United States Patent 11,549,145 (METHODS AND COMPOSITIONS FOR INHIBITING AND TREATING NEUROLOGICAL CONDITIONS) - sequence listing, part 52

SEQ ID NO: 1179 - DNA, 1235836 bp, Homo sapiens
ctttctaaaccaggttgaagtcagacaagccaccatcttgaagaaacctaccctgccccgtgtgccttatttttaagagttggattcacttcctttccctacagaccccaccagaaacacaaaccacctggttgcctgttgtcattgcggccaactacatggctgacggggtcagtgggtcaggagagcaggcagcctgagagctagggcctcctgttttatcagaaggtctgtgcctgtgcccggtgtgtgatttgcagactagatttgcaaacagcttcctagcacctgttacaggaacctggtacactggtgaaggggtaggggaccagaatgctatttaatcctcaaacaactagtgagattgttctctttttcttcttttttttttgagacagagtctcgctttattgcccagcctggagtgtgcagtggcccagtctcagctcactgaaacctgcatctccaggttcaagcaattctcctgcctcagcctaccaagtagctgggattacagatgcacaccaccatgcccacctaatttttgcatttttaatggagatggggtttcaccatgttggccaggctggtctcgaactcctgacctcaagtgatctgcccatttggcctcccaaagtgctgggattacaggcgtgagccctcacacttgagattgttcttaatactctcatattacaaatgaggaaactgagtctcaaaggggttctgtgactcacccaaagacaacacaatccaggcacttgatgctctcatggtgggaagtttgacagtttgcctgaaactgaaagatgctgagttactaacaagacttgaacctaagtccaggccaagctctctgatacagattcctggccagattgcagctttgctttggtcttcagtttttcttttctttctttctttttttttttttttgaaacggagtcttgctcttgttgcccaggctggagtgcaatgacacaatctcagctcactgcaacctcagcctcccaggttcaagcgattctcctgcctctcctgcccctcctgagtagctgggattacaggtgcccgccaccacgcctggctaatttttgtgtttttagtagagacggggtttcgccaagttggccaggctggtctcgaactcctgacctcaagtgacttgcccacctcggtctcccaaagtgctgggattacaggtgtgagccacctcacctggccggttttcagtttttctggttcagtttcccttacctcacatttcaatgaaaggggaagtggaaggggatagagtggaggtttgcgtaaggctttacatggaaattgcaggaatcaattgatctttgtgctggggctaccttggggaaccagagtcgtaacagattaacaactctggcttgggaatcagacacctgggttgaactctgtccgctattaacctctctaagctcttttcctcctttgtaactctacccaccttagcgaattgtaaggaggggcacatgaaatgaggcacgtaaactacatagcatttaattaatgctgggtaagtggaacacagtattaccaatattttgctgggtcatgtaagaatcgtctgtaattaactaataaagctcttatattccctccctcctaatcagggattggaaagaatttttaaagtactctcagttttacaaccttcctaaaataggagagctttgccttgctacctgaatttattgttacttttttccttttctttttctgagacagggtctcactctattccccaggctgaagtgcagtgatgtgatcacagctcattgcagcctcgacctcctgggctcaagcgatcctcccacctctgcctctggagtagctgggactacaggcacgcacccctatacctggctggtttttaaatagttttgtagagacaaggtcttgatatattgcccaggctgtgaatttctcttcagggatattgaagatcaaagtgtttttaggaagggtgaattggtgttccactttcaaattttgaatagggtaatactgatggaaaatttgtagtcgccagagtatttgggtccactggcctttttttatttttatttttttgagatagagtcttgctctgtcacccagtcaggagcacagtggtgcagtctcggctcacctcaacctccaaatcctgggttgtgtagtggtacaatcttggctcaccgcaacctccacttcctgggttcaagcgatccttctgcctcagcctctcaagaacctggaattacaggcatatgccaccatgcctggctaattttgtatttttagtagagacggggtttctccatgttggtcaggctggtcttgaactcccaacctcaggtgatctgccagatcagcctcccaaagtgctgggattacaggcatgagccacgcgcccagcccactagcttttttaaaaagacagaaattaaaatttcaaaatgttcaaatgttcaacatttcacaaaatgtttggaaggtagagaaagtaaccaatagacccactattgtaacctgattgtttttgtgaattgttagtttttgaaaaaataatcgttctgctataatttttatactctgctattctcacttcgtatttatcattcctttaaaatttatctagttttagagtggagattatgttttcttttttttttttttttttgtttgagacagggtcttgctgtgttgcccaggctggagtgcagtggcatgatcacagctcactgcagcctccacctcccaggctcaagcgatcctcccacctcagcctcctgagtagctatgactacaggcacgctactacacctggctaatttttgtattttttgtagagatgaggttttgccctgttgcccaggctggtctcttaactcctggactcaagcaatctgcctgcctcggcctcccgttacaggcttgagccacggcgcctgtctatgttctcttttcactgttgggtcagagggtcatattgttggatgatagtgatggttactttgcattttggaatgggaaacttaaacatgaactgttatacggtactctactgaatcttttaaaattttttttgggttttgcaaataggtatgagcattctccaaggaaaggatgacatatttttggacctgaaacagaaattctggaatacctatctggtaagataggcgtttgaaaatgtaatcactatatttttgtgtatatatgtatatatatgtgtataaaaatatatgttttgtgtttatatttataaagattaaaaaatcttttaattgacacatataagtacatattttcatatacatgtgataatttgacacgtgtttaatcacatcaggatttttttgtatgtgtgtgtgtatatatatatatatatatatatatatatttttttttttttttttttttttttaattaaaaaaacctttttcgagacagggtctcattctggcacccaggctggaatgcagtggcatggtcatggctcactgcagcctggacctcctgagctcaagcgatcctcccacctcagcctcctgagtagctgagactacaggcatgtgccaccacacccagctaattatttttaaattttttggtagagacagagtctcactatgtagcacaggctggccttgaactcctgtgctccagtgattctcccacctcaacattaagtacatttttattaaactattcctaaattagagctccagtttggttgacagaagggtccaatattttgacatagaaatcttaaagttattttgatagatgtatgaggagaggttttaagagtatctgtacttctcatgaactggaaagaaataatgtctctgggcccggtgcagtggctcatgcctgtaatcccaacacttgggaggctgaggcaggcggatcacttgacgttaggagtttgaaaccagcctggccaatatggtgaaaccctgtttctactaaaaatacaaaaaatagtcaggcacggtggtgcatgtctgtaatcccagctactcagtaggccgaggcaggagaatcacttgaacctggagacaggttgcagtgagccgagatcgcaccactgcactccagcctgggcaatacagcaagactccatctcaaaaaagagaaaaaagaagaaaagaaaagaaataatatctctgaattttagtccatgttctcagtgatttctgactttattatattaactcttagtaatgatcacaatttactttgtaaattttgcagccaaagggacaacaatttattctgtaaatttgggattctatttgcaaaatagagattatagattgtgagtggcttaatggaatcattcccacattcagagccaatgttttcaggtgagcatcctgcggagtcctggtgaaaagaactttaacatcacaaaggtattgatagagaaggagaaggtttccaagggttattccaaggtttgaagcaaatcagcatttttactgtttgctcggcacaaatatatacagtccagtccaatacatatttattcattgattcagttaatatttattgaacagtgtccttaaggcctggcaaaatcagggatggttttcatctctgccctagagcatgtttgattgcattcatcacaaggaggtaaatctttgggattacagaatgttcgcagactggcctagggcttcacatgttcttccttccctatcaaaagcagtgttgagccacacccagctattacctccacagcttctagcatcatctgttggatggtaccaggcccctgagccagcattacttgatggctagaggcagaggatggagaggtttgaagtcagaggcttcccctgagcctctatactcaggaacagtaactataagtgtgttcagaactcttgtgatttctcttagggcagaaattgaggaccccatggtgacaaccaaatgtgattttcttctggttttgttttttgtttgtgtgttttggtttttttgtttgtttgtttgttttttgagacggagtcttgctccgtagcctaggctggagtgcagtggcactctgcaacctttgcctcccgggttcaagcaattctcaattctcctgcctcagcctcctgagtagctggaattacagacttgcaccaccacatccagctaattttttgtatttttcagtagagatagggtttcaccatgttggccaggttggtcttgaactcctgacctcaggtgatccgcctccctcagcctcccaaagttctgggattacaggcatgaatcaccatacccagccacttcttctgttttactttagaaaaaggaacaagtttttccattatgttgtaaagtctatggagatatgtacatctaacttttttttttttttttttaaagagcaaggaccggaggcagtagctcatgcctgtgatcccaacactttgggaggtggaggcgggtagatcacaaggtcaggagatcgagaccatcctggctaacatggtgaaaccgtgtctccactaaaaatacaacaaattagcagggcatggtggcacaagcctgtagtcccagctacttgggaggctgaggcaggagaatcacttgaacccgggaggcagagactgtagtgagctgagattgcgccactgcactccagcctgggcgacagagcgagactccgtctcaaaaaaaaaaaaaaaaaaaagagcaagaagtaggcagctcacacctgtaatcccagcactttgggaggctaaggcaggaggatcactagagcccaggagtttgagaccagcctgcgcaaccatagtgagaccccatcgctacaaaaataaaataaattagctgggcatagttgcaagtgtctgtggtcccagctgctcgggaggctgagatgggaggattgcaagcctgggaggtcgaggctgcagtaagctgtgattgcaccgctgcacaccagcctgagtgacagagtgagaccatggttcaaaaaaaaaaaaaaagagagcaggaagtagaattgggaaagaagcttcaggcagggatttgtaaatgaacaaaaccacaggaacatttgcatactgtttaaaaaaaaaaactggttacaatgagtgagtctcatctaccctcaggagaagaaagagggcaaaccagtagtctgaagcccagcccatctggagattttttgggaagatttcctttaaagaggcaggatggctcacgcctgtaatcacagcactttggtaggccaaggcaggcggatcatgaggtcaagggatcgagcccatcctcgccaacttgatgaaatcccctctctactaaaaatacaaaaattagcatgagcccaggaggtcgagactgcagtaagctacgattgtgccactgcactccagcctgggtaacacagtgagaccctgtctcaaaataaaaaaataaaataaaataaagatctgaagttatgcacatactgggggacaggtcattccaggggcagaagagctgagtacagttgacaatgcgtaaagcaccatggtatgcctggaggggagaaaccacaggcagtttggtgttcacagagtatttgttgagcaacttggaatgagtttggatcctggagactgttgaacacccagagctgaggatcttgaacttcacagttaggtaatggcagcaaaggaaaccaaagtgggtggttatcgtgaccaagttcacataagaaataaggaagcatatcaggtgtggtggctcacgcctgtaatcctaacactttgggaggctgaagcaggaggatcccttgaagttaggagttcaagaccagcttgggcaacatagcaagaccctgtctgtatttaaaaaaataaacatggtggctcacgcctgtaatctcaccactttgggaggccaaggcgagcagatcatatgaggtcaggagttcgagaccagcctgaccaacatggtgaaaccctgtctctactaaaaatacaaaaaattagccaggtatggtggtgagtgcctgtaatcccagctactcgggaggctgaggcaggagaatcacttgaacccgggagacggagattgtagtgagctgagattgcaccactgcactccagcctgggtgacagagcaagactccatctcaaaacaaacaaacaaacaaaaaagaaatgaggtgagttcagcttgggaaatgttgaatgtcagatgcctttggcctattcagagggagattgccgaagcacagaggagagttcatggcagggtttaattatttttagcgctcacatgtcccagattcggccagtgggagttcccccaagctggttcctgtgtcctgtgcatcacccatcttctttctcctttacttctttcttaagccacttcctttctggcatgacagcgtgttccaggatcatcttgtacttgcacctgccctgccctggccctagaatcagccaattctttgaggcatcctgcttccttttagtgggggaatgatttgagaacaaaatatactactacatgatactacattctgacaagaaaaaaaacacagccataagaaataaagccatggccaggcacagtggctcctgtaatcctaaccctttgggtggcggaggttggaggattgtttggggtcaggaattcaagaccaacctggcccgcatagtgaggcctcgtctgtattaagaaaaaaaaaaaaaagaaagaaggaaagccatgtttggataagtttagtcttctgattatttttgctaaagttttaattttttttttttttttgagacagagtctcgttctgttgcccaggctggagtgcaatggtgcagtctcagctcactgcaacctctgcctcccgaattcaagcgactctcctgcctcagcctcttgagtagctgagattacaggttcctgcaatcacgtcctgctaatttttatttttagtagacacagggtttctacatgttggtcaggctggtctcaaactcacgacttcaggtgatctgcctgccttggcctcccaaagtgcagggattacaggggtatattttatatttaaagcatatttaacaattaagggccaggctcggtgtctcacgcctgtaatcccagcactttgggaggctgaggtgggcagatcacctgagctcgggaatttgagatgcacaacaagagcgaaactccgtctcaaaaaaaataaataaatataaaatatacattatggccgggcatggtggctcacgcctgtaatcccagcacgttgggaggccaaggcgggcagatcacctgaggtcaggagttcgagaccagcctggccaatatcatgaaaccttgtctctactaaaaatacaaaatttagccaggcatggtcgtgtgcacctgtaatcccagctactcggaggctgaggcaggagaatcacttgaacccaggaggtggaggttgcagtgagccaagatcgcaccattgcactccagcctgggcaacaagagcaaaactccatctcaaaaaatatatatatatacatacacatatacgtatatatgtgtatatatacgtatatatgtatatgtatacacacattatatgtaatatctacttttaaatataaacataaatattataaagcttttattgcaattgttcattttagaaacttcagaaaatacaaattagtaaaaagaagaaaataagtctgtaataccacttttaaggactattttgaaaacctctagctgttttttgagataaatttacataccaagacttttttttaaaaaatcataatgatgactttttcataggactgtgtaggataaagcttgtgaaatgtctatctaacatattttgtaatatatgaaaatttcagctaaacttgttctatagcatcacatggtttcaatatattattagaaaatcattccataaacaatggtttggtatatagtttcaacaattcaaggctgggcacagtggctcatgcctgtaatcctaccactttgggaggccgaggcaggcaaatcacctgaggtcaggagttcaagaccagcctggccaacatggtaaaaccctgtctctactaaaaatacaaaaattagccgagcatggtgtcaggcacctgtgatcccagctactcaggaagctgaggcaggagaactgcttgaacctaggaggcagatgttgcagtgagccaagatcttgccactgcactccagactaagcgacagaatgagattccatctcaaacaaaataaataaataaaataattcagcaggatgaggtggctcatgcctataaccccagcactttgggaggctgcagtgggactactgcttttgcctgggagttcaagaccagcctgggcaacatagagataccatgtctcagaaaaaaaaaaattaatttaaaaaaaaagaattcattgatgattctgtatttacaaatatattcctgcatcatttgttcatggtaaccaggaaattgcaatgcatatatacatgctgtcatttccaaagccgctgtcttccagaattggtactgattctagtagacttttcattctggtgttaaaaatataattaatataggaatgtcttctacctaatagcttttttccccacaactccccaaccccctcactctagaggccttaagtagtctaagttaatcagcttagtctgaaatataatactacctaggcatcttgttggcctagtatttcttactcttttatggaatgaactgtgcaattgttttgtgtggttaaaaggtattctaggtcaggtatagtggctcacacctgtaatcccagcactttgggatgccgaggtggtggatcacctgaggtcgggagttcgagaccagcctggccaacatggtgaaaacccgtctctactaaaaatacaaaaattagccaggtgaggtggtgtgtgcctgtaatcgcagatactcaggaggcagagacacgacaattgcttgaacccaggaggcagaggttgcggtgagctaagattgcaccactgcactccagtctgggcaacagagtgagaccctgtctcaaaaaataaaaaacaaaataaataaataaaaaataaaaggcaatctaataaagttgttgctttttttttttcccaattccagagtggactgatgtactggccctttgtacaggtaagttccacctactcagtaatatgaactcagggctttggtttccatgtggccctaacggactctctctctgttccagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatacaaagcctgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacactttattaacttctacaccagcagatttaaaaattatgtaactatctcaagaagtttcacttggacgtagtggttcacgcttgtaatcccagcactttgggaggctgaggtgggaggattgcttaaggcaaggagtttgagaccagcctgggcaatacagcaagatcccatctctattttaaagaaaagtttcactttgggaggccaaggcggttggatcacaaggtcaggagatcgagaccatcctggctaacatggtaaaaccccatctctactaaaaatacaaaaaattagccaggcgtggtggtgggcgcctgtagtcccagctactcgggaggctgaggcagacgaatggcatgaacccgggaggcagagattgcagtgagctgagattgtgccactgcactccagcctgggtgacagagtgagactccgtctcaaaaaaaaaaagtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgtaggccgggcacagtggcttacgcctgtaatcccagcactttgggaggccgaggcgggcagatcacgaggtcaggagatcgagaccatcctggctaacatggtgaaacgccatctctactaaaaatacaaaaaattagctgggcatggtggcgggcgcctgtagtcccagctgctctggaggctgaggcaggagaattgcatgaacccgggaggcggagcttgcagtgagcagagatcaggccactgcactccagcctaggcgacagagcgagaatctgtctcaaaacaaacaaacaaacaaaaaactgtacccaagttaattataagtactacctggtgcaaaactttacagaagctgtggtatcacttttatgatagaagaatagtgtttgcattttgtataaaagtacttggggctgggcatgatcgcttatgtctataatccaagtgctttgggaggcgaaggcaggtggatcatctgagcccaggagtttgagaccagcctaggcaacatggcaagagcctgtctctccaaaacctacaaaaattagccaagcatggtggtgtgagcctgtagtcccagctacttggaagactcatgcaggaggatctctcgagctcaggaggcagaagatgaataaataaatggatgcaactgaatgagatgaggtctctcttgaaggagagagcaaaagagatttaaataataacaattataagaaggctgggcgcggtggctcatgcttgtaatcccagcactttgggaggccaaggcaggtggatcggttgaggtcaggagttcaagaccagcatggccaacacagtgaaaccccgtctctattaaaaatacaaaattaaccggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcagaagcatatgcccagtttacttgtaattaaaaatcatgcatcattcacaatttatcagtcttttttgtttgtacaaaaactaatataagttattctcttttatttgtattgtgattggtttgatgagagggaattaggccacttgagagtttgtgcgtgtttataattttctggctgggcccggtggctcatgcctgtaatcccagcactttgggaggccaaggcgggcggatcacttgagctcaggagtttgagaccaacttgggcaatgtggtgaaaccctatccctaccaaaaatacaaaaattagccgggtgtggtggcttgcacctgtcctcccagctacttgggggtgctgaggcaggaggatcactcaagcccaggaggtggaggttgcagtgagccgagatcacgccactgcactccaggaagggcaacagagcaagactgtgtctataaaaaaaaaaaaaaagaaagaaaagtaaattaactttggtatttcaggttgtatttatatggggacttcacatcaactatgttcactacaattgaccaagttaagtgtagacagtctctttaatagagagattatctggaactgcaattttttttttttttttgagacagagtttcgctttgtagcccaggttggagtgcagtgtcgcgatctcgcctcactgcaacctctgtctcccgggttcacgccattctcctgcctcagcccaagtagcagggactaaaggcgcccgccaccatgacccactaattttttttttttttggatttttagtagagtcggggtttcactgtgttagccaggatggtctcaacctcctgacctcgtgatctgcctgcctctgcctcccagagtgctgggattacaggtgtgagccaccgcgcccggcctggaactgcaatttctaactcatacatcattgctataaaccttatttgtttactgtttctcttccaaggacggtcagtcatcctttaaaattcatttgaagttatgaaaagatagtttttgttacatgggaaatttacttttagtacagtaaaatgttatgtgaatttctacagaatgtttgctagaatgaattatatctaggatatgcttaacaatatattctggaggcagctttcatttgaaattaggttcatcttctgagagtattaaaaagttaatgggtttttgtgcctgaagattttgatgttgcatttggctacatttaatccactttcacccataaggtttagcatctaaaaaaattaaatcactgctaatgcaattaaaatgactgaaaaagtttcttttaatactttcaacagctgatacataaaaagggaaatctggaatttgaagataaagtatgtgctggagttgaaaggttaggaacacatgaagatctgtgaactgtagctaaccttgtgaatagaaggcagtaattactgagtaacatttttggtatatatcaagtaaaagcttgtcttttcctagttctcttctcctttgttaagtgtatccttctctaactacatctttattcatccttttcttccttcctctttctttgtccacaacccaaccaaacccactgctctctcctctcaccccctgcccgtgccatgaccacttgaacattccaggagggcagaataattgtaataaggctaagggcttattacacttcttacacttaaggactcaacagccttgctttagagaggatggtagcggaggatcctctctggtctctgtgagaagaaaagagaaaggaccatcctacggagaatttatttttatttttatcttttttgagatggagtctcactctgttgctcaagctgcagtgcaatggcatgatcttggctcactgcaacctccgcctcccaggttcaagcgattctcctgcctcagcctcccgagtagctgggactacaggcatgtgccagcatacccagcgaatttttgtatttttagtagagatgggatttcaccatgttgcccagactggtcttgaactcctgacctcaagtgatctgcctatctgtctatgatattttaggttggcagttgcaaactaatggtccacagcgtgctttttatgacacctagaaggtttgaagactttgatttcatagtaaaaatctgggtttcaggctgggtgcggtggtgcatgcctgtaatcctagcactttgggaggctgaggcaggtggatcacctgaggtcaggagttcgagaccagcctggccaacatggtgaaactgtctctactaaaaatacaaaaattagccaggcgtggtggcatgtgcctgtaatcccagctactcgggaggctgaggtgggagaattgcttgaaccagggaggtggaggttgcagtgagccaagattgcgccactgcactcaagccttggcaacagagcgagactccatctcaaaaataaataaataaacaaataaataaatatataaaatctgggtttcaggccaggtgtggtggtgcactcctgcaatcccagcactttgggaggcggagatgggcagacagcttgagcttaggaattccagaccagcctgggcaacatggcaaaacgccatctctacaaataacacaaaaacattagctgggtgtggtagagtgcgcctgtaatcccagctacttgggaggctgaggcgagaggattgcttgaggctgggaggttgagccacgatcacactcacacacttcaacctgggcaacagagccagactgtctcaaaaaagaaaaagaaaagaaaaaagaaaagaaaaaaggaaacgtctgggcacatgcctgctacagtcctctatgaagcaatgtgccgcagcaggggtccctaatccctgggccatggacctgtactggtctgtggcctgttaggaactgggccacagagcaggaggtgaatagtgggtggacaattgaagcttcatctgtatttctggccgctccccattgcttgcattgctgcctgagttctgcctcctcttagatcagcagcatcattagattctcataggagcataaaccctgttgtgaattgcacacacaagggatccaggttgcatattccttatgagaatctaattcctgatgatttgtggtggaacagtttcatcccaagaccattaccatcctgcgctccatcccttgctgcctgtggaaaaattgtcttccacaaagccagtccctggtgccaaaaatgttggggactgctgtgctttagaatgtgccttgaatctgcagcctctattgtatagttccctatagactttgcttcctaccatcttacattctgccttataggcatttgtgtttgcaactcttgtttttgttagtatgctacgctggtgacattgaccaaattgaccacacattaattataagcttagttggtgatgacctcaatggaataacgtgacataagtactgtgacaatacttcttgcatgtatctgctggtagaattgtaaacctggtggtccgagatggtctaattcgatcttcctatgtatctacttatattaatagtggtagcatttgaggtggtgattcagagtttcaatgcctcttctcatggcaacaacaaatgttttccttctgaatcagcattaacctagatgttactgcagatcaaaattagactgtacattttcaaccacagaaatattgggcagtaaacatttttcttaatattgattgcctacataggttatgtaattagcatatgtttatagttttgtgatttatgtgtggctgctactgagccagagggggtaaagcaacagcgttttctcagttgtgtgagcagcattacgttataatgaataggtaatattaaattgggctgatgaatcatattacagtaatccaatatttcacttgtaaagtccctgaggtttacagaaggaaattttttctaataacaagaagagtgaggcatgtgctttggtctttatttcctagttatacgatcctgggtaaggagctcaacctttctctgccaaaattaaatgaggattaaatgagatcatatatgtgaaggtgtgaaggacagtgcctggcacatagtgggatcaatcaatgttagtatctctaaaatagagattgagtctgaaggttcataaagtggtagaacagatcttaagattcccaaatgatagaattgttatttatttgcctaagtagtagtagattacttattgtatgtccaggggatccttttttttttttttaataatttttatttctttaagacagagtctcactctgtcccccaagctgaatgcagtggcaccattttggctcactgcaacctctatctccctggttcaagcaattctcctgcctcagcctcctgagtagctgggattacaggtgtgcaccaccatgcccggataatttttgtagttttagtagaggcaggattttgccacgctggccaggctggtcttaaactcctgacctcaggtgatccagctgcctcagcctcccaaagttctgggattgcaggcatgagccactgggcctggcctttttttttttttttgtgaggcaggatctcactctgttgcccaagctggagtgcagtggcactaccatgcctcactgaagctttgaactcactggctaaaaagattctcccacctcagcctcctgagtagctccatgggtatgcaccaccacaccccattattttattttttgagaaggagtctcactctgtcacccaggctggagtgcagtggcatgttcttgactcactgcaacctccacctcccaggttcaagcaattctcctgcctcagcctcctgagtagctgggattataggcgcatgctatcttgcctggctaatttttttgtatttttgtattttttaactagagacagggcttcaccatgttagccaggatggtctcgatctcctgaccttgtgatctgcccacctcggcctccaaaagtgctgggattacaggtgtgagccaccgtgcccagccctggtattttttttttttttttttgtagagatgaggtcttactatgtggcccaggctggtcttacattcctggactccgaccttgacctcccgaagcgttgggattacaagcatgagccacctcgcccagttcccttcttaaatagttttaagggggagaagaaagaaaaagactgattttcttcccttccactaccaagacaggcaaaacacaccagaacactttgcttagcatttcttttctaaagtgaccaaaatttataatagacacttaaaatgtgtactggaatatatcccaattatatccccagtctataactcagctatatgcagctcctttgtcttattaatgctatgaatcagcaatagtttatgttttcatatcacctgaggccatgcaatcctcttttttggttgttgaaataatttctataactatttcacaatttcaattgccaacattaattcaacagtatttaagctgtctgtcccagacactatgctagcctttggagatttccaaggtgaataaggtgaggacccggctatttgcctacggtctagcagacagacctttttttttaattttttgagactgagtctcgctctgtcacccaggctggagtgcagtggtgcgatctcagcttactgcgagctccgcctccccagttcacgccattctcctgcctcagcctaccgagtagctgggactacaggcgcccaccaccacacctggctaattttttgtatttttagtagagacacggtttcactgtgttggccaggatggtctagatctcctgacctcgtgatccgcccgccttggcctctcaaagtgctgggattacaggcatgagccactgcgcttggccaccttttttattttttatttttatttttttgataggagtctccctctgtctcccagcctagagtgcagtggcacgatcgtggctcactgcaacctctgcctccagggttcaagtgattctcctgcttcagcctcctgagtagctgcaacttacaggtgtgtgtcaccacacccagataatttttgtatttttagtagagacagggtttcgccacgttgtcaggctggtctcgaaatcctgacctcaggtgatctacccgcctcagcctcccaaagtgctgggattacaggcatgagccaccgcacctggccagcagacagacttctaagcaaattacagctaccactttttgtatgctcactaactgtagataagggtctatgccaagccctttacatcatgtggtaattgatatggtgtagttgagtggtttctaccatcgatttccttacctcccccacttcccaacagctcccagttcctttttggggatcttcccagaagatgactttacttggctcaagaggtggagcacatgacagattaagccaatcagggcgtttcatgccccttgctacagggttcagagacaatcatgttatctgcagctgcccaattagagtgaatctcataacctttgatggaaaaccaggacaaaggcatattctctcattgtgtcatagagatgttaatatagatgtaaggcctaggactaccatagccattttttgttaccgtgaaagacatggaggcaagagggtatcactgaaagaatctcagagaaaccctgatgatttcataacctctgatatagcctatgcccaaagcctgctctgggcttttctgttataggagctaggagattccctttatttttcaaaccactgggaattaggttttctgttacttgaaggaaagcatcataaaggatacacaggaccttttttataacacagtagatattattctcattttatttttgtgtgttttgttttgttttgttttttaagacagagtctcgccatctcagctcactgcaacctccacctcctgggttcaagcgattctcgtgcctcagcctcttgagtagctgggactataggagcgcaccgccatgctgagctaatttttgtatttttagtagagacagggttttgtcacgttggccaggctggtctcgaacccctggcctcaatggatccacccaccttggcctcccaaagtgctgggattataagtgtaagccaccacactcagctgattcatttattttcatttttttttgccatacaaaccaacaacttgcaaactcccattataaacatttccagaaatttatggggtacaggtgcaattttgttgcatgcatagatttcatactggagaagtcagagcttttaggctgtccatcacctaaatgacgtgtattgtactgaataagtaacttctcatcatccacccacctcccacaccctaacccttctcaatctccatcatctatcattccacactctacatttctgtgtacacattctttagcttccacttatgagtgagaacatgcaatatttgtctttctgtgtctggctggtttaagataatggcttccagttctgtccatattgctgcaaaggacatggtttcattcttttaatggttgaatagtattctattgcgtatatgtatcacattttctttttttttttttttttttgagacggagtctcgctctgtcgcccaggcggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcccacattttctttatccactcatctgaagatggacacttagattgagtccacatctttgctatagtgcattcactctcattgttatagttgagaaaacaaaggtccttgccctttgccactaagccaatacatggcagagtcaggttgatttccaaacccacactcttatgatcatgcttctagtaactccagtgcagtttaagaggtatatcaaagatacagtagtgacagccaggcatagtggcaggcacctgtaatcccagctacttgggagacaggagaatcacttgcaccggggaggtggaggttgcagtgaaccaagatggtgccactgcactccagcctggtcaacgtagcgagactccatctcaaaataaataaacaactaaataaataaaagggatacaatagtgacataaaggaatgatcagctcattgtgtgtgtgtgtgtgtgtctggtggccatggagatattccagggcaccagacatggacaaaagtatgaagtgaagggctcatggtatatgctaaataaatgtttctattttattttcctttgcgcttctgagaaatttgctgtgctagggaatcttagtgggaggttccaaatgtctctaatgggtccttaaaagtaacacaggggactgagagttactttcaaaaagctagtattttaaaacaggttgtgcagatgaattcagacttttgtttgtttgtttgagacagtgtctcattctgttgctcaggctggagtgaggcagtacaattatagttcactgtagtcttgacctgctaggctcaagcaatcctcctacctcagtctctggagtagctgggactacaggcctccacacctgcataatttttttttttttttttttttttttttgtagagacagagtttcaccatatagcccaggctggtcttgaactcctggcctcaggcagtcctcctgcctcggcctctgaaagcattgggattacaggcatgagccactgtgcctggcccagacaggcccagacttctttaccatggatgagatctttgtcaactcagtgtggccatctcacgctgctttgtcaacaagttctttttttttttttttttttttttttttttaatgagacagggtcttactctgttaccaaggctgcagtgcagtggttcaatctcggctcactgcaacccctgcctcctgggttcaggcaattctcctgcctccgcctcctgagtagctgggattatgggtgcccactaccacacccggtggtacataataataatttttctatttttagtagagacagggttttgccatgttggccaggatggtctcgaactcctggcctcaagtgatccgccctacgtggccatccaaagtgctggaattacaagtgtgagccaccgcgcctggccacattctatcatttttatattggtttagtccatcctgtctttgattccactgccattgcttatttcagatcattgctgtttctcatggagacccttgatactcagagtgtggtccatggatcagagtctcaacatcacctgggaacatctaggaatcttagatacccacctcagactctctggattagaatgtgcattttaacacactgaaatttgacaagcactaataaattttttcactagagtcttccaatgatctcccgactctagtttggttttgttttttcagagatagggtctctctctctctctctctctctctctctctcacccagttgagagtgcagtggtgcactccatagctcactacagccttcagctcctgagctcaagtgatcctcttgcctcagccttctgaatagctaggattacacatgcatgccattacatgcagctacgtttctactttttgtagagacagggtctcactatgttttccaggctggtctcgaactcctggcctcaagagatcattccaccttggcctcccaaagtgctgagattagaggcatgaaccactgcgctgggcccctgcctctagtttttttgtttgtttgtttgttttgagacagagtctcactctatcacaaagtctagagtgcagtggcgcaatcttggctcactgcaaactctgcctccagggttcaagcaattctcctgcctcagcctcctaagtagctgttccaagcattttgagaggtggaggtgggcagatcgcttcagcccaggagttcaagaccagcctggacaacgtggcgaaacccatctccaccaaaaatacaaaaaattagctgggtgtggtggtgcacctcagtggtcccagctagacaagaggctgaggtagaaggatcacttgagcccaggggcggaggttgcagtgagccgagatcctgcaactgtgctccagcctgggtaacagagcgagaccgtgaacattaaataaaaatggattgtctaggggagagagaagttgagaccaaaatagttcaatgctagtagagagtaagggacagagtataggttaataaatttagatttacctaggtagtatcagccagatttgtaggtcaaagtacaaatttacggccgggcaccgtcccagcactttgggaaggtgaggcaggtggatcacttgaggtcaggacttcaagaccagcctggccaacatggtgaaaccctgtctctagtaaaaatacaaaacgaaattagccaggtgtggtggcgctgcctgtagtcccagctactagggattctgaggaaagagaattgcttgaacccaggaggtggaggttgcagtgagctgagatcatgccactgcactccagcctgggccacagagtgagactgtctcaaaaacaacaacaacaaaaacaaagtacaaatttactggtttcaatgactagctcaaacaaaggtgtcatcagctgtcataggaaatacacaagataggatctggaggaagatattaaatttgaagtgcttctgggatatctagtctagtggtgctgcccaacaaagagttgtatagacacatctggaaatataagttcgtaaacttttagcatgtctttactcactttactgtttagtttaggtgaacctttttccagagggtaactcccctgcatagatgatggtaaaaaactgtagagactaaggttggggttataaatacacagtaaatataggtagaatgcaaggaattttttttttttttttttttttttttttggagagacacgatctcaccaagttgcccagcctggccttgaactcctgggctcaagcaatcttcgtgccttgaccttccacagtgctgggattacaggtatggggtaccacctccggccagatgcaaggattttatttcctggatggagcagcattttggagcatccagaaatatcagccctgtatgcaaggggatgctgttgaatcaattccacatgaaatagacaaggcatactagcagttatgttaggatgttattatttgagccatacacagatcagggggcactttagaatttttcttctgcttactcagttcattcatacgttcaacaagcattggctgggtatctaccacgtgcctttcaatatttcagctctgatgatttgaaagtaaatagaacacatttctacttcatgggtatcctcatgtaaatatgtgatttataaatgagttgtattactcacgcacatttcttttcttttcttttctttctttttttttttttttttttttttgagacagagtctcactctgttgcccaggctgcagtggtgtgatctcggctcactgcaacctctgcctcccaggctcaagcgattctcaagcctcagcctcccaagtagctgagtagctgggattacaggcacacgccactacgccttgctaatttttgtatttttagtagagatgggatttcaccatgttggccaggctgatctcaaactcctggcctcaagtgatttacctgcctcggcctctcaaagtgctaggattacaggcataagccaccatacccagccctcacacacacttctggtgagtataacttggcatgacacttttgaaggatggcttgataatataaaatgcctttaaaaatgtgcatatcctttgattcagcaatttcacatcaaggaatttttcccaaaagaataagatatctacaaagctttaactgcaagactgctcctcatattttgctgataatctcgagaatttaggaataacctgtttgtccccagaaccaaggagattggttatataaattattctatagctagcaggaaaccagtggatgattttctttttaatttttttttttttttcagagacaggttcttgttctgtagcccaggctggagtgcagtggtgtggtgatcacagctcattgtaacctcgaactcctaagctcaagcgatcctcccacctcagcctcccaatggaggtttttaagcaggagagtggcattggatgtgtgtgtgtgtgtatctaattttagaagtcgtgtggagaatggttttcagtagggagaaaaaaaacccagaaaagatgttttttgccacagtgtaggtcagagatgatgcaaaattgagctaacttaggcagtaggaaggaggaggagaatcagatttgggagctatttccaaaatagagtcaataggatttgttgactgactgtggcagagagtgttgggatgttgcagaataaggtaccaaggatatactgagatttccaactcggatggagcaggtatgggggctgatatagtgaatctgactttgaatatgatcaggttgaggttataaatccctcttcatgggcactgccatggtggtttcttgaaacacctttgagaggtgatgtgggatgtggcgaagtgtttaggctttgagactggctggctgagtttgaatgctggttctgccatgtgttagcaagtaatttacttacccaaactctctgagctacagcccctgtctcacaggatactacagcatagaatgaagaaggataaatctggtacagtgcccagcacatagtaaccacgcaataaacatcagctttaaaaaaacagacaatgcgggctgggcgcagtggctcacgcctgttatcccagcactttgggaggccgaggcaggcggatcacaaagtcaagagatcgagactatcctggctaacttagtgaaaccccgtctctactaaaaatacaaaaattagctgggcatggtggtgcatgcctgtaatcccaactactggggaggctgaggcagaacaatcgcttgaatctgggaggcggagattccagtgagccgagataacgccactacactctgacctggcgacaaagcgagaaagcgagactccctctcaaacaaaaaacagtcaatgctgcctgtaatcccagtattttaggaggctgaggtgagcagattgggctgaggttgggaattcaagaccagcctggccaaaaggtgaaaccctatctctaccaataatacgaaaaattagccaggcgtggtggttcatgcctgtaatcccagctacttgggacaggcgtggtggttcatgcctgtaatcccagctacttgggaggctgaggcaggagaatcgtttgaacctgggaggcggaggttgcactgagccgagatcgcgccattgcactccagcctgggggacagattgagactccatcaaaaagagaaaagaaaaccacaaaaaaactcagacaattctataatagagggagaatacgcatgcaacccagggatttttctcagataccctacccattctcaaatagcatgtgctctaagctcctatggtaaaagcttcatgcccctgcaaaactcacacacctgatcccactcctcaagcacttcatggagaagcagcagctcccagctctataacagataggggatttcaggtcctaagtcttgagagcaaatatttcctcaacttcttttctctctctcaagcctcctttaagaggaatacatactatgctttctggaactctgttctaccttccaaacccatttatatcttttacgattttttttccccaagattgcggatattttctattttttttctggagacagtctcgctctgttgcccaggctggagttcagcggtgcgatctcagctcactgcaacctccacctcccgggaggaactgccagaccatcttccaaagaggttgcaacattgtatattcatggtatgagagatctaatttttctactcaatgtcattttaatggtgtggtgttttgttttgttttgttttgttttgttttgttttgtttgagacaggatttcactgccactcaggctggagggcagtgatccagtcatagctcactgcagcctcaacctcctgggttcaagtaagcctcccaccccagccccctgagctgctgggaccacaggcacatgccaccactcccggctaattttttaattatcacttgtatagatgggatctccctatgttgcccaagctggtcttgaactcctgggctcaagcaatccttttgcctcaatctcccaaagtgttagtgagaggtgaagcccgctgcatttcctgtatggagtggggacttggagaacttttctgtctagctaaaggtttgtaaacgcaccaatctgcactctgtaaaaactcaccagtcagcgctctgtgtctagctaaaggtttgtaaacgcaccaatctgcactctgtaaaaacgcaccaatcagcaggacatgggcagggacaaataagggaataaaagctggccacctccaaccagcagtggcaacctgcttgggtccccttcaacgctgcggacgctttgttctttcgctcttcacaataaatcttgctgctgctcagtctttgggtctgcaccacctttgtgagcaataacactcactgcgagggtctgcggcttcactcctgaagtcagcgagaccgtgaacccaccggaaggaaaaaactccagacacatctgaacatctgaagaaacaaagtccggacacaccatctttaagaactgtaacactcactgcgagggtccacagcttcattctttaagtcagagagaccaagaacccaccagaaggaatacattccagacacattaggattacaggtcaatgtcattttaataggtttttggttttgatttggagacttcatttggtaaattctcaaagagtcagcactcaaaatatcagctaacacgttgcttcaacccaagaaggatgatgatcatgatgatgatactaacttgtactgaggacctcctatgggctgccatactttatctcatttaatcataatagtcctctggggctgggtgtggtggttcatgcctataatcccaacactttgggaggcctagtcaggcggatcacctgaggtcaggagttccagaccagcctggccaaaatggtgaaacctcgtctctactaaaaatacaaaaattagccgggcctggtgatgtgcgcctataatcccagctactcaggaggctgagacaggagaatcacttgaacctgggaggtggaggttgcagtgagccaagatcacactactacactccagcctgggcaacagagtgagactccatgtcaaaagaagaagaagaatagtcctcaccactacactccagcctgggcaacagagtgagactccatgtcaaaagaataataataataataataataatagtcctcaccactacactccagcctgggcaacagagtgagactccacatcaaaataataataataataatagtcctcagaatagataataatgtcattagcatttgaaagaaagtgaagattaaagaaattaagggacacaacacacagagtcacacagccagcaggtggcagagtcagggctcaaactcagatcctctggatttcacggcccgcatttttgaaaaccatgcgattctcataagctcagtgtcatggacgtttgaaattctcaacatgctggatgaagtatcaaattaccaggatgagattgcattatttttcctttcaatcaagcaaaatgacagttataaaagtgtcttgcactggcccctgctgccttggctctttataatcacccaggatccctccaagtccttggcattcccagcaaagccgaggcactgagccaggacaagcagccagggctcgggggcggtggcgggggggtgagggggtgaaggggagggtgtgggggggtgttgctgcttaatacttccatgcagatggtgacttcagccagttactgaacttgaagcattatcaccctatgctaatgcaaacagacagggttctggggactgtggtggcagggatagtttgtcctctaggattgtggaattgtattacacacttttagaaatgaaatgtattcgtttttgaattctaaaacaatatgggctcaatatagatggttggaaaattcataaaattaaaaaaaaatctttcccaaatttcaactctagaaacaaccattgttaatattctcttgtatttactgctagtcattttatttttcataccttaaaaccattatttattgctgggcgtggtggctcacgcctgtaatcccagcactttgggaggctgaggtgggcggatcatgaggtcaggagatcaagaccatcctggctaacacggtgaaaccccgtctctactaaaaatgcaaaaaattagccgggcgtggtggcgggtgcccgtagacccagctactcgggaggctgaggcaggagaatggtgtgaacccgagaggcagagcttgcagtgagccaatatagcaccactgcactccagcctaggcgacagagcaagactctgtctcaaaaaaaaaacaaaccaccattatttatttatattttagagacagagactcactctgtagcccaggcaggagtgcagtggcacgatcatagctcactcactgcagtctcaacctcctgggctcaagcaatcctctcacctcaacctcccgagtagctgggactataggtgtatgccacaacagctggctaattttttttttttttttttggtagagacagggtcttgctgtattcctcaggctggtcttgaactcctggcctcaggcaatcctcctgcctcggcctcccaaagtgctgggattacaggtgtgagccactgcacctagcctgatttcttttctgattataaaagtaatacaggccgggcttggtggctcatgcctgtaatcccagcactttgggaggccaaggtgggcagatcacttgaggtcaagagtttgagacgagcctggccaacatggtgaaacctcatctctactaaaaatgcaaacattagctgggtgtggtggtgggcacctacactcccacctacttaggaggctgaagtgggaggattgcttgaacctggcaggtggaggttacaataagccgagatcaagatcgtgccactgtactctagggtgggcaacagagtgagactatctcaaataaataaaagtaatacgtatactttgtagaaacattggagaatacaaacaaaacatttattatcatgacatacataggtagtcactatcaatattttggtgtatgacattttagtgttttttcaccctggatgtgtatacatgtttgtatatacgtaaacaggtaaaattggaatcacagtagccgggtgtggtagcccatgcctgtaatcccagctctttgggaggcagaggcaagagaatcacctgaggccaggaggtcaagacccacctgggcaacatggcaaaaactacatctccgctaaaaatacaaaaattagttgggcaaggtggtgcatacccgtagtcccagctactaaggaggcctgggcgggaggactgcttgagcccgggaggtgagcagtgagccgacatcccaccacagcacgctagcctgggtgacagagcgagactctgtctcaaaaaaaaaaaaaaaaaggaatcacagtatttttaaatttctaccattatcattctataaaatatgattgagattacagtgtgcacttgatcttagccaaaagatccagaatgacagctcacactttatattacaatttgtattctacttttcctgatattttgattaaattgtgctatgttttccctatgacatttccctattacatttctttgtaaacatcattttaaataagtgtacagtgttacattgcaggcataccataagtttagccatttcccttttgtaagatactgacccttttctaattttttctacagtttacataaattgtaaaaaaaatatattgtgtgaatgtatttttagtaattcagatattccttcgggtagatttccatgagttgaatttttagatccaatagatgtattttttcttttttaaattataaaatattttaatgtagagataattacatgacaaagatccctaaatgcaccaaccgtcttttaagggatacacacccttttatttatatattatgtctgtaagattcatccattttgttggtagtaatttgtttgtttttttttttttttttttgtgagacagggtttcactctgtggcccaggctggagtgcagtggcatgatcacggctcactgcagcctgaacctcccacgctcaagtgatcctcctgcctcagcctcctgagtagctaagactacaggcacacaccacccatgcctggctaatttttgtattttttgtagagaagggattttgccatgttgcccaggctggtctcgaactcctgggctcaagcgatttgcccacctcagcctcctcaagtgctaggattacaggtgtgagccattgtgcctggccagtagtttggtctttttcgttgctgtgcagattcagttgtatgaatatagcataatttttgtccattctattgttgatagacatttgagttgttttcatttcttgtcattatgagtaaagctcttaacattggtggacacaagtatgtatttctcttagggatatatccaggaatagaattgctgccagacagaaaaatatatatgtatttgtagctttagagggtattgccagtctttttttatttctttcttttttattttgagacagtctcactctgtcgcccacgctggaatgcagtggcgcaatctcagttcactgcaatctctgcctcccgggttcaagcgattctcctgcctcagtctcctgagtagctgggattacgggcatgtgccatcacgcctggctaatttttgaatttttttagcacagacgaggttttgccatgttgggctggtcttgaacccctgacctcaggtgatccgcccacctcagcctcctaaagtgctaggattacaggcgtgagtcaccacgcccagccattatctctcattttctaaagtggtagtaccattttatactccgaacagcaataaattgtagttacattcttactaactgctaactcatttatttactagcatctggactaacatttggtattgtcagtctttttaattttagtcattctggtaagggtgtagtgcccaccagccatctccaacagattttaacatatatgcttcagatctcttttaagaaatataaatttaaatattcattagtgaatctagtaagggatgtgtgtgcgtgtgtatatatatatatattgtatatatacacacacatatacaagaaaataacatacatattatataaaataacgtatatatacacatactgtatatatacacacacaaactatatatatatatgtgtgtgtgtgtgtattttggagacagggtctcactctgtcatctaggttggagtagagtggtgtggtcttgcctcactgtagcctcgacctcccaggcccaagcagtcctcctacctcagcctcctgagtatctggaattataggtgtgtgccaccacacctggttaatgttttaatttttgtagagatggaaaactgctttgctgcccaggctggtctcgaactcctgagctcaaggattcctcccaccttagcctcccaaagtgctgggattataggcatgagccaccgcacctggccaaggtctgtatttttcttattgtactaaacttgcaacttttctgtagatttaaaaattttcaaaatactgtaaatagtttaaaaatatataaattttagatatagctgaaactaactacttaccctttcccagcctcctaaagtaattactatcctgaatgtaatgtttattgttttttttttttttttttgagacagcgtctcactgtcactgaggctggagtgcagtgtcatgatctcagttcactgcaacctccgtcccacgggttcaagtgattctcctgcctcaacctcctgagtagctggaattacaggtgtgcgccaccaggcccggctaatttttttttttttttttttttttgtatttttagtagagacggggtttcagcatgttggccaggctggtctcgaactcctgacctcagactaaccgcccgcctcagcctcccaaagtgctgggattacaggcgtgagccactgtgcctggcctggtacaactaattttaaaagcaggttgacactctagtccaactggcagatgtgcataccccatgccattgtaatttttccccctagaaaaactcctattcagtcgtacagggaaatgagtataaaaacatttgctgctgccatgtttgtaattgtggacaattgggaataatctttatacctcatcaatgaaaaaatagaccaattatggttcattcatgtagaatactatacagtagactatgaaccagagttacatgaatcagaattcgtatttctcaaaagcataatgtgggccgggcacggtggctcacgcctgtaatcctagcactttggcaggctgaggcaggtggatcacttgagcccaggaattcaagaccagcctgagcaacacagtgaaaacctgtctctatctttttaaaaggaagaaaagcatattgtggaacaacaacagaaaaaagcaacttgcagaattataaagtatgatatcatttgtataaattataagaaaatgttaaatagcgctattatatataatttgtagagttatacatatatacctgagaacaataaacattacattcatgcagccaggcacagtggctcattcctgtagtctcagcactttgggagaccaaggcgggcagatcacttgagctcaggagttcgagaccagcctggccaacatggtgaaaccacatctccattaaaaatacaaaaaattagctgggcatggtggcacgcctgtagtcgcagctactcaggagcttgaacccaggaggtggaggtttcagtgagccgagactatgccactgcactccagcctgggtgacagagagaaaaaaacagttgtaccaatttatactcccactagcattagataaaagttcaaattatgccaggcatggtgtctcacatctgtaaccccagcatttttggactctgtctcaaaaaaaaaatccacatcttttacaacacatgattgttagattttttagtttttgcctatcggatgatatattcttatttacattttcattttccttattactaagggggttgagcagcttctcacattaggccttcctcctctgcccacatgacatgactattcatattctttccctgtttcctactgggatatcattttctttttttcgtttcttttctttttttgagacggagttttcctcttgttgcccaggctggagtgcaatggcatgatctcggatgactgaaacctctgcctcccaggttcaagcgattctcctgcctcagcctcccgagtagctggaattacaggcctgcgccatcacagctggctaatttttgtattttcagtaaagatggggtttcaccatgttggccaggctagtctcaaactcctggcctcaagtgatccacccacctcggcctcccaaagtgctgggattacaggcatgagccatcgtgcccaggcactgccatggtgttttttgtttgtttgtttgtttgtttttaaagataaacctctggggtttctggaaagtaaagccccatgctccaaacagctctgctatacctgtgtgcaaaatattttcatctctctctctctctccccaaagtgcatgcaaacacatatggaactgacataggcatccactgtcgcacttcaaattaaacagacgcacacgacagatattctcacagaaaagcagtcagccaagcccagaacccatagatctaggtccacactcacgcctctgcatgctccccagaaagacggatgcatcgcccgcaggtagagacgggctcaccaatcccactcaaaacccgctgccggcttacagctcgcaagccgcccacagtgccagccccatgccaagcatcactaggggctctagaataggcaggggccttgttctcacttcctttgtgttgcttttattttagttgttttgtttgttgtttttcttagagttatcacctgcccctctgtctccctacccagcccccaagcctcccctccaagcctccactgcgcatgtgccgtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcccagcttttcctccctcgccttccttgggtcggggtgggaggcttggggcggcaaaagggtcaaaaggcacacaccgttctcttttctctcttgactcagttaaagtctgcttgggcacaactctagaaggcagtttcgaaatagaccggctgtatttatttactggttctctctgcggtgtttggatgtcaacatttctaagtaaacgaaggattttgtttttcattaataggatacaatagttgaaactcctgccctcaaagtgtagaggcagcgtcaggggctccagggtcactggaggtccctgcaaacccgggggctccccaaagccgctgctctcacatggcttgcccaccaggctgggaaggagaggtccttctcagggacccggcagcttcctgcctcggctctgggtcactgctccgcgctctgccccagcacggatctctgagcgatgtagggctaaagtattgtgaatgtgatcttattctgtcctcacctggtggaaaattgtgtgtgcgcgctttctttctctatacctgtaattatggatttagaaaatcttcctagaagggctcaactgtgttctgattctgacgggttgaagttgaaatcacaatccaatgtcttagtggttcatgggctaggatggatgtcatagcactgccaacctctttccttttctttttttttctccctttttaaccttggtctttctttctagttcatcctttcaagacccaatgacttggtgctttggcataatatcagggcgtcagggctgagggtctctgtttctttctttaatttttaagtgcacatagtgggtgtccatatttatggaatacatgagatattttgatacaggcatacaatgtgtaataatcacatcagggtaaacggggtatccaaaacctcaagcatttatccttttttttgtgttacaaacaatccaattacactccttttttaaaaaagcccagctgtgtgactaattatactcttttagtttagcttttttttttttttttttgagacggagtttcgctcttgttgcccagactggagtgcaatgacacaatctcggctcactgcgacctccacttcctgggttcaagcgattctcctgcctcagcctccagagtagctgagattacaggtgctcgccaccatgcctggctaacttttgtatttttagtagagatggggtttcaccatgttgggcaggctggtcccgaactcctgacctcaggtgatcggcctgccctggcctcccaaagtgccgggattacaggtgtgaggcaccccacctgccctcttttagttatttttaaatgtacaataaattgttgactgtagtcatcgtgttgtgctatcagatactagatcttattcattctatctacctatatttttgtacccattaaccatctctgtgtccccccatcccaataccctccccagcctctggtaaccatcattctactctgtatctccatgagggtctcttgtttcttacaagctcaaaataatctcaacaatggctgccttttattgctagatgaccatgtgctgagaactctaaatgcatcatttcatttagtcccctcaacaacctcctgcagtactaagatttataaatttaaatcttgcctagatttaaaaaaacattttaaaataaaaattttaaaacaaaacattttaaaataaaaaatttaaatataaatttaaaatcttgcatagatttaaaaaaacaaaacaaaactgggacttgttaggtgatctgacagttaagtggcagaaccaggatttgaaccccggtctgttggaccccagagcctgcttttaacatgaaggtttattgctttcatggtttcagaaaacttcctaagtctattgagatagtcacagaacatgctcagtgattttataattatgtggcagccctgttgctctctgaagctcacagaggccttaaaaaaatgctgggtccacgcagaatggaagctgttcacaagagtgctgctttgaatcctcactctgtgccttgctggctatgtgactttaggagtattgctaagcctcactctgccttcattttctgaaaatagagattatgtctttattgtgtatactaaataagatgatacatatagtactcaaggttaagtgctcaatacgtattgttcacttccattcggttactgcacaacatttatagacagaacctgcttttactctttgcaaggaattatgtaaatattggtcaattcttcaataatgcccttgtagctttttatatcttaacattttatgagaaaaaatttgaaacatgcaggaaaattgcagcaagcacccaatttacagcagtttcaatcctgaaatttttgtacttctgggtcctatgctgcacactgttaaaagtcaggtataaggccaggcgcattggctcacgcctgcaatcccagcactttgggaggccgaggcgggcggatcacaaggtcaggagatcaagaccatcctggctaacacggtgaaaccccatctatactagaaatacaaaaaattagctgggtgtggcagtgggcgcctattgtcccagctgccggggaggctgacacaggagaatggcgtgaacctgggaggcggagcttgcagtgagccgagattgcaccactgcactccagcctgggtgacagagtgagactccctctcaaaaaaaaagagtctggtataaagtccttcttaccctctgtttcaaaccatcaaagactcagtcttgcttcctagtcaaaggcaagaggaacagctcctgatctgtacttgcgtggatcctcaaatctggtttttcttttcttttttgagatggagtctcactctgtcccccaggctggagtgcagtggcatgatctcagctcactgcaacctccgcctcccaggttcaagccattctcctgcctcagcctcccaagtagctgggactacaggcgcctgccaccacgctcaactaatttttgtagttttagtagagaggggttttcactatgttggccaggctggtcttgaactcctgaccttaggtgatccacccacctcagccttccaaagtgctgggattacaggcatgagccaccacacctggcgaaagctgaaattcttaaaacgtggatccagagtctaacttttgaaacttgaatctggcaagttttattttctagactatttttttttttttttgagacagggtcttgctctgtcgcccaggctggagtgcagtggcacaatcagctcactgcaacatctgcctcccaggttcaagcaattctcccgcctcagcctcccgagtagctgggattacaggcatgcaccaccacgtccggctaatttttgtatttttactagagatggggtttcaccatgttggccaggctggtctcgaactcctggcctcaagtgatctgccctccttggcctcccaaagggccgtgattacagatgtgagctaccatgcctgggcctgttttctagatgcgtgtttgcacgcagggggtgtttgattaaaccttttttggaacactctttcaactctcagggtatctatggatccattccataaagcctgggccctccatttatttattaagtgtgaaaattagtacttttgtttctatggcatgacaattgccaagccaatgttgtaacacatgaaatgctggagaaaagaagagtccccttaaaaagaagacatgctctgtttaacttccacacattttaaaatattttatgttaaacactgagtaggtgtaaattaaacagaattgaagaggggagggagactgcagaactggtcttttttagttaagattgtgttgactgctattttaaatttcaactatagtttttagataaaagatatgtaatgtgctatatcagagtagcaaagaaggaacgttttgaagttaggctgaatgagttcaaaccagcctcattcagctgtcacttggtagatttgtgaccctgggaaaattgctcaaggtctctgtgtgtcagttgcctcatctgtgaaatggggataattgtagtaatgcgcacttcggactcttggaagattagatgagataatgtatataatgcatttagcacagggcctcacatgctgaaagcgctcaatcaaggttgaatggttgtcataggaggacagaaggggattgccccagcaatatttgcagaggttatcccaaactcaccagttacagcttttcattgcttccatttcttagtaaattctggttaatgattctgtacatactgccttcctcatgggaacatgtggagaaaggcttctgcacccttacaaaccatctagtattttctcctttgagaaaggttcaaagtaattgctcccagccaccttcaacagcgtttttccactagcagggaggttttttccccgctcagctggaaaatgtatagtgacatttcagcgtggttagatatataaaaatactgctttcaaccaagtgtaattaattgagggagacatgcagacaaggtgccttttgaaaaagcgcagagcttttcagaaacacagttgtctctgttgtggccatttcttgatagatttgtatgtgtcttaaaggatgatcaagattttggacaggggaaatggaggagttggaggcgggagaggggaatgccaggagaggtaatagcatcaactggctgggtgtggtggctcatgcctgtaatcccagcactttgggaggctgaggtgggcggatcgcttgaggtcagcagttcgaggccagctgtcccaacatggtgaaaccctgtctgtactaaaaatacaaaaattagccaggcgtggtgatgggcgcctatagtcccagctactagggaggctgaggtgagagaattgcttgtactcaggaggcagaggttgcagtgagccgagattggacggctgcattccagcctgggtgacagagcaagacttaatctcaaaaaaaaaaaaaaaaaaaaaaaaaatcaacacagacatagtgctggaaataaatgctctatgagtaggagattggaatgaagtagagagctcaaactgcaatctttccataagcccgggggagatgactactatttaaaagttcaaagttgtgtactgactaacaagcagatcgtaaaactggccagcgtttcaggtttcataaacagtgtggaggctgaaataatgcaaattgctggcaatctatataatagattcttggggaaaggtttgaactatcttctgtttggttacatatgctcattttattattttattttggttttgcatcatttctttttttctgattctagaagtaatacatgtactttataaaaaatttgaattcatctgaaatatgaaaataaaaagtaaaaaacgaccatcatttgctccccagatcccatttattcactccataaataggtactgagtgccttacaagtgccaggaagtgttctaggggctgcaggtacagtcttgagatttctcgacaaagtccctgcccacataaagcttctgtttaggggaagttaagacctgggttgagagtgaaggcgtcaaatattacataagcaaacaagtaagatggtttaggtcatagtaaatgtttcatgggcattaatagggaaggggtacttttcatttggtgttcaggaagcgcttctctaaggaggtgacattttgctgtatcaatagcaggaatccaggcagtaaacgtaaaggccttgtgctagaggaagagacagaaggccagggtggctggaacccagtgagtcagggtgaagggcagatgaatcagagggaagccagactaggtagggccttttaggttgtgattaaaacaaacaaacaaaaagtctgaaatttattctcattgcaggagaaactgctaaaaaattttaatcaagggactaacatgaactgttatgttttttgaggttttttgtttttgagacagggtctcgcttgtcacccaggatagagtgctgtggtgagatctcggatcactgcagcttcaacctcctgggctcaatggattctcccgcctcagcctcctgagtagctggaactacaagttcgcatgcctctagagcccattaaaaaaaaaaaaaattaagacagagtctcgttctcttgcccaggctggagtgcagtggtgtgatcttggcttgctgcaacctctgcctcctgggtccgagcgattcttctgcctcccaagtagctgggattacaggtgcccaccaccatgcctggttaatttttgtatttttagtagagatggggtttttccatgttggtcaggctggtctcgaactcttgacctcaagtgatccacctgcctcagcctcccaaaatgctgggattacagccgtgagccacgatgcccagcagccctgttagtttgtgaatttttggtagagatggggttttgctgtgtttccaggctagtcttgaactcctgggctcaaaagcaatctgcctgtctcagcctcccaaagggctgggactacaggcaagagccactgcgcccagcctggtttttgtttttaaagggtcatgttgggtactagatggggaataagtccatagcggggcaagtgatgatcaatgcaagcagcatttgatatagtccgtgattccttcctaatcaattttattttggagaagtggtggcagtttccttgagtgtgaaaggtgtgacaagggccccatgggttgtcctctggaagatcaagcacctggttaagacttaggagagggaggccgggcacagtggctgaagcctgtaatcccagcactttgggagaccgaggcaggtggatcacctgaggtgaggagtttgagaccagcctgggcaacatggtgaaaccccacatctaccaaaaatacaaaaattagctgggcgtggtggcgcatgcctgtaatcctagctactcgggaggctgaggcgggagactcacttgaaccagggggcagagcttgcagtgagctgaggtcacaccattgcactccagcctgggcgacagagtgagacactgtctcaagaaaaaaaaaaaaaagaattaggagagggatagattctgcactgtctcttgacaggcaactatgtaagttattgcaaaactattatagcagtgatataaatattacaaatatgatagtatctagaatgtactttgaacaagcccaattatttacacagttgagtaatgtctgctcataactttgctcataacattatgttttatttttgcaagagtttcctcctgtgttaattgaagaaaaaattaatcatgcctattcttggactgattagttattaaacacatattaataataatatccattcaatgagttttagctatgaacttgagcttattaaattctcataacagccctatgacataaggagaattattattcccatttaaacatggggaaaccgaggtttcagggggttaagaaacttgctgaaaggcataaagctagaaggtggtagggctggagcctgattctaagccctctctgcctctggatgttcctatccactgtctgttattcttggttcagtgctgggtgctgtagagattagagatggaataagacagaatcccagccttcactcttaaaaggtttacagatttggagtgagagacacagccataaagaacaccacagggccgggcgtggttgctcacacttgtaatcccagcactttgggaggccgaggctggtggatcacttaacatcaggagttcaagaccagcctgagcaacatggtgaaaccccatctctaccaaaaatacaaaaattagccaggcatagtggcatgcatctgtaatcccagctactctggaggctgaggcaggaggatcacttgaaccggggaggcagaggttacagtgagctgagattgcaccactggactccagcctgagcgacagagcaagacctgagaccctgtctcaaaaaaaaacaccacaggctgggtgcggtggctctcatgtgtaatcccagcactttggtaggcccaggcagggaggattacttgagccccagagtttgagaccagcctgggcaatgtggcgaaaccctgtctctaccaaaaatacaaaaaattagctggacgtggtgctagctacttgggaggctgaggtgagagaatcgcttgagcctggggggcccggaagctgtggtgagccaagatggcaccactgtactccagcctgggcgacagtgaggccctatctcaaaaaacaaacaaacaaacaaaaacaaaaacaaaaaatccaccgcaacttataaagcagtataatgaaacacatgctaaatgaaaagtacaagtgtgggccaggcatggtggctcgagcctgtaatcccagcactttgggaggccaaggtgggaggatcacctgaggtcaggagttcgagaccagcctggccaacatggtgaaaccctgtctttactaaaaatacaaaaaattagccagatgtggtggtgcacacctgtgattccagctactcgggagcctgagacacgagaatcgcttgcaccctggaggtagaggttgcagagattgcaccactgcactctagcctgaacaacagagcgagactctgtctccaaaaacaaaaaaaaaagtgtgaaattaggaaagaaattggctgtgactggggagctgcaggccaacagcaaagaggggtgtttgcattgggcctgaaggctaaacagggtttcaaaagaggaagagtgtagagaaggggatttcaggtaagctgtctgccccaggcacagaggtgaatattccaaaggccagggtccaggcaccagctttgtttttttttttttttttttttttttttggctgtttctttccccttggcttaatggatcctgggactgcctggttcacttatatgaatgggcttgggggttggttggaagccagcacaggtaaaggccctcttttagtacttcactcacaagttcccccaaaagatagaatcaattcatttcttcactattcacttgttgtgggcgtctcctgtgcacttgttttagaggaacagagctagatgggtcctgaccccacccttaagaattccgtcctactgtggtccatttcttcctctgctgcttcctagcactgtgatcttggacaattggcctaacttccctaagcctcagtttcctcatctgtaaaatgggtatagtgatttctttaatcccctgagaaataaacagaataatgccaggaaagcatggtgacaaatacatgtcactaaatgttattgatggtagcagtgtgaaggctcagctctgttttgcagacgatatttattgagaaatgcctgccaggctgggtgggaggagctggcctcatagtatgagtacatggtggtcctgcatggaagagcagatggtttctagtttattggttataagtgtgggctttcgagagagcttttattttgaggcctggctctgccatgtcctggctctggactttgaatgagttatttcacctttttttcccccacctcaatcttttgctatctgtatctgttctcaataataaccatgaggaattatataaatctgaagaagtttctcaaagtcagtttttgagacagggtcttgctccattgcccatatgggagtgctgtggcacaatcacagctcttgcaagcctcaacctcctgcctaggcctcccgcctaggcctccgaagtagctggaactacaggtgcacaccaccacgtgtggctaatttttacaatttttttgtagaggtggggtcttggtatgttgcccaggctggtcttgaactcctggcctcaagcaatcctcctgtcttggcctcccgaagtgctgagattataggcatgagccaccacgcctggttatttcacctcttaagctttggtttctgcaactgtacaacagtgacagtaatagtatctacttaggatagctgagaattccttgagacacagattggaaatcattcaatacagaggtcagtacatgatacatgtttagtaaatgttaattattatattattggctttacagctatggcaacaggtacataaaaaggtaaacttgatttaataagggtgtgtgagtaagtagggggctggcagcagggtagctaatggagcaaagaggaggggcttagccaaccctggggcttctgaaaacttctggaagagctgagccttaataagaaagaatagaaggaaatacatatgtggaatcaccattaattgttaggaaaaaccaaattggaaccttactgagatatgtagccactggaaaggctaaaattaaaaggactgatcatactaagtgctggagaggatgtagatcaactggcaccctcatgccttgctggtaggaatgtcacatggggggaaatggcttggtcatttcttaaaaatttaaacatacaccaatcataggacccagacggtgcacttctgggtatttacccaacagaaatgagagcaagtgtctctacaaatatttgtacacaaatgttcatagcagcttttttaggaatagccccaaactggaaacaacccaaatatggtataatcatacaacagaatgcttctcagcagtaaaaaggaacagactaaagacacactatgtaaatggatcacaaaatcatcatgctgagtgaaagaagcaagcaagaaagaaaagagtacatactgtatgagtccgctgacatgaaattattttaaaaacttaaactattgtatacagacagaaagtaagcgagactctaactctacaaaaataaaaataaaaaagttagctgggcatagtggcccacgcttgtgatcccagctacttgggaggctgaggcagaatggcttgagcccaggagttcaagaccagcctgggcaacatagcaagtcctcatctctacaaaaaaataaaaaaataaactggctgagtgtgatgatgtgcacctgtagtcctagctacccgggggctgaggtgggagaatctcttgagcccaggagtttgaggctgcagtgagctatgactgcaccactgcactccagcatgggcaacaaagtgagaccttgtctctaaaaaaataaagaaaatgattataagaaataacatgcatgaagttcttcctatgagccactgtgtgcatgttttacatgcatcctccgctccttacaaaacgttctgtgagatgagacacaatatagccatctattgcatttattgttctatttacagaggagcaaactgaggcttacagaggttaagcaattggcccaatgtcactccactgataagtggtagggctgagatttgaacctagcacaggttgacttaattctgctaccttcctaatttcccaggattagttgaagctgccattgatatagatgcttaatgtcaactagacacatctctgtgtttcttagaactgattctgttctctggctcattaatttccttttccattacaaacatgcctcttgtaagcttgaggactacatctcaccacttcaaagtgccttcagtgtcaaactggagtggaagttgaagacgttcacaaaaatggaggagggagagcctttctgttttgaagacttgtagcttcacaaagaaaggctttctttgaatgatcaagaaggatttctaggtcaatataggggcatattactgtaacgtttggcagcaggagctctgcctgcatttgaatcctggctttaccacttcataatagttgcgtgatcttgggctagttacttaacctctctgaatttcagttttctcatctgtaaaatggggataataacaggatctgccccaaaggatgtattggtccgttttcacactgctataaagatactacctgagactgagactgggtgatttgaaaagaaaagagatttgattgactcacagttccacctggccgaagagtcctcaggaaacttaaaatcatggcggaaggcacaggagaagcaagcaccttcttcacaaggtggcaggagagagtgacagagggaagcaccagatacttatcaaacaaccagatctcgtgagaactcactcagtatcatgagaacagtatgggggaaaccgcccccatgatccaattacctcccaccaggtccctccctccacacatggggattacaattcagattacaattcaagatgagatttgggtggggacacagccaaaccgtatcaaaggctaattaagaagattcaatgaaataatacatgaaagcccttcacagagtctggtgctctcagtaaatggtggcgatcatgttaatagaagaggatgtgaagtgggaattgacctgatagtatctgaatagttggagagaaggaagagagagaagttaaatttaagtgggtgaacctcaaggaagaatggaggtgacgatgagcgtggagatttctggaggcgtgcatgagcttcgctgcattggaggagttgtgagataaaaaggatggttaagcaggaccactagactttggtggattaaaaaaggactggcaatatggggccattggaggacaagggatggagggaaagaagtagcatttatttatttatttatttttgagacagagtcttgctgttgtctcccaggctagagtgcagtggcgtgatcacggctcacttcaacctccacctcctgggttcaagcgattgtcctgcctcagcctcctgagtagccggaattacaggtacccgccaccatgcccagctaatttttgtacttttagtagagatggggtttcaccctgttggccaggctggtctcaaactcctgacctcaggtgatctgcctgccttggcctgccaacgcgctgggattacagacatgagccactgcgcctggccggaagtagcattttaggaaggcttgtctggcaatggtgaccaactggatgcaaagtcaggggccctggggataagaaggtcagctaggagggtttggaattatcccatgatgagggctgtatgtccaaatatccatggcagggctggagtctgcaggagcagtgggtttgaaagaaggggctgatcagaaatcttgaagggagaaacccatagtagttattatgtctcagaaggaaagaaggtcttctaagtgctctcaatgtgataggcaaggaaaaaccctgtcattagcctgaggtcttaaccagttaaaaatatcagcatccaggcgcagtggcttacgcctgtatttgcagcactttgggaggcccacgcgggtgggtcacttgagttcaggggttcaagaccagcctgggaaacgtggcgaaatcccatctaccaaaaatataaaaattagctgggcatggtggtgcaagcctgtaattccagctactcaggaggctgaggcatgagaatcgcttgaacctgggaggcagaggttgcagtgagctgacatcgcactactgcattcaagcctaggcgacagagcaagaatctgtctcaaaaaaaactgaaaaaacaaagagttgttcctgatgctgccgtgagattagcatcctcgccttctgctttgagggaaagatgtgagattttcagatcagatacaaagtaacaggaataggtaccatgaatgggaaccggcagccaagtgacagtgttgtgatgggtataggctgggctaggtactttacacaccttaaatttttgattcttagatgccagcataggtgaggtataacatttcagagtaagtcacgtctttctgaaacaacagaaacaaaaaaacgataaggccccgttaaataactggtccgtttagcactacctgcaatagcaaagatgtggaatcaacctaggtgcctattgacagtggattggataaagaaaatatggtacatatataccgtggaataccaccagctagcaaaaaaagtaaaactatggtctttgcagcaacatggatgcagctggaggccattatcctaagtgaactaatgcgtgttctcacttataagtagaagctaaacattgggtacaaatggacacaaaggtgggaacagcagacactggggactacaagagggaggaaggagggagggaagagttgaaacactacctgttaggtactttgctcattatctggctgatggtttcacccagaccccagatctcagcatcatgaaatacacccttgtaacaaacctgcacatgtacctccttagtctaaaataaaagttgaattttttttctttttctttaattttttttttttaagagagggagtctcgctctgtcgcccatgctggagtgcaatggtgtgatctcagctcaatgcaacctctgcctcccaggttcaagcgattctcctgcctcagcctgctgagtagctgggactacaggtgcacaccaacacacctggctaatttttgtatttttactagagacaagctttcaccatattggtcagactggtctcgaactcctgacttcaggtgatccacccatctcggcctcccaaagtgctgggattacaggcatgaaccactgcacccagcctactttatttttaatctccatctagtatttagactagagatgggcaaatttttcttttttgttttctttaaaatttttttttttttggtagagatggggtctcactatgttgcccaggctggtcttgaactcctggcctcaagtgatcttcctgccttgacctcccaaagtgctgggattacaggtgtgtgtcatcacacccagccctgatacactttttctgtacaaggatagatactattttagggtgtgcaggtcatatggcccctgttgcgaccactcagctctaccaccgtactccaaagctgtagcctaaagctgccatagacaggcacctaagtgaatggatgtggctatgttttgtttcagcttgattggtgagcactgaaatttgaattttatataactttcccatgtcataaaatattattattcttttgatgttttcccacagccatttgaaaatgtagaggtcatctcaaaaaagaaaaaaaaggaaaagaaaatgtagaagtcatccttagctcaagggccatagagaaactggcattggtctgggtttggtctgaaggctcatggatccctaccctagacaaataataggcatgtaaaaggtattcacatcacagctggctttttttttgaaacagagtcttgctctattgttcaggctggagttcagtggcatgatcttggctcactgcagcctccacctcctgggctcaagcaatcctcctgcctcagcctcccgagtagccgggattacaggcacaagccaccatgcctggctaattgttgtatttttagtagagatggggttttaccatgttgttgaggctgatctcgaactcctgggttcacaggattcatctgcctcagcctcccaaagtgctgggattacaggcatgacccaccacgcccggccatagctggctttttgcttgctgtgggaggagaaagttctggctgcttggcttcgatgctatgcttggctcttccaaccaccatttgtggctttttgctgccagagcttgtcatgctgctgcattgcccaagagaaaaagtttgtgaggttccacgttccatcatatcgatgatcattttagggttttcacacacaagagacaggattattgcaagcaacagcaatgaactttggaaaactcagaggttttccaagtgtgagatttaaagcctcatgcatgaaactttaaattagtttaagggggcgtaaccagcataaaaaaaatgaaatagaaggaaataggaaatagaaagctgcatctatgctgctaaagttaagtcttatttccgtgcaacctttcgtttgtttgttttgtttgttcgttttctgagacagagtctccctctctggagcgagtctcacccaggctggagtacagtggtgtgatctctgctactgcagtccctaccttccgtgttcaaacgattctcctgcctcagcctcttgagtagctgggaccacaggtgcatgccactatgcccagctaatttttagtagagatggggtttcactgtattgaccaagctggtctcaaactcctcacctcaagtgatccacccatctcagcctcccaaagtgctgagattacaggcatgagccaccatgcccggcctattttgtccaacgtttgttttacttatgcctatgtgtgtatgtacatactgggtcactcttagtatttcttttttttttttttttttttttttgagacaggagctcactctgttaccgaggccagagtgcagtggtgcaatcatggctcactgaagccttgaattcctgggcttaagcgattctcccacctcagtctcctgagaagctgggactacaggtgggtgtcaccacacccagctagctaactaatttttttttttttttttttttttgtagagacagggtcttactttagtgcccagactggtcttggactcctgggctcaagtgagcctcctgcctcagcctcccaaagtgctgggattagaggcatgagccactgcatctggctctctgagtatttcttactgtgatccacagtaagtaaacttatttaaataagtttgcaaagtacaggaacttaaggaaaaggaatgtatctggaaatccttccagaatttaaaacaaaaaatagctctaggcacagtggcttacgcctgaaatcctagcactttgggaggctgaggcgggaggattgctagaggcaagagtttgagaccagcctgggcaacacagggagatcccatctctacaaaacagttctaaaaattatccagtcatggggcgtgcacctgtagtcctagctacttgagaggctgaggcaggaggattgcttgaacccaggagtttgaggttacagtgagccatgattgggccactgcgctccagcctgggagacagagtgagaccctgtctcttaaaaaaaaaaaaagaaaagaaggaaggaagggagagagagggagggagggagagagagagagagagagagagaaagaaagaaaaagaaaaagctaaacagccagaccttagagagaagaggaaccttggtgactaggaatttccagatggcagaaaattccgggtactgtcatctggctgaatcagtcccactcttttgcatctctgagccactgtgcccaagattcaagtacctgggggagaacacagagaagatctctgcgttaaccagagtccatttctgttgcttgcaaatcatcccatctcctgtgtgtgcaaactcctaaaataagcacttttagaagaaacgctgactcgtacaaactttccctgtgtcctaaggcctcctgccagctttgcaactgctgctcgcgggcaagggaacctctccagtctcaggacaatggtggttgggagaagctaagctaaggtcaaagccaaacacagcgagaacttagcctaagtgtatcggaccagctaggatcaagacccaacccttgactaggaaggagggcatcttgaatgccagttccctaagacagcatttcacgggtgaggtgtattctcccatggcaagacattggaggtgctatcatgagagaaagaacaatggatgcttgcagaacagaacccgcagatgaccactaaggaatgacactggttttccttctctaataaaaataacaacaacaacaacaaaaatagctgggcgtggtggcaggtgcctgtaatcccagctactcgggaggctggggcaggagaatcacttgaatccgggagacggaggttgcagtgagctgagatcgcaccactgcacaactacctgggcaacagcacgagactctgtctcaaaaacaacaacaacaaagaaaaaaccaaaacaccgttgcttttattctgataataaaacagggttaatgctcgaaattttaaaactaaaaaaataccaaaagttataaaagagggcaaatgtcatttaaaggaatgctgcagcgaggtagagtctcacacctgtaatctgaggcagaaggcaggagcttgagcccaggagttcaaggccagcttggccaacacagcaagaccctgtctctacaaaaataaaaataattacctgggtgtggtggtgtacctctaattctattattagctacttgggaggccaaggcaggaggatcacttgactccaggagtatgaggctgcagtgagccaagactgtgccactgcactccagcctgggcaatagagtgagaccctgttctaaaactaaccggctgggcgaggtggctcacctgtaatcccagcattttgggaggccgaggcgggcagatcacttgaggtcaggagttcgagaccagcctggccaacgtggtgaaaccctgtctctactaaaaatacaaaaaaattagctaggtgtggtggcacgtgcctgtacacccagctacacgagaggctgaggctgaagaatcacttgaacctgggaggtggaggttgcaatgagtcgagatttcgccactgcactccagcttgggtgacagagctaactctgtctcaaaaataaaataaaataaagcaaaccaacagaatgccaccaacctccaataaccactgagagcatcccttcagatgtcccttcctcccttcccctttccttcctctcctcctcttcttcctgttctgagtcatgtttctcaaggagagacaagttgtactttgggatctggtctcttttctcacacatctctgctctctaggggggcacctccctccctatggatatcacagggagtttttttccttttagagtttgaatggaggaagacttcagacagaactgtacacagcacagagctgcagagaagtggaagattaagagaaaataatgttggacaaattagatgtagcttgtataatctggagctacagtcacgagaataggatgtaacataaagtctaatgtgattcagcaaacacacgttttcattacttttgtgcagatggctctgctaggtgacttggaagggaaggaaaccgaggcagtgttgcttccttcgaggaagacagagttgcttcctttccccccatccactggggacagaatttcaaagagattacagcacagaccagcctgtggcaaatgcatgagccaagtgtgatggggacacagaggcgattaaaatgcaatcattagggctggtcatggtggctcacgcctgtaatcccagcactttgggaggccaaggcgggtggatcacttgaggtcagcagttcgagaccagcctggccaacatggtgaaaccccatctctactaaaaatacaaaaattagccggtgtgatggcacatgcttttagtcacagctactcaggaggctgaggcaggagaatcgcttgaacccagaaggcggaggttgcagtgagccaagattgtgccactgcactccagcctggatgacagagtgagactcagtctaaaaaaaaaaaaaagattgctgttctatttatgctgtgaacattgctgaaagattgagcaggaaaaatggagatcaatgctcagtaagttccacctgaaagacctcctttgaacatagcaactgttcacttggtgaaatttggctatacaggtaatgaatactttgtgagaaatcacactctgtggtctccgagtagcattaacaatctcttgcaacagagaaagctgaaatgaagaggagaagtgtagaaaatgtcatctgagggcgcgcgtggtggctcatgcctgtaatcccagcactttagaaggcagaggcaggtgacctgaggtcaggagttcagcctggctaacatggcaaaaccgtctctactaaagatacagacattagccgggcgtggtggcgtgcacctataatcccagctactcaggaggctgaggcaggagaatcacttgaacccgggagatggaggttgcagtgagccgagatggcgcaactgcactccagcctgggcaacaaatggagactctgtctcaaaaaaaaaaaaaagaaaagaaaagaaaatgtcatacccaacagtgtgttgggtatgacaactactagtgtgtccagccatcctggtttgcctgggactatcctatttttagctctgaaaagtctttttaaaattttatttatttatttatttttgagatggagtctcgctctgttgcccaggctggagtgcagtggcatgatcttggctcactgcaagctccgcctcacgggttcacgccattttcctgcctcagcctcccaagcagatgggattacaggcatgtgccgccacacctggataattttgtatttttttagtagagacagggtttctccatgttggtcaggctggtctcaaactcccaacctcaggtgatccaccagcctcagcctcccaaagtgctgggattacaggcatgagccaccgcgcctggccatgttaactatatattaagatacgaaacagctttctttcaaggggtgcagctttaaaacagtctacagtagcaaggcatttaacctgtactcggaagccaggaaaccttggcctgacttgccactgtgttctttgaaaggtccgtcgttaatgtttgactattcttaatgacaatttgtggcttatcaggttgacgttttcctttcttttcaggcagctgagacttaagggagtgaagtaatttggtggtattcattgcaggggccacatagatactgtcagtacgcttttaaaaatctttttaaagtaatagatgctcattataaaaattcaaacaatacaaaagtgtagaaagtagaaagtactttctacttcaggaagaaaatttcccaccctcaaattgtcattccgtcacaagtttgatgtgtatcttctcagtgttttgttggacatatgttaacacatggattttaaaaaatgaattggatgatatgtgtactaatcagtcttctttttttattcaaactatatatcatgaccatctttctaagtcagtaatacagcattatcttttccttgttttttttttttttgagagaaagtctagttctgtcacccaggctggagtgcagtggtataatcatagctcactgcaacctctgcctcccaggttcaagtgattctcatgcctcagtcacaggagtagctgggactacaggcacatgccaccacacccagctactttttgtattttttagtagagactgggttttgccatgttatccaggctggtttcgaactactggcctcaagtgatctgcctgcctcagcctcccaaaatgctgggaagacactgcatcagccaaaaaaagtatcttgtgtttaatttggcctatgtcttccttttctgatcactgcataatttttcagtgtctggttataccttattttttcttaattaattctttattgatggacagctaggtgatttaacaatttgataaagaatgctgcaataaatatcttttgtcatttttgcacattgtccaattatttcctctatataaattcactttttttttgatgcggaatctcactctttcgcccaggttggagtgcaatggcgcaatctcggctcactacaacctccacctcctgggttcaagcaattctcgtgtctcagcctcccgagtacctgggattacaggcacgcgccactatgcctggctaatttttgtatttttagtagagacagggtttcaccatgttggccaggctggtttcgaactcctgacctcaagttatccacccaccttggcctcccaaaatgctgggattgtaggcatgaggcactgtgcccagcctcctctatacaaataattaaaagtagaattgctgagttaaaagctttcaactaggtttagaatgtggaagatacacaaatctgaattcactttatggggtgcatatttgagactaaattaaaactaattaacttgaggaagaaagaaaatatcgtaattcaaatgatactgtggaaaaagtagcagagtaggagttagaatactttggttctagagcttgttcaccttccagctaactggttgacctttgacaagcttcttaacctttttgcacgtctgactcttgcctccagttgtatctggtctcatgaatcttccaaataattgacagagtcattttctacaatgcgaatatgacctctgcttaagtccatcaggagctcaccattgcctttggggtgaagctaaaactcctagctaaccatgcagcagtctgtgtttgtagcttcctctccctccacgtgcccagccaggacctttgatccacctgttctcacctcctttcattgccttcaatgctcacagtttgctaagcctccagatgttggttcaggttgttccctccttctggaatatctggtcccttctctgaccagctgacttctactcattcttcaagaaatagcttggactttgtattagtccattctcacgctgctataaagaaatacccaagattgggtaatttataaaggaaagaggtttaattgactcacagttccgcatggctggggaggcctcaggaaactaataatcatggtggaagagaaagcaaacatatccttcttcacagggcagtagaagagaaagaacgagcaagaacagggaaaactgccttaattaaccatcaggtctctcgagaattcactcactatcacgagaacagcatagggaaaaccacctccatgatccaatcacttcccactaggtctctccctcaacacctggggattacaattcaagatgagatttgggtggggacacaaagcctaaccatatcagacttcttaccttctcagaagactttcctgacacctacaggttgaactgatgcctcttctcttggcttttgtgaaggcagcatattactttacacatcctctgtaaatagcacacactgtattacaacggctgactttcttatctgggtcacttcattcttttgagggcagaaaccgtgacctgttcatctttgaatttatagtatctaccacagtgtctgacacatacagatgtttgctgaatctttgtggaataaaacaattgatctataaaataagtgattggattcagtaatacaaaattgcagccaagtatggtggctcacacttgtaaccccagcactttgggaggctgaggtgggtggattacctgaactcaggagtttgagacgagcctgggcaacatggtgaaaccccatctctataaacaatatgaaaaaattagctgagtatggtggtgcacacctgtagttccagctacttggggggctgatgcaggaggattgtttgagcccagaaggtcaagactgcagtgagctgtgttggcaccactgcactccagcctgggcaacaaagtgagaccgtgtgtccaaaaaaaaaaaaaaaaagtagaagtttatgagaattaaaagttcaaggaaacctcagaactactaaggaaacatctcaaaataatacagtaaaaaaaacacaaacaaagccaggtgcggtggctcacgcctgtaatcccagcactttgggaggctgaggcgcgtggatcacgaggtcaggagtttgagaccagcctggccagcatagtgaaaccccatccctactaaaaatacaaaaaaattatccgggcgtggtggcgggcgcccataatcccagctactcgggagggtgaggcaaggagaattgcttgaacctgggaggtggaggttgcagtgagccaagatcgcgccactgcactccagcccaggtaacagtgtgagactctgtctcaagaaacaaacaaacaaacaaaacacacacacaaacaaacaaaggaattaaaatggcacactggaaaataacatgaaagaaagctattaaaaaggaacagactaacaaaaaagacatgaaggatataaaaaacaaatagcaaaatgtcaggtgtaaatccaaccacatcaataattacataaatgcaaatggattaaatactccaatcaacaggcaaagatcgtcagactggattaaaaaaaaaaaaacaccaggatccaactatgtattgtctataagagacacacttcagattcaaagacacaaataggttgaaaagaaaaggatggaaaaatgtatagcctgcaagcataagagagcaggagtggctatattaatatcagacagaagaaaatttaagacaaaaaatgttactagagacaaagagggacattttatagtgataaaaacaacaatacaacaattatatatgtgtccaataacaagagtagaagggaattgtagaatgaattatagaacctttacagtgtgaatattgtaacttacagtgtgtaaattacagtgtgttttcagaaccataccttggaacctctccagattctttaccttgtggcctcctgtccactccattctaaggtgttatcatactgaagtgcaccatagtggtggtcttgatggggaaaagaaatcacagtagcactaacaggaaacatcctgagggaagaggcactgtcatttttaggtgtagggaagatgtttaagagcccgttttaaacatctgagcttctggtctttggaattttgtcagcccagagacagtttcttttcttctcaattctcttttcctttaattggtcttcttcttgccatacctcattccttagtcatcctggtcttgatctcagaaatctcacattctcattgatttagcatggttttctactctagtgccagttctactgttggatggaaagaaccatcttctgatgtgacaggaagccttaattattaatttaaaattcccctacccttctccaacttctatggaagttaactcaggaattattggagtaggttgaagattctctgagtgggaggatgggtgagattcaaattagagaagtactatgaggactaaatgaccctacctaagaaagacagtttccaaactaaagttatgggagttgggtacgtaggtagggactcgggaaccatcttggctagagaagggtcagaggaaaaatacagaggaaattcatgggagagagtatcagggtggatatatacggaacagatgcatacttcaaggggacatttagacattttgctctgggatgagcaaaatcaccctctttttcatctcccaacaaaccatttaataaaaagtaagacattactcattatcggagcaggatctgttgatttcgttttttaatttttttaattcatttgtgtttgatgtgatgatgtgccaagaccagcctgaaggtggccaagggcaaaagcagaggttgttatttgcaggctacgttgacactaggtagtgaacttcacagctcaacacatccacacatattggctgaacgttaattagttctgcctagttacagggtttccaaaatggatgagacattctgcctcccctcaaggaatttgtgggctggtaaaggagacagacacagtaacagatcattatgtaatatgctaagtgctttatcagaggaaaaaagctgggtgcaggctgggcgcagtggctcacacctgtagtcccagcactttgagaggccaaggcaagcacctgaggtcaggagtttgagaccagcctggccaatatggtgaagcccattttctactaaaaatacaaaaaattaaccaggagtggtggcacatgccggtagtcccagctactcgggaggctgaggcaggaggatcgcttgaacccaggaggcagaggttgcagtgagccaagattgcaccagtgcactccagcctgggtgatagagcaagactctgtctcaaaaaaaaaaaaaaagaagctaggcgcatcaggggctttgagccttctgacccagcctgggaacagggagaagcacaattcaaggggacatttagacattttgctgtgggaggagcaaaatcactcctggcaggagcgacccccgggctcagttcaccaggtgaaaggaacaggcaaagtcacataagtacaaagcagtgtggtgcttcctgggaccaaaaagcaattcgttatcaataaaacatactttgcgttggttcccatcttaccgaaccttctttcctttcttctttcttccctgcttccttctcacacgccctccactcacctctcagaactcattctatgtgatctctacccaaagcacagtgctaagagcccggaataaaacgggcaaaaccaacctagccattgtcctcatagaattaatcatacaaataaaaatataattttaacctgtggcaagtgctcagacagaaaaaatccagttaggctgccagtaaaaatactagatgtggccggatgtggtagctcatgcctgtaatcccagcagtttgggaggacaaggcaggtggattgcttgaacccaggagtttgagaccagcctgggcaacacagcaaaccccatctctacaaaaatacaaaaacaaaacacaaaaattagccaggtgtggttgtgtgcacctgtagtaccagctacttgggaggttgaggcaggaggatcacctgagcccaggaggttaaggctatagtgagctgtgattgggccactgcactccagcctgggtaacaggaagaccctgtttcaccaaaacaacaacaacaacaacaacagcagcagcaacaacaaacaaaaaactcccccaaacaggtgcccagttaactttgaatgtcagataaacaacatatatgattttgcagtataagcatgtcccatgcaatatttgggacatacttatcctacacaaaaattgttttttctgtgaaattcaaagttaactggatgtcctgccttttttttttttttttttttttttttttttttgaggtggagcgtcgcactgttgctcaggctggagtgcaatggcgccatcttggctcactgcagcctccacctcccaggtttactagattctccagcctcagccccctgagaagctgggattacaggtgcccaccaccacgcctggctaatttttttgtatttttagtagggacagggtttcactatgttggccaggctggtcttgaagtcctgaccttgtgatccgcccgccttggcctcccaaagtgctgggattacaggtgtgagccaccacacctggcctgcatttttatttgtaaacctggcagccttaagtccaagatcccatgagctcacatgactaggggacctgagttaacctgggctgcagtgggagaaggtgattggagaaagcctgacatctgcagaacagggagctgcacctgggagaggaggccggagaggggagtgacctggagaagggaacagcctgaatgcgaacagaaattggccccaacagagcgttcaagagtctgagagaaggctcctggggcttgagcacagacatttagtttactgggatatggagagaggagaagcaattggaaaatgagtaaatatatcatgcttttaaggaggcatgctgtacaagtaaatgtcaggtacagtgactcaggttattgatttgaaagattagtcagtggagacatgtgctggacttactcagtccctctgttgtcaaggaagtccaacgccaccagcactagatccttcaacaatgcagagtcctcccgcaaatgaatctgactttgcctgtaaaccgcggagagtttcaaaaactggaaagcattacaggtggccagtttgtttccatttatataaagtgcagcaaaaatgatctgtcagagagagaacattgggataaatttcttttttttttttttcttctggagacaaggtcttgctgttgcccaggcaggagtgcagtggtgcgaccatggctccctgcagctttgaactcttcatcttaagggatcctctcacctcagcctcctgagtagctggggccacaggtgtgcactagtatgtctggccaattaaatcaattaaatatatatatattttgtagaggcggggatctcactatgttactcaggttggtcttgaactcttggtcccaggcaatcctcctgctttggcctcccaaagccctgggattgcaggcataagctacatcacctggcctgaaatacgcttgaaggcatcctttgaaccactgttatcacagaagtgtggtcaggttcagtgtggagagtgaatgagaagctgggcaggagcctgtgcgagttgggctttgtggagacacacagaaagatgccccccactttaaccaccttcccttgcctcgtcgtttgactgctgaggtcttactcacactctgagactgtagctttcacgtggcctcctctaatatattttcagtgtagccttaacaatgaatcgtagtaacttctcaccttacatgctccccaaaagatgtcactttgggagaacatattcaaggaaccctccccaatcctgacccccatccccaccccagctcctgctgctgttgacacaactgccttagctgtgaggctgtgccatccattggaacctgggactttccaatgttgggatgcctcagcatcatcaagcaaaattggggttctttttgtgtatgctttaaaaaaaaaaaaaaaacttgaagcataaaactattactggaaagtggtcctgatccagactgcaagagagggctctcggatcttgtgcaagaagaaatttggggcaactccatagagtaaagtgaaagtagtttattagagaagtaaagaatcaaggccgcgcacagtggctcatgcctgtaatctcagcagtttgggaggccgaggcgggcagatcacctgaggtcaggagttcgagaccagcctggccaacatggcaaaaccccatctctactaaaaatacaaaaattagccaggtgtggtggtgggcgactgtaatctcagctactcaggagactgaggcaggagaatcacctgaacctaggaggctgaggttgcagtgagctgagattggtccactgcacttcagtctgggcgacagagtgagacttcatcttaaaaaaaaaaaaaaaaaaaaggattccaaagaatgtcaggtatggtggctcatacctcccagctctttgggaggccaaggcgggaggattggttgaggccaggagttcaagactacactggccaacatagagagaccctgtctctaattttttaaaaaagaagaaactaaaaaaatggcttctctgtaggcagagcagtctcgagtgctgctggttgacaattcttgtggttatgtcttgatcgtatggtaaacaagaggtggattattcatgagttttccggaaatggcacagggaattcctgaaactgagaattcctcttccttttagactatattgggtaacttccagaagttgccatggcacttgtaaactgtcatagtgctggtgggagtgtcttttagcatgctaatgcatcataattagtgtataatgagcagtgaggatgaccagtggtcacttctgacaccatcttggattgggcaggttttggccagcttctttattgcaccctgttttatcagtggggtctttgtgacctgtatcttgtgacctcctgtctcatcctgggactaagaatgcctgacttcctggggttgcagccaagtaggtctcagccttattttacccttattcaagatggagtcactctggttcaaatgcctctgacaaagccagcatagatgaagacctaacacccttgagcaaatgaaagatctgtgtgatggaacagttgcgtgtcttgattggggtggttggttacctgaatctgtacatgtgataaaattgcacagaaccacacacacacatacacacacacaccaatgaattggatgtaaaactggtgaaatctgaataaggtcagttatgcaaaatgtcatcactggggaacattgggtgaaggttttttaggacctctctgacatacaaacggatataaatcagcaattctctccaaataaaaagctaaacaacaaaaccgaccccaaacactgacaccttgtatccatcatccaaatttggtcaatgctaagatatatatttttttttttttttttgagactgggtctcaatgtgtcacccaggctggagtgcagtggtatgatctcggcttactgcaaactctgcctcctgggttcaagcgattctcatgcctcagcctcccaagtagctgggattacaggcacccaccaccattccaggccaatttttgtatttttagtagagacagggtttcaccacgttggccaggctggtctcaaactcctgacctcaggtgatccgcctgccttggcctcccaaagtgctggtattacagctgtgacccaccgcacccagccctaagatctttgtattagtcctttttagaaaaataaaacaaaaccttaaagattcagctggagactcctactcagtcctttttctttccagaaatgacccttgtcatggaattaatatgtatttatcttttccacatttgcttttactgtattatgtgcatagtcataaacaatctgtgatatcctgttatacatttcctttggtagcttattttgccactaaacatgttttcaggatttatgcatgttgaaacatgtagatcaattcttttaattttttaactgctcaaagtatttctaataggtgaatataccacaaattcttcaaccaatcttccactgataataggttgttttccatttttcagtattaccagacattgctatcatggccatccaggtataaatgcctttttgggtcaagagtttctgcagggtttttatctagaattgaaagtgctaagcagacagtatgcacatactaaacttcagtaaacattgagaaattgctatccaactgtgactctataaatttatggctgtcccagcaggtggtaataatcaccatttccttatattttcaccagccaacctgatctttccagactgttaaaagtttgccaatctgatggatgtaaagtagtatttcattgttattttattattgtgttttcctgatttccaatgaggttagacatctcttcataggtttattagctggaatttcctcttctgtgaatcctgaggtcgtacccttttgccctttttttttctattgtgttgtcattgtcataggtattttttgtattttgttcccgattgttttgtatgtttgtgtattataaatttcagcttgtggcctgtcttttaaaaaaagactttttattttgagattattgtagtttgcgtgcagttgtaagaaataatacagagatctatgtatgcctttcacccattttaccccaatggtgacattttggacagctaaatacagtatcaaagacaggaaattgacattgatacaatccattcatcctattcagatttcaccagatttatgtgtgtgtctgtgtgtgtgtgtgtgtgtatttagttctatacaattttatcatatatttagatttgtgtgactatcaacaaagtcaagatacagaacagttccatcacaaaggttcctcctgctacttttgtatagttacagttaccttgccccattcaacccctagcaacaacaattagttttctatttccataattttgtcatttcaagaatattaaagaaatggaatcatgcagtatataacctttttgagattggctttttcactcaccgtaattctctcaagatccatccaagttgctgtgtgtatcagccattcattccttttcattgccaagtaatattccattgtatggatgtaccatggtttgttttacccattgaaggacatctggattatttccagttacaggctattatgcttaatgctgctatgaatactcttatgcaaatttttgtgtgaacataagttttcatttctctgagataaacgctcaggagtgcagttactgagttgcttcaaatgcatatttagccttataagaaattgccaaactattttctagagtggttgtaccatgttacattcccattggcagtgcacaagggattcagtttcttcccatcctcacctgcatttggtgttatcattattttttattttagctagtctgataggtgtgcagtgacatcttgtggttttaatttgcattttctttatatctaatgctgttgcacatctttttatgggcttatttgtatgtccatctgtataatctcttcagtgaaatgcctgttcatgtcctttgtccacttactaattggtttatttggggtttttctgctgttgacttttaagagttctttatgtattctaaatacaggtccttgttgggtatgtggtttgcaaatatttcctcctagtccgtagcttgttttttcactttcttgtcaatgaagagtcaaactctgtaaaatatttgaagatacttattctgagccaaatggaagtgaataatgacctgtgacacagccctcaggagatcctgagaacatatgctcaaggtggttgggccacagcttggttttaaacattttagggagatacaaggcatcaaccaatatatgtaagatgtacattgatttggtccagaaaggcaggacaactggaagcaggaactttcaagtcataggtggattcaaagattttctgactggcaattgattgaaggagttaagttattgtctacagactgagaatcaatagaaaggaatgtctgggttaagataaggggttgtggagaccaaggtttcattctgcagtcaaagcctctgtgtagcaggattcagagagaacagattgtaaatatttcttttctttttttttactttttcttttcttttctttctttctttcttcttcttttttttttttttttttttttttttttgaggcagggtctcagtctgtcaccaagtctggagtgcagtggcacgatcacagctcactacaaactttgtctccagggctcaagtgatcctcccacctcaaccttccaagtaactgggactataggtgtgcacctccccacctggctaatttttgtattttttgtagagatggggtttggctgtgttggacagactggtctcaaactcctggcctcaagtgatccacccacttgtcttcccaaagtgctgggattacaggcatgagccaccacacctgacctgattgtaaatgtttcaatcagacttaaagagtctgttctattaataattccaaaaggaaggcaggtataatgaggcatgtctggctctcccttccaatcatggtctgaatgactttttcaggttaactttgacatgcccttggctgagaggagggctccattcagatggttggggggccttagaattttgtttttggtttatactcttcacagactcttttgcagagcaaaggtttttaattttgatgaggtctaatttatcaattttcccttttatagattatgctttggtgtcaaatctgggaactctttgcccccctttaggttcttaagattttcccttgttttgttctgaaagtattatagttttacattttacactaagtctgtgaatcattttattttttgtgtaaagcatgataattaggtagagatttatttttttggcctgtggatatccaatttgtccagtattgtttgttgaaaaggcttgacttcctccaataaatcatcttcacacttttttttttttttttttttgagacagatccttgctgtgttgcccaggctggagtccggtggtgcagtcacagctcactgcaacctccacctcctgggttcaagtgattcttgtgtctcagctaagtagctgggactacaagtgcgtgccaccacacctggctaacttttgtatttttttagtagagacagggtttcaccatgctggccgggctggtcttgaactcctggactcaagcaatcctcccacctcagcatcccaaagtgctgggattacaggcatgagccactgcacccacccttcgcacctttgtgaaaaataatgtgggcacatttgtttggggctatttctggattctctgttctgttccctcaatctatatgtgtattcttccaccagtaacacagtaacacagtcttgttaaagtaagctgtaggtatatgtaatcatttgtgattccttccagcttattcatatttctcaaattattttagctcttacaggtcctatgcctttatatataaaatttagagtaatatcgtttatgtcttcaaaaattaccttgcaggggtattgataggaatagcattaaacctacaggtcattttgagtgtaactgatatctttactatgtggagtttgccaatccatgaacacaatatgtctcccgatttattgagatattcttaattctttcttcagaattctgtaaatttcagcatacatatcctctacatattttgataaatttatatttaggtatttcattttctttggagtaattataaatggtaatgtgtctttaattttggtttccacatgttaattattagtatatatagatgcagttcatatttgtctcttgacattggatcttgcaaactttctaaactcttgtattagctctaatagttttttggtaagttattggagatctacgtagacacttaagtcatctgcaaatagggacagttttatttcttccttcctaatttgtatgccttttatttctttttcttgttttattgcactggctagaacttcagtactatattgaatgacagtagtgagagcagacattcttggctttttcccaattttagggagaaaaaaatcaggttctcaccattaggatgttagctgtagttttgtgtagatacactttattaagttgagaatgttctcccttattcctactttctgagactttttgtactacatgagtgttggattttgtcaaatgctttttctgcatcaattgatacaattgtatgattttttatttttaccttgttaatatagtggatcacacattgattgattttcaaactagctttgcatacctggattgtcccacttagttgtggtgtataattcttttcatccatcattgggtttgatttgctagtatttttagtattttgttgaaaatttttgctctaagttcatgaggaatatattggtctgtagttttcctttgttgtactgtctctctctggttgtggtatgacggtaatacaagattcataaaatgagtgatggagtgttcctttttctttctttctttcttttttttttttagacagagtctttctctgtcgcaaggctggagtgcagtggcgcgatctcagctcactgcaacctccaactctcaggttcaagcgattcccctgcctcagactcccaggtagctgggattacaggcacatgccaccacgcctggctaattttttgtattttagtagagacggggtttcaccatgttggccaagatgatctcaatctcctgacctcatgatctgcccactttggcctcccaaagtgctgggattataggcatgagccaccgcacctggcctcttttttttttttttttttttttttttttggagagggagtcttgctttgtcactcaggctgcagtgcagtggtgcaatctcggctcactgcaacctctccctcccaggttcaagtgcttctcctgcctcagactcccgagaaactgggactacaggcgcctgctgccacgcccagctaattttttgtattttagtagagatggggtttcacgatgttgcccaagctagtcttgaactcctgacctcaagtcatcctcctgcctcggcctcccaaagtgctaggattacaggcgtcagccactgtgcctggccaagtgttaccttttctattttccacaaaagattgtgtaaaatatgtattaattctttaaagatttgatagaattcttcaatgaagaattgatagagattcattttttttggcctatggatgtccaatttgtccagcgttgtttgttaaaaaggaataatttgaaagctcacaaagagaaatatccaggcaatttctggagatttctcctggagatttctcttttgggagtttttaaattatgcactcattttccttaatggttttagaactatgcagattttctaattcgtcttggatgagtttggtagagtgttgtttttgaggaattggtccatttcattaagttgtcaagtttctgcgtaaaaagttgtttgcagtattcccttgttatctactcagtggctatagaatctgtagagattatcacctgtttcatttctgatattagtgctttgtgtcctctctctcactctctctctctgtctgtctctttttagagataggggtcttgctgcattacctaggtgagacttgacctcctgggctcaagagatcctcctgtctcagcctccaaagtagctggaactacaagcatgcaccaccacgcctggctaattttttgtagagatggggtcttgctatgttcccctggctggtctcgaacttctggactcaagcaattctcccacctcagcctcccaaagtgctaggattaaaggcatgagccactgcacccagccctctttcttcatataagcatttagtgctattaattttacactgagtacagtctctgtatcacatatgttttgatatgttgtattttcattttcatttggttctattctttaagttttgttttagaattcttctttgacctagagattatttagaagtatgttgtttaatttccaagtgtcaggagattttctgttatatttctgttattgatttctggttttgttccattatggtcagggaatataacacataattttaattcttttgaatttgttggggattgttttttggccggggtatggtctatcttggtaaatgctctgtgaacacttggaaaaaaatatgtattccactgttgttgggtgaagtgttcccaacttaaatatcaattaagttgaatgttatgcagttattctatatccttgctgattttctgtctagtaagtctaccagttgctcacagtgggatgttgaagtgatcaattgtaactgtagatttgtgtacttctcctttcggctttatgaatctttgtttcatgcatcttcagactctctgttgtttggtgcatacacaggattgctatgtcttcttgataggttgacccttttatcatgatgtaatgtctctctggtaattttctttgctttaaagtctactttatctggtattagtagagccatcctggcttttcttttgattaacatttgtgtatctttttctatcattttactttgaatctgcctatatcattatatttgaagtgagtttcttctagataacatattgctggataatgttttcatgttcattttgccaatctgtctttaaactgatatatttagaccatttacatttaaggcaattattaatgtgttaggatttaagtctgccattttattgtttgtttctcctgtttttccttctctgcttctcttttcctactttcctacaggttacttgacatattttaaggattccatctttttttttttttttttgacatggtctcgctctgttgcccaggctggagtgcagtggcatgatgacttggctcactgcaacctttactttccaggttcaagcagttctcatgcctcagcctcccaagtagctgagatcacaggcatgcgtcactatgcctagctaatttttgtattttcagtagagatgaggtttcgccatgttggccaggctggtctcaaactcctgacctcaggtcatccacctgcctcagcctcccgaagtgttgggattacaggcgtgagccactgaggccagccagattccatctttaaaaaaaattattattgatttttgtgggtacataagtacccaaataagataaaactaaagttccaagccttcttctgttatcattacctttctgtttggagaatttcctttagcctttttttttttttttgagttgtagctttgctcttgttgcccaggctggagtggagtgcagtggtgccacctcagctcactgcaacctcgacctcccaggttcaagtgcttctcatgtctcagcctcctgagtagctgggattatataggctcctgccaccatgcccagctaatttttgtatttttagtagcgatggggtttcattatgttggccaggctggtctcgaatgcccgacctcaggtgatccacccgcctcagcctcccaaagtgctgggattacaggtgtgagccaccgtgcctggcccctttagccattctttaagggcaggtttactaacaacaaattctcttagtgttttctcgcctgagaatgtctttgtttcctcttcattcctgacatctatttttgccagatatagaattcacaattcataattcttttcttttacttcttgaaaaatattgagtcacttccttctagttgccatggtttcaaaggagaacttgactgtcatttaaattgatgttccctttcaaataatgttttatggctgggtgcggtggctcacgcctgtaatcccagcactttgggaggccgaggcaggcggatcatgaggtcaggagatcgagaccatcctggctaacatggtgaaaccccgtctctactgaaaatacaaaaaaattagccgggcgtggtggcaggtgcctatagtcccagctcctcgggaggctgaggcaggagaatggcgtgaacccaggaggtggagcttgcagtgagcagagatcatgccactgcactccagcctcggtgacagagtgagactctgtctcaaaaaaaaaaaaaaaaaagttttatttctttctgaatccattcaagatttttcttttttttttgtcagagtttaaggacatgtcttggtatggatttctttagttttatcttatttgggattttctcagcttcttgaatccataggttatctttcttcaaatttgggaagttttcagctattgattcttcaaataatttttcagtaccatattctttcttttctccttctaggaatacaaattaatttttatttatttattttgagacagggtctcactctgttgcccagggtggagcgcagtggcacaatcatagcccactgcagcctcaacctcctgggctcaagtgatctgcctgcctcagcctcctgaattgagttgctagaactacaggcatgtgccaccacactctgctaaatttttttgtgtgtgtgtgctttttgtagagacagggtctcactatgttgctctgctgatcttgaactcctggcctcaaacgttcctcctgcctcagcctcctaaagcactgggatttcagtcatgagccactgtgcctggcctttctcttttttattcttattttttttgagatggagtcttgctctattgcccaggctggagtgcaatggtatgatctcagctcactgcaacctctgcctccggtgttcaagcgattctcctgcctcagcctccctagtagctgggatacaggcatgcaccaccacgtccagctaatttttgggttttaagtagagatggggtttcaacatgttggccaggctggtcttgaactcctgacctcaagtgatctacccgcttggcctcccaaagcactgggatttcaggtgtgagccaccgcacccagcctttctcttttctttttaagcaggtagccttcctgttgagctatagtatgaggggtggttgggatgtatattcactttcccccttggtgctggggccactttcctagaaaatatgaggaacaaacctgacagtgctgcattgcttcctggtagggggtgtacgtttagttccttactgcgctctactgctgctggggagtgagaaatgatgagttgactcgtaccactttgttgatgcagggtgagggcagaaacttagctccccaatgggtcccactgacaccagcaggtgggggagtgaggcaggagtacagactagccttgcacaaagtcagaggacagtccaaaagaccactctcacttctgacaccagctgcgagtttgggggtccccaaaactgtcctcaactttcatgctttgctagagggactcacagaactccctgaaagctgttgtactcacagttacagtttattacagggaaagagttcagattaaaatcaggcaagggaagaagcctggagggcagaatacaggtaagttctgaacacagagatgacagtggagtaatgggcagctttaattgtcctggcaataacatgtgacaaaatgaatggagtatgtcaaccagggaagctcactcaagccttggtgtcactgctagaccttcctgatacttgtttggtaaagaaatcagagtgccacctccttccactgggtgggggatggagaatcagctctcaatttgttcccacccatgctaccccagcaggggaatcagactgttaccacctgcttctgccacatgggagttggaaaatcaactttaatctcctgtcaatgatgtgtgaaaatacacacaaagtattgccaagcagggaagctctcccaagccttggtgtccagagtttttattggggctcagtcatgtagacctggttgactgcccacattgctgacctcattctccagcccctctgaaggtggagctgatgccatgtgacccaaagctcccatcctgaatcacatcacttgactttctgatgtggtctaaagcccccctgtgaacaaacacacttttattaagcaggacattccaaaggctgagagatgacctcccaggagctgaagtttaaattcattactgcatatcctactttgtacatgtcattcacttttttttttttttttttttgagatggagtctcactctgttgcccaagctggagtgcagtggcgtgatcttggcttattgcagcctccgcctcccgggttcaagtgattctcctgcctcagccttctgagtagctggggttactggcgcccaccaccatacccggctaatttttgtagtttcagtagagacagggtttcaccatgttggccaggctggtctcgaactccttacctcaggcaattcacccacctcagcctcccaaagtgctgggattacaggcgtgagcccctgtgcccagcccacatctcattcacttttattgctgccaggtgggtgtggaggttcagcttcacagtgagctttgttgacaccagtgtaggtggaaaatgcaggcctggctggccatgacttgtgccacttgtccaatcttggtgatgctgattgggatggagactccggctctgccgggctctgccaacaccagggtgagaaggaaagaagagtcatggtgagtagcctcaccttgcaccagctcattaagtctgctgaaggggaggggagagagacgggagacccatcaccagaccctgatgacatggctgtggcaggaaaatcagggtaccaccttcttccactgggtgggggatacaggatcagcttcccactcattcccatctatgtaccccagcaggggaatcagagcatcaccacctgcttctgccatgtggaagctacaagaccagatccccagttggccctgctgaaatgacagggaaggggttgcagtttttccatcagtctttggctggcagggcagatatggttaaaaaaaatttctctataatctcagcattttgagagtccaacgtgggaggattgcttgaggctagtagttcaagaccagcctaggcaactgtattagtctgttctcatgctgctatgaagaaatacctgagactgggtaattataaagaaaagaggttcagttgactcacccttccacatgtctggggaggcctcaggaaacttagaattgtgtgtggaaggcacctcttcatagggcggcaggagagagaatgagtgcaagcaggggaaatgccagacacttataaaaccatcagatctcatgagactcactcattatcacgagaacagcatgggggaaaccacctccatgattcagttacctccacctggtcccgcccttgacacgtggggattatgggaattacaattcaaggtgagatttgggtggggacacagagccaaaccatatcagcaacatagtgagacctcctgctctacaaaaaatacaataattagccagttgtgttgatgcacacctgtagtcccagctgctcaggaggttgaggcaagaggattacttgagcctgggaggttgaggctgcagtgagccatgatcgtgtcactccactccagcctaggcaacaaagtgagatcatggcttaaaaacaaaaatgaataaaaaatcctgttgctggttttctttcttttcttttgattcaggggaactggcttttcttagagcgtttttttttttctgtgcttggtagtggttccaggtcagaggcttttcctttactgtgtctgggatgttggggtatatggaagacaataagaaaactcaggctgctcactgccacgagtgcccaaagtcccaggatccagaggtagtatgtcttctccttttcacctttcagaatctccttatgcttgtctgctgtgttatgtctgtgagttatcagttgtaagagagaggacctgggaagaatgacactactgcatcttggccagaaccagaagtcctgtagcttgactttcactttgcttatgatactgtatttagttttgacttttaatgagtcaaatgcattgaccttttcctctaaggtttgtgtgtgtgtgtctgtgtgtgtgtctgtttaagaaatccttctcgacattcaagtcataaagatagctcagactttttctctagtttttaattttttttagatggagtctcactctgttgcccaggctggagtgcagtggcacaatctcggctcactgcagcctctgcctctcccgggttcaagcgattctcctgcctcagcctcccaagtagctgggatttacaggcacacaccaccatgcccagctaatttttgtatttttagtagagacagggtttcaccatgttggccaagctggtctcgaactcctgacctcaagtgatcctcccacctcagcctcccaaagtgttgggattacagatgtgagccaccacgcctggcctttttctctagttttaaagtgctttccccactcccatatttaggtatttagtctaattggaatttatttttgggtgtgacagtgattttcaaagcatgatccaaggaccctgggtgactgagactctgtcaggaggacgatgaggtcaaactattttcctaatgatgccaagatgtaatttttctttattgtgttgacattcccaatgacagtgccaaagcattggtgggtaacactttttgcaccttagcacaagaaggcagggcaccccactctactcatcttcatattcttcatggccatgtattcacagttaaacaaacatgcaccagtttcatttaagaatgttcttgatgaagcagtgagagttattattgttactgactcctgatcccaagtatgtctttgagctcttctggatgatggaatgggaaatacacgaaaagcacttcttctggattctgaagcacaatggttgtctcaaggaaaagcacttatgcagtggctggaactgaactagctgccttttgtcttttgttttttgtttgcgtagaacatcattgaaagaaatactgagaaactctgatttttcagccttgggtatttgtcagacattctctcaaaaatgagtaaataagcctgtcacttcaaggaaaacaactgacagtgtttgttgctggtgatcaaacttgagctttcaaataaacaattagaattctggaacacttgtatctgttaccatgggcttgatggtttccaatagaagactttttgatgtgattggtcgtaatgttaatgaatgtgattttggggatgaaatgtgtcaaatgtggaagatcagtgtaaatcagtggcctaatgttttgtaaatgaccaatacatgatattccaaaatcatacttgagcaaaagatctttcaaagagtaagatagaccaatgaattctcatgtaacagagtatgaattgatacagtttcagattccacattgcaagtaaaccttaaaaatgactacttcttgagtttgggtgtcatagaaaataagaatattcacaataatctgaaaaggctattaaactactcctgcctttgctaaccacacatttctgtgaggttagattttccttatatactccaaccaaaacaatatatattaaaacagaccgaacatagaagcagatataagaatctagccagacattgaaacgatttgcaaaaatttaaaacaatgtcactaaaaattttttgttttgaaaaatagaagattttaaaattaaataacatgttacctatgttaccatgtaatgaatttatagtgaatttaaaaaataaattattaaggccaggtgtggtggctgacacttgtaatcccagcattttgggaggctgaggtgggaggatcacttggacctgggagattgagaatgaagtgagccattatcatgccacgccactgcactcgagcttgagcaacagaatgagagcctgtctcaaaaatttttttctaaaatttctcagtttcaatttatcatatagttttcatatatatatataatatatatataatatatatttaaaaagctctttgggtcctccatatttttttaaatggccaggaaatgttgatctatggcatgaaatagagatctgattttattaatttttttttttggagatggagtctcactcagtcacccaggctggagtgcagtgacacgatctcggctcactgcaagctccacctcctgggttcatgccattctcctgcctcagcctcccaagtagctggactacaggcacccgccactatgcccggctaatttgttttgtattttttagtagagacggggattcaccgtgttagccaggatggtctcaatctcctgacctcgtgatccgcccgtctaggcctcccaaagtgctgggattacaggcgtgagccactgcacctggccaatctgattttattttcattttctcatgtgaataaccagtttctccagtagctgaagtagtctatcctatccctactaatttgtaatataacctcttgccattagtatgtttccatattcatttgattgtgtgcctagactctttttctattatatatatttatttgttcatccatatgccaattccactgtctttttttttttttttttttttttttgagacagagtctcactctgtcaccccggctggagtgcagtggcacgatctcggctcactgtaacctccgtctcccaggttcaagtgattcttcagcctcagcctcccaagtagctgggactacaggcatgcaccaccacaccgagctaatttttctatttttggtagagatgggttttcaccatgttggccaggatggtttcgatctcttgacgtcaagatccactgacatcggcctcccaaagtgctgggattacaagcatgagccactgtgcccggccaggaattacacttttagaaatttgtattatacagatatttgcaggaatgcatgaagatctgtataagagaatttcattagagcattgtgtctaataataaaaaattagaatcagtctaagagtccatccatagagaagtggctaaactatggtagaactttagagcaaaatattatgtagctatttggaaaagaatgcagaagatctaattgtatcatcatggaatggtcttcaagatattaagtagaaagtcaccaagtggaaaaacaagtcacagaatatgtagagcatgttcccatttctgctaaaaaaaaaataataatacaaaaactcagccgggcacagtggctcatgcctgtaatcccagcactttgggaggccgaggcgggtggatcacgaggtcaggggatcgagaccatcctggctaacacggtgaaaccccgtctctgctaaaaatacaaaaaaattagctgggtgtggtggtgggcacctgtagtcccagctactccggaggctgaggcaggagaatggcgtgaacccgggaggcggagcttgcagtgagccgagattgtgccactgcatgccaacctgggcgacagagtaagactccatctcaaaaaaaaaacccacccaggtgcatgcccaactactaccagcgatttgtcacctctgagaagaggagtgggattggaagagagatgtcaagggaactcttttctttcctttttaaaacctacttctagattgtctgcattttctataacaagaattaattaacatattgcttgtgtacttattttctttttcttttctttcttttttttttttgagatggagtctctctctgtccctcaggctggagtgcaataatagcatgatctcgggtcactgcaacctccacctcccaggttcaagcaactctcctacctcagcctcccaagtagctgggattacaggtgcctgccaccatgcccggcaaatttttgtatttttttttttagtagagacggggtttcactacgttgactagcctggtcttgaactcctgacctcaagtgatctgcccacctcagcctcccaaagtgctgggattacaggcatgagccaccgcgcctggcctgctgtgtaattctaaataatcatcaggaccatgaacctgaccatctgtgaaagacagagatgtttcctggcaggatagggtccactgccattgatattggcaaggtgcctgctgctccttagcctgctgtaggtaccagattgaccttgagtagaaccagccttgagagaagaggaaaggagagccaggccctaatcatagggatccccaggggtgtagatgatgttaaggcaacatcttctctgtgtctaagagaaaaagaatctgccctgagtatgaactgacttgtgtgctttgaggtcagtgtcctaaacaggaagccatgaggtgagcagagacacttccctgctgcctggggctgggagttgggaagtgagaaaacatcctagtggccaccagaaccatccagtgggtggctctgaatcctgcattgatttgttgggagactttggaggaggagcctggtgtggagggttgagcctggtgagttggaggcagcagctggttactttccatgcagagcagcttggagttgagtcactcgacaatccaagggcacctgtggaagcagccatgactcatgctaccttcagtttcacatctggaggaggaaatcactgacaaagcaaagcaaggcgacttctgggggctgccgtgtaggattctcccatgtttaaaaaagaaaaaaagattgtacaggatttaaacatagcatttattgcctgtgttcttagttataaaattaatacatgtacataataattgttgtagttagttattttattcagcatttatcctatgtcaggtactgatgcttcaagctttacatgcgttgtctcacttagtgtttctgaccattcagtgggggagatctgttattatacccattttacagatatggaaactgagtctatacacacacacacgcgcgtaaaacacatagaaaaaaatcacccacaattctacccgccaaagtcaaccaacatcctgatgcgtgtttttctagtaaccttttaatatttttcctgtgtagctaatatccaactattttactttcccatatcctgcctttttcactcagctctaaattatgatcctagtcccaaatcatcacatattcttcaataacttaactagtccatatggccaaacattgtatgtttccaatttttccactgttataaaggttgctgttgtgagttatcttagtgggctaaactccgattattcctctaggaagaacatggaatgatacattcttctaaagaaatgttctgtgtttctatgctcttccctctactaggaggcacttgaacggagtggttgagagttgtaaaaacctatttttatttatttatttatttttgagacagagtttctctctgaagcccaggctggagtgcaatggcatgatctcagctcactgcaacctctgcctcctgggttcaagtgattctcctgcctcagcctctcaagtagctggggttatagatgtccaccaccatacctggccaatttttgtagttttattagagatgaggtttccccatgttggccaggctggtctcgaactcttgacctcaggtgatccactcgcctcggcctcccaaagtgctaggattacaggcatgagccaccgtgcctggccagaaaaatctatgtttgagtcccagctctctgctgatctacaactatgtaaacttgggcaagttatgtcccctttctggcccttgcatacttacctataaaacaaggctaaagtaatatttactacctcaagggttgctgtgaggattaacgatgtaattactgtaggtagaggtatcttagtccatttcatgttgctgtaaaggaataccggaggttgggtaatttataaataaaagaggtttatttggctcatagttctgcaggttatacaagaaacatggtgccagcatctgattctggtgaggggcccaagaatcttacaatcactgtggaaggtgaaggggaacagacatcacatgtcaagagagaggaagagaaaagaggaagatgccagcttctttaacagccagatctcttgggaattaagggtgagaactcactcaatcctgcaaacatggcatgaagccattcacgagggatctgctcccatcatccaaacacctctcaacaggccccacttccaacactggggatcaaattttaacatgagatttggagggaacagatgttcagaccacatcaaaagggcttagcaccttgttattaggcctagaaagcatctcccccttctcctgcctcttgaccaccatatctagcttcagtgacactccttttgtgaaatctctgatatctgcgtggttaaaattatgctcttcccccaacctcttttttttttttgagaaagagtctcgctctgctgcccaggcaggagtgcagtggtgcaatctcaactcactgcaaacttcgcctcctgggttcaagcgattctcctgccttagcctcccaaatagctgggactacaggcacacaccgccacacccggctaatttttgtatttttagtagagacagggtttcaccatattggccaggctggtctcgagctcctgacctcaggtaatctgcccaccttggcctcccaaagtgctgagattacaggcgtgagccaccgcacctggcctctttccccttttttaaaaaaagaaggcgaaattcacataacatagcattcatcattttaaagtgtacccttcagtggctttatgtacattcacagtcttgtgcaaccatcacctctagatgccaaacattttcatcatcccacaaggaaaccacttacccattgaccccttatccacagtagtcactgtacttcaaggtttcccatatcccatatccagcgtggctggatccaagggatcaaatgccatcagtaggactcagtttttctgcatctacttgtgttggcttcactctcgggcagatgctttccatatggcaatcccagtggctctaagcttacattagccatcaggtagcaatcccaacagagagagatcgtttcattagaagtttcaatggaagtcatgggactgagtattattgcctcaacttggataatttgcccatggctgaactgattaccatggtgggggagaggggaagaggtggcggtagaatattctgattggccaggttctgggtcgtatgttcattcctccaaattgcattcagaaaatgggtgctggatggggcaaaaaatcaggtgtcattcaaagttcactaggcttagggagctgggctcagaggccagaggcctgatcttgatcttgtcatcacttagcaaatctcctggccattcaggccttcacacttcctgtctgtaaatgggtttatcaccactcattcaagtcctaattattaccagcgctgagaaaccaatactttctttttccatctcgcttgtgtaatttcttcggagaagcatttggatggtctctgaaccatttttaccctgagaaatgggacttaggaaattatgcagccacattttatatccattctggtcatttcagtaattggttctgagacactatttccccgagcaccatcccaagtataaactactatttccatctgtgttactggaggaaactggggaaagacatttgtgggttttttcccccccaggccaaaaaaaaaaagcaaacaaacaacaacaagaaaaactaaagtagagcccaaaaccaatttgttggttcccagcttggcttaggcaccattctaagcatattccactagtccctccatctccaaactagtcattcttgggagctgacctacttagtgcacagcaaaggaaataaacagaaatccagcaagtccatcatttgagaggcccatgctgatgactcagagaatatataaaatggcaggttggccaggtgtagtggctcatgcctgtaatcctagcactttgggagactgaggtgggtggatcacctgaggtcaggagttcaagaccaggctggccaacatggtgaaaccttgtctctactaaaaatacaaaaattagccaggtgtggtggcacaatcgctggaacttgggaggcagagactgcagtgagccgagatcgtgccactatactccagcctgggcaacagagcaagactccatctcaaaaaaaaaaaaaaaaagccaggttgttttgctcttaatcgggttacgtttgaggattcttttggttctaggtgaccaaaacccactgggttcagccaaaagtggatattgttgaaggattctagggtgtctcacagaacacagggccatggttccactggaattcaggaaggggatagagtccattgtgaatcaaggaggtccctcccaccacctctacctcttgactgtttttctccatgtctcctctattcttctatctcatgggagagtgacagaagtcaggttgagactggaatcttaatctcagcaccaaaagctcagggaaggagcctattggtccagcttgggccagatgttgacacctgatccaatcaaatatggagaggggatgtgagttccattgtatcaacatgatcgtgttagtggtccagaaatacttctgagggaaaaaaaggtgtatgttacacagtgatatcaattaaattctaaactatagtgaaatattattgtcatttccacctcttttaaataaatctgagatggtctaacccctagcatagttcagtttctgggtctagattactggggtttgaatcctggccccaatatttgctgtgtgatcttaggcaaattacttaacctgtctctgtgccttcgttttgtcatctacaaaatgggtataataatattacttacctgacagcatggttggagccattaaatgtgttaatgtaagtaaaatgctcagaactctgcctggcaaatagtaaagatttaacaaatagctattattattactgtaaagttcatttcattatgacagattgtttttcagattattcaaaatatagaagatgtttaaaagggaatttctatgataatgggaaaatagggctgaataaccattactaagattgaatatatcattgctattgcccttgaattctataatttgaattcatattatttgaattctagacggtacttttgatttataaccttaaaagctttagtaagggtttcttctaaacagccttatataaaataatagcaattcttgccatcttacctagcaggaaaaaccaattgttttatcaagtttgccagcataagattgaaatttaaagcctttaatatcttagtttataaaagacaagttacagaatgtctctttcctggatgtcttagaattacagtatcttttagggcaggagtctgtgaacctttgcttaaaggactcatggtaaatatttttgtctttgagggccatattgttaaaggaaaggggtcccgatccagaccccaagagaggattcttagatattgtgcaagaaagaactcaaggcgaatccatagagtaaaatgaaagcaagtttatttattaagtttcttaagttattaagaaagtaaagaaataaaagaatggctactccacagccagaacagcagcttggactgctcaactcataatgcttaacagttttttctaaattatatgctaaacaaggggcgaattattcatgagttttctgggaaagaggtgggcaattcccacagctgagggttcctccacttttaagactatataaggtaactgacattgccatggcatttgtaaacagtcctggcgctggtgggcgggtcttttagcatggtaatgcattataattagtgtggaatgagtagtgaggatgaccagagatcatgtgcgttgccctcttggttttggtggcttttggccagcttctttaccgcaacctgttttatcggtcaggtctttgtgacctgtatcttgtgccgtcctcctagctcatcctgtgacttagaatgcctaacctcctgggaatgcagcccaataggtctccgcctcattttacccagcccctattcaagatggtgttgttctggttcaaacgcttctgacagtatggtctctgtcccagctactcagccctgctgtaacacaaaagcagtcatcaacagtacctaaacaaatgggcatggatgtgttctaataaagctttatttatagatgctgaaatctgaattttttgcagttttcatttgattccacgctgaccccttgccccccgtccaaatattcacaaatgtaaaagccattcttgtctcacaggctgcacaaaaagaagtgatgggctggagatggccttggggccatatttttcataccctgctttaggagacagtgcattagcattctgacagcaggcaggggaggtacaagatgactgtctactgcctcttgggttctaacaccccagatgcatgttgaccccctgctgcttctcatcatgcgtttctcttaaaagatacatagtatttgtggggctgggcgcggtggcccacatctgtaatcccagcactttgggaggccgaggcgggtggatcacgaggtcaggagagcaagaccgtcctggctaacacagtgaaaccccatctctactaaaaaaaaaaaaaaaatacaaaaattagctgggcgtggtggtgggtgtctgtggtcccaggtaccccggaggctgaggcaggagaatggcgtgaaccgagatcgcgccactgcactccagcctgggcaacagagcgagactccgtctcaaaaaaaaaaaaaacaaagatatatagtatttgtgtgactttcttggttttgtgcaacagaaaactcaacccaaactgcatatgcaaaaaaaaaaaaaaaaaaaaaggaatgtactaaccggggtttctacactctaggggtggttgaggcaggagtccaaagtctatctgtttatccctcagcttttatcccctccatgagggctttgttcttaggattcagggtttcttttcccccaggggggttcacagcaaagttctgggtctgactacttctggtgtgtatctgatcctatatctatctgaatctgaacgggaagggaacacagtgagcaccttaggccacacctgggtagggtaagccccattaaatttgcaagtcctgggagcggtggtgccagttggttccccaaaggaaacaggtcctattacctaagaaaggtgaatggatactgggaggcaaatcaacaaatgtccattgcacatgaggacatcacactgtgacatttagaatctaaatgctctgaacaaaatgtataggggaccttccaggaacgggaaattgctgttcctaccccctctttttggagaaattgctgttcctcccattggcaaaattcccctcgcaggttccagcttctttctcttagaacagaccttctggtttggcaagcccagtcccacatcgaggtttagttctggacttctgtgcagggtcatggcactcgcttgattgaaattttgtttggggaagcaatgacctgaagagcttacagcctgggtcaaccactcaccactctcaggaaaagcagacagagccaaactttctagctgggctcaaaatagctattttctgacgtgggtcctccatgactcatggtggagttttccaggctcgaggggactgttgacatttactctgctcctcccacgccacagagtctaactttttctatcttcccccaaacataactcattacctccagtttatcccatgtacacttctttttcaccccagttttcttttattttcagcgatccattccagatccaatatctttttttttgagatggagtcttgctctgtcgcccaggctgcagtgcagtggctcgatctcggctggctgcaagctacgcctcccgggttcacgccattctcctgcctcagccttccgagtagctgggactacaggcgcccgccctcatccggctaattttttgtattttttgtagagacggagtttcaccgtatgagccaggatcctctcgatctcctgaccacatgatctgcccacctcggcctccccaagtgctgggattacaggtgtaagccacctgcacccagccctccagatccaatatctttttcctccatcctttgccaaaccaggacttcagcttctggttactggtgcccacttcaagagatgccaggcagggaactctcaggacacataccaggcctgcactggcatatgtattttttggagacaggatctctgtcactcaaaatagagtgcagtggcgtgatcatggcccactgcagcctttaactcctaggctcaagtgatcctcctgcctcaaccttctgagtagctgggaccactggcatatgccaccacacctagctaatttttcaaaattttgtagagatggggtcttgctatgttgcccaggctgatcttcaactcttggtctcaagcaaccctcctgcctcaacctcccatagttttgggattacaggcatgagccactgcacccagcctcggactgctactttagaccccactttcttgtccaggtgtgatcctgggtgcgtgtgcccagagacgccctggctacctgggattcatccatcaaacacctggtcattcagccaattctgtgcgaacagcaccttcccggctgtcccaccctctgcaaagatctgtgatgctggaaagttgtgtgtggctaagtcggaagaagtgaagttcatctgcataagtgcagtagtgtatttattgatttttattcttattttttatttttatttatttatttgagacagggtcttgctctgtcacccaggctgtggtgcagtggcatgatctcagctcactgtaacctccaccgccttctgggcttgagcaatcctcccacctcagcctcccgagtagctgggaccagaggcacacccaccatgcccggctattttggtttttgtattttttgtagagatgaggtcttgatatattgcccaggctggtctcgaactcctgagctcaagtaatcttcccgcctcggcctcccaaagtgttgggattacaggcgtgagccaccacgcccagtccagtagtgcatttactgatagcacttactgcagctattttcttttattgcatttactgcattcctgctatgtcccaggctttgcacacattagtaggcgttcgatcctttaacaattctttgaggcagtagcaggtcttcctatttctatacttgctcccttagtagatcacactctcatgggaaacacagtgacttttttttttctttctttctttttttcagacagagtttccctcttgttgcccagtctggagtgcaatggtgagatcttggctcactgcctcagcctcccaagtagctgggattacctgccaccacgcccagcctgattgtattttttaaaattaaaattgaaataccatcaataggttgaccactaggactaaaatccaaacttttcagtgtggcctataggccgggcatcatggggccacttcctgtctctccatcttggaacaccccttcccttcctcattttgctccacccacatctgccttttctctttcttttagagacaggatctcactgtgttgtcacctctcacagcttctgcactcgtggatcctctatctgaagcattcttccccctccgtcttcccaggccagcttctgctggtcattcagtgtcagctcaaatgccactttctcatagaggtcttctgtgaccccgctatctggaggagtccccgggatcaatcactgtctacccccgtaatggcattttactctcttcctagccctgtccacctaaatgatgttgtttgtttatcttttggcttgctgtctgtcttcatcaggaggatggatgtttcatttctgcatgcctagctcctagaatattgcctggtgtgtggcgggcatgttgaataaacaaagagcccccaaatgacataggaggccatgccatgtgccccagtccctgcagaggagcgaccatccaccagcagaccctgtgtctttgaaaggaattccagagagagtaaaaatcagtgcctatgaaaagtatcccaactggctgcaccattgcctagcttttgtgctcagtgtttttggttttgttttttcgacatcattggcttttaaagccaggtcaacctttggacttgaaccctcaggttttgcatctcccgctgcactgctgggcagtcgacccttcccaaaccaccagttctagctgagacacacacgaggttctggatttttgctccaccagcaggtgatcctcttcatcttccattgcaggcatctttttctttaattataaaaataacaccatactccactctcaaggaagcactcataactccctaccctataagtgtgggctgtgtatagtgacttccttccaaagaggaagtgaaaggagaaactttacaatggagaaacctggcagacactccctcagccaggggctcaaggtcagcatcaacagtgccaactcatcttgatgggatgtaccacggatgtgaagtgatgagaatggtggccgggcaccatggctcacacctgtattcccagcactttgggaggctgaggcgggtggattacctgaggtcaggggtttgagaccagcttcaccaacatggcgaaaccttgtctctactaaaaatacaaaaactagccaggcatggtggcacacacctgtagtcccagctactcgggaggctaaggcaggagaatcgcttgaacccaggaggcggaggttgcagtgagctgagatcatgccactgcactccagcctgagtgacaatatgagattccatctcaaaaaaaaagaaaaaaaagaagaaagtgatgagaatggtgacttacctctgcagtcttctctccaaactcacaacttgtctcaccatcagaaaaactcaaaattaaagggtattccactacaaaatacctgtgcagtaccccttaaaactgtcaagggcaggctgggctcatgcctgtaatcccagcactttgggaggctgaggtgggcagatcacctgagttcaggagttcaagaccagcctgaccaacatggagaaaccccgtctccactaaaaatacaaaattagccaggcgtggtggtgcatgcctgtactgccccctactcgggaggctgaggcaggagaatcgcttgaacccaggaggcggaggttgcagtgagctgagatcatgctactgcacctgagaaactgtcacagtgtagaagagtctaagaagacacaaggactgaatgtcatgcactgtcctcgatgggatcctggaatggaaaaagaacattggcggaaaaacaaggaaatctgaacagagtatgcattttaatctttttttaaatcccctaaggatttccagtactgatgctttgcctttgtgcttgagatccctgtttagagccacatctcccttctggtgtggattttcagtccgacatgaatgcttccagatttgcttccttccttcttctgccatgatctgactctccctctgacttcacattgaactggacccgttcacgcctgcacacatcctgtttttcccctggctgctcttccctgcgtcccccctccgcagaccaccctcattcagatgaggatatatcccaccctatttcttgggcttacctttctgaatgaaaataatgttcctggtgcaatttatctctcctgtcaaatttccagcctgcagggaattaaatgaggcacatgattttcaggctaagcagtttttaaaaactgaaatattactttagacaggcccaatttattttcctctggattctcatcattttaaccccgccaagcacatggttttaagcagctccatctgctcctctaaccatccttgcgtgacctgggcccttgactgacttctgaattggtttgtaaattggaagaattagggagtcggttaagatgcatgaatcatagctcaggatagatttataattgtctgttttcatgaactcattctgagattgcagggatgggggatatttcagaacaaatggaccttgagtaacagaatgaacctacagaagtgccgaaaaagatttgttgtttatgcaattttaaccgggcaattgttgttattataggtttatcaatttccacaattttaattccacagccctaatgatttgctttgaattaggaagtatatactttattctctcatatggtcccaaagggccttagaaagcaatcggagcccttctgcttgtcattggaagaaatatgacagcatggtttggtgattcattgaaggtcactttgaagtgttggggagaggacactgagtaatgtaaaatgacattacaatttgttaaataatttgccggaactcttgtgtcatctctttcaaagtctcaccctggaaataacacacacgtaattcaaatgcaatctttctggaagtcccacctgggaactgcagtcccaatctgtggcaaagtcttgtgaatatccttaatgtgataaaactttgccttagacggagtttgctttttggaataaccaaagtcattctgggccaaggtgtttgaataaagtggttgatcaaatgaaatttaatgtaaagttattttaactgcttttcttgagtaacgcataaactgatttgaaagcaacaaagaatttgtttattactacctctccttattccagaaaggacttaatgatcttattggagccttaaaaaagttttaaaaggctcaagaaatgttggtaaatttccttttttttatcttttttttttttttttttttttttgagaaggagtcttgctctgttgcccaggctggagtgcagtggctcgatctcagctcactgcaatctctgcctcccgggtttaagtgattcttgtgcctcagcctccagagtagctgggattacaggcatgcgccaccacccctggctaatttttgtatttttagtaaaggtggggtttcaccacgttggccaagctggtctcgaactcctgacctcaagtgatccgcctacctcggccttccaaagtgctgggattacaggtgtgagccatcacgcccggcctaatttacttttattattattattattattgttgttgtttgagacggagtttcgctctgttgcctgttgccaggctggagtgcagtggcgtgatctccacctcctgggttcaagcgattctcctgcctcagcctcccaagtagctgggactgtaggcgtgcaccaccatgcccagctaagttttttgttttttgttttttgagacagagtctcgctctgtcacccaggctggagtgcagtggcatgatcttggctcactacaagctccgcctcccgggttcacaccattctcctgcctcagcctcccaagtagctgggactacaggcatctgccaccacgcctggctaattttttgtattttttagtagaggtggggtttcaccatgttagccaggatggtttcaatctcctgacctcgtgatctgcccacctcggcctcccgaagtgctgggattacaggcgtgagccaccgcgcctggcctacttttattatcttaatatcactcttctcatttctcttctctaagcctaatattagtatttgtggacattgcaggtgggacacaagacctttggtgcttctcatcttccaagagggcacagaatgggatggtgtatgaggtgggatattcccagccaagggagttctgggagggaggtgaagttggggcaaagaattcccatgggctaatgtcctctgtgcttccccaaccctagttccagctgatgtggaattctgagtttggctgctttttcttttgttgatggtggtgatggtggtggtggcaatgatgatgatagtgatgttgatggtggtggtggtggtgatagtggtgatggtgatgatgaaaggggtggtaatgatggtggtgatggtgatgatgacagtgatcgtgatgatggtgatggtgatggtggggatagtaatgatggtgataatggtgatagtgataatggtgacgatgacagtgatgtgctagtgatggtgataatgacagtgatggtggtgatagtgatagtggtgatggtgatggtaaagataatggtgatagtggtgatgattatgatagtgatagtgattatggtgaggatagagacagtgattgtgataactgacattcaccaagtcctcactgtccttatgatgtaccaggcaccacattaagagccttatatacgatctgtcattcaatcctcactgcatccaagggtaccctctattattatccccagttaacaggtaatgaagactgaggattgggaaagttacataactcacttaccagccacacaactagctattatgaaatgaacaaatattacaagctaaggattaatagacccactttacaagggaaatttttttttttttttgagacagtcttgctctgtcacccagcctggagtgcagtggtgcgatcttggctcactacaagctccgcctcccgggttcacgccattctcctgcctcagcctcccgagtagctgggactacaggcgcccgccaccacgcccggctaattttttttatttttagtagagacggggtttcaccatgttagccaggatggtcttgatctcctgacctcgtgatctgcccgcctcggcctcccaaagtgctgggattacaggcatgagccactgtgccaggcccacaagggaaattttttaaagtggaaactcagagaatttaaataacttgtccaggggcacaaagccaggcaggggcagagccaggcaggggcagagccagcctttcaccattcaccattgctggctttgaacatgaagcaaggggccataagccaaggaatgtaggtggccaaggaatgtagaagctagaaaaggcaaggaaactcattcttccttagagccccaagaaggacaggcaatcctgctgacactgttaccaaaacaccaggggattcgtctaggtcctgctgctcactgcacagaaggccgacactgagacaacaattattgctaaggaaggaggctttactcaggtgttgcagccaaggagccagtaactcagtctcacatccatctccctgaccaactaaaatcaagggtttatacagcagggaagagatgtaacaatgtgtaacaaaacaggaacttgggacgggcaaggaagcaatcccgatgaatgaggggtctggcatctcattgtctggatgctgtaatctggtgagtttcagttctttgatacttatttgagaggcaaggaattccctcctgaggaaggaactcagataaaacaaactttaagtttcaagagttaagaccagaaaggtcaatttctatgtttatcaagaaagaaaaaaactgtctatgggactacttgtgttggtttcaacaccctgattttcacgtccgttgggcctctgtcctccagaactataataaatgtgtgttgttttaagccactaagtttgtgtttatttgtaactgagacacagattggcatttttttccactgtcacccctcttgccttgtatcatcagttgttagtatttgttttagctggggaggcagctggagcatgaagtcaacaggaacaatgatgatctgcagggaggaaagccctaggatggcgggataatccccattgtgccccctcatcattagccacagtacttggctggcatttgagcagagtggttatcacagcagcgttcactctcctgcccccgggttcctgttcttccctctcttcaagagcactcaatgcatatctctccaaaccagtgcttctccacctttaatgtgagtgataatagctaacattcagcacactgtgctcaatgtgtgaatcccctcacttaacctccataccaacccttgagatagatgttatcattatccttcccatttcaggaaactgaggcatagagtgtttaatgaagaatcacctgcttgaagggcagcttgctgggtctcctccagggagattttgattcagtaggtccaggagaagcccaggtagatggattttttttttttaatcacacctaggtaagtctcatacctgtgccctgggagcacaataaaaaaactctgggtttaggctgtgtgcagtggctcatgcttgtaatcccatcagcttgggggtctgagatgggaggatcgcttgaggccggtttaagatcagcctgggtgacatggtgagactccgtctctacaaaattaaaaggacgtgatggtgcacacctgtagtcccacctattcaggaggctgaagtgggaggattgcttgagcccagaagcttgaggatgcagtgaggtatgatcacaccactgaactccagacttggtaatagagtgagaccttgtttcagataaaaagaggaaaggaaagaaaggaaaaaagaaaggaaaggggcaaaaggaaatgggaagggaagggaagggagaaaggaaggaaggaaaaaagaaagagaaaggaagaaagaggaaggaaggaagggaagatggaactaaggaaggaagaaaggaggaaagaaagaaaaaggaaggaaaagagagaaaggaaagaaggagaaagactctgagtctaaacccgtggttttcaacaaagggtgattttgtcccccaggggatacttgccagtgtctgaggacattttgggttggggagaggatgctactggcagccagtgggcagaggccagggatgctgctgcacagcctacagtgtttagcacagcccccagcacaaagaagcgtccaactccaaatgtcaaagcactcacaggctatggagcagcagtgagatgaagctcttgctctagccttggctcctgcactcagaatgagtcttcagatgttctcagattacacttccagaggattaggctggaatttgtctttcttgtgaaagaaactctttgtctcaagtgttgggtcctcccaggattcctccccaaatgggctatcttagtttctcctctactcctcaatctcacctcttcaccttcatccttatttcctatttcactgcaaaagtcaagggcccagcctggccaacatggtgaaactctgtctctaccaaaaatacaaaagttagtcaggcgaagtggcaggcacctgtaatcccagctacttgggaggctgaggcaggagaatcacttgaacccgggaggtggaggttgcagtgagccgagatcacaccactgcactccagcctgggagacagaatgagactccatctaaaaaaataaaaataaaaaacaaaaaaaaaaagtcaacggcatcaaatgctctcctctgctccctttgtcatttctttgtacttggacctcttagatcttggacttctatgaggtcacagaggaagagcatgtttccagaaagaaattcctacaatcagccagttctgcataatcttgtggttcacgagaggggaaggaccacagcttctccttgagtccacctgggaagggcatctgtggacaccttctctctgcctccctttccttcctcccagttccttcctagagggatggtgtttgatttctgaggccctggacatttcttccagctcatcattcaggttgttcagagcatttggaagacgagcttttctcttgccaacactgaccgcctcttgcgggaagatgtcgcagcattattatttaataacccgtgtctttcttcagctcatcaaagaccttccagctccagataaggagtcggggtagggagtaaggaaacaaagggatgagggtacaggaaaatcccagctgccccttatcacacaatcaatatattcaatcaatatagttaatagcaatgtgccaatgtcagtttcttggtaaagttaacaaatagtggaaattgagtgaggggggtagaggggaattctgttggctctttgcaacttatcactgcccatctccagttttctggtgcctttgctcagatgctgctgtggagtcccctccacagagatacctgtgtccttctccccaccttcctggctcccaacagactacactgcctgagagagctgaagtcaggcattcattctgcaggggattctgggtcacagctgagccagtcctattaggatttagggggcagccgacctgtggggcctgcaccgcacacactccttctaagggtttcctcacagtccctgctgaaggggagggtctcgtgtgacctgtggctccacccaggttgaacgtgctgaggccctgaccaaaggcagggccacccataggctgccaggggctggaggtgggacgagagggtccatcagaagtcctttcatgagagcagttaagagggaagcagaagagtcctgaaatggagaaacacctcagggagacagaatctttgaggaaggggaaggtatcagggagaaaagaaagaaggagatgaatggagggtcccaggatggtgaacaatgacttgggacttgggagcacttgaaatgtggccattccaaattgagatctgttcttcctttatttagttttgagacggagtctcactctgtcacccaaactgtagtgcagtggcgcagtctcggctcactgcaacctccatcccccaggttcacgtgatccttgtgcctcagcctcccaagtagctgggatgacaggcacgtgccaccagacgtggctattttctgtatttttagtagagatggggtttcaccatgttgtccaggctggtgtcgatctcctgacctcaagtgatccacctgcctcggcctcccaaagtgctgggattacaggcgtgagccaccgtgcctggcctgaattgagatctatttaaagggtaaaatatacatactggacttaagacttccatactccctccaaaaaggatataaaacatctcattcgtatctttaatatattgattacattttgaactgataatcctttagatctattggattaaataaaatatgttagtgaaattaatctcgcccatttctttttatctttttttttatttttaagagacagggtctcgttgctatgttgcctaggttggacttaaactcctgggctcaagtgatccccctgcctcagcctccagagtagctgagactacaggcatgtgcctccgcacccagctctttttacttttttttttttttttttttttttgagatggagtccgttctgtcacccaggctggagtgcagtgactcgatcttggctcactgcaacctccgcctcccaggttcaagcgattctcctgcctcaaccttctgagtagctacgattatagtcacctgccaccatgcccagttaattttttttgtttgttgttcttgttgttcttgttgagacagagtctccctctgttgcccaggctggagtgcagtggcacgatctcggctcactgcaacctccgcctccccagttcaagcaattctcctgcctcagcgtcctgaatagctgggattacaggcacacaccaccacacctggctaatttttgtatttttaggaagacgggctttcgccatgttggccaggctggtcttgaactcctgacctcaggtgatccaccgcctcggactcccaaaatgctaggattacaggcgtgagtgagccaccgtgctctgccacggctaatttttatatttttagtagagatggggtttcaccatgttggccaggctggtcttgagctcctgaccttaagtgatatgcccaccacccttggcctctcaaagtgctgggattacaggcatgtgcctccacacccagccttttttattttttagaatgtggttcctggaatgttcaaaattacatatgtggctagtgttctatttcaattggaccgcactgatctatacattctctcttttatgacccccgatttacagataaggaaactgagtctcaaagaggttagggcatttgccgaggtcggccgttagaaagatgccggaccatctactcatgtctgcttgacgccaatgcctgcgtcttcacgtgctgttggtgcgtcctcctgaattacttttgtgtcctttgacacgtcagatgtggctggggaaacagaaactcgcagaagttaaaaaaatgtgcttgaggtgccactggagaataacaatcatagccaggatgtgaagcctgtcagtttcctcagccgcaaattcttccatgtggggcgacctcacagagacgggatgtatgggacggcggagtgcaaagaaaggtatgatcgctcttgggggcccagtggcatcctctccacgaggcaggctgggagaaatcgagcagccaggagcttctgggttaaaagcagtgacttcatctctttgggaaacggtgactcattaaaagcaacgggcggcttcccattacattcacgttatagcaagaaggcgaggcacttggtgcatcccgtaataggatgcttgggggttggaatgagcttctttcctacatgaatgattgatgacaacgaagtctagagtgccaccaggagcctttgaaatgcattcagatattggctccctggtcatggggcgcagatctattcccttgggattcaagactctcttttgggtcaatagcagcaactggcttcttgacaaaaggctggagggggccccctctagattctcttctcagggcaggcatgggtctgttggagctgcggggctgtggtctcacctagaggggccaagagatggtccccatgaccatgagtctgtgttcttcaaatttgatggtggctccaattttattttctccccagtgttagtctggcttctttcagggaaaggcactgtgatggcaggaataatgctactgaccactctttgtgatgtctaggcactacaccaagcacatgttgtatacagttggtcctctgtatctgtgggttccgcatccttagattcaaccaattatggatggaaaatattcaggaaaaaaatccacaaattaccaagaagcaaaactttgagtattatgctgaatctgtgtaaatgaagtgatgtgtaggcatcctattagggattataagtaatctagagatgacttaaagtctacaggaggatgtgtggggcttctatgcaaatatttcaccctgttatatccgggtcttgaacatccaaggatttttttttttttgagacggagtctcgctctgttgcccaggctggagtgcagtggcgcgatctcggctcactgcaaactccgcctcccgggttcacgccattcttctgcctcagcctcctgagtagctgggactacaggcgcctgccaccacgcccggctattttttttttttttttttgtatttgtatttgtagtagagacggcgtttcaccgtgttatccaggatggtctcgatctcctgacctcgtgatccatccacctcggcctcccaaagtgctgggattacaggcatgagccaccgcgcccggccaacatccaaggattttggtgtccaaagggaggcctggaaccaatcccacacggatactgagggacaagtatatcatcccatttcatccctacagcagcaacttcatgaggcaggagttattagtcccattttacagaagaggaaactgagacttagggagatcaagtaatttgcccaggtcgcacaattagtgatagagccagggcttgaagcgacgtctgtcttaagccaatgacccctgcagattattagagcaactgttctccacaacagtgtaagcctcttgctagaagctcaggtccacaagggcagagatttttgtctgttttgctcattgctccttccccattgcttagagcagggtctgccacgaagcaggttctcaatgcatagttattaaatgtatataagagcaaacatatgttacagagaactttctgtatgcttgtcacttacatgaatcacctgtgagatgggtatgcttgttccccaatgttgcagatgaagaaactgaggtgcccagagtcactgatgcatggctcaagcgtgagagctggactctgaaacccaaaagcccatgcccagaaccactcccctctcttgccctcttcaagggctggcctggctccccatggtgcctgcacacgccaaccccttttcttttctctcttcttaattttaaatctattttgcaaatgtaacatctgaccattggtaaattgctaaaatttcaatgaatatagttaataacaatgcaccaatgtcaacttcttggtaatgttaacaatagtggaaatttaatgaggagtagaggggaattctttatgctctttgcaactcttcttaaattttttttttttttttattaaagatagtgtctcactctgtcacctaggctggagtgcagtggcaccatcatagatcactgaagccctcaaactcctggacccaagcgatcctcccacctcagcctcccaagtagctgggaccacagctgtgtgccaccacatctggctaatgtttacattttatttttgtagagatggggtcttgctctgttgcccaggctggtcttaaactcatggcttcaagtgatcctcttccctcagccttccaaagctccgggattacagacatgagccaccacatccagccacattttctagaaatataaaagtattaaaaaaaaaaagtatatttaaaaacccaaacaagagaaaaggacatattaggtgaaagttgattctcccccaacactgactccccctacctgagtccctcatgtccttccctaaatgcagcggctgtgacccaagtatattccaatgactgaaatgaatagcacccccacccccagcccttcatttaattgcctttgttatatgagctgggttgaaataatcgctcaaaatggctgattcctctttgagtaggacttaacccatggctgagaattgtccttctagcttgagttctcactgaagtttgaatgagaaccgtttgttgagggaccctgggaaccacatcttgccaagtcattttacatcctatccaacacaggtatgaggctgaccaaaacgtcgtttaagacctttccaacgcaaaggactggaattctattctacaacaggggatgggataggtacccccagtggtactttcatgcttgtaccatcaaacagcaatgaatttcccttcaggaaagctacgcattttctccccaattatcaacctttttgattacctaaaggagaaagccacaatttggtgctagctttgtctttaatgcccctagtacttgctgattcaccttgttaagaaagaaaattcaagcttcattctgaaccttaagcaggctatagtatttagcaagaatttaacagtattgctttgtttcctcaggtttattttcatggctattttctaattatgccaagtaagagtcatttattgtctgtggatgtcatgggacatttccgttagggagtttgagtaaaaaaagtcaatgtcggccaagcgcagtggctcacgcctgtaatcccagcactttgggaggccgaggtgggtgggtcatgaggtcaggagatcgagaccatcctggctaacatggtgaaacccgtctctactaaaagtacaaaaaattaggctggtgtggtggtgggcgcctgtagtcccagctacttgggaggctgaggcaggagaatggcgtgaattcaggaggcagagcttgcagtgagccaagatcacgccactgcactccagcctgggtgacagagcgagacgccgtttcaaaaaaaaaaaaaaaaaagtgaatgtcatgacatactgagtggtatatgacagagtacagaatatgtagctggggtaaattctatgcagtgttgagagttttggaaacactgttttgtagctcttttgaccttagagcatgggcattgggatcagatagatctgggtttgagtttcatttctaccactcattatagcactgccccaattgccccttagaactgatgtttacggtgttttgttttgtttgaataaacacaaaaatttaccttcctaatcttttgtttttcttttttcttttatttttgagacggagtcttgctctgtcacccaggctggagtgccgcggtgcgatctctgctcactacaagctccgcctcccaggttcacaccattctcctgcctcagcctcccaagtagctgggactacaggtgcccgccaccacgcccggctaattttttgtatttttagtagagacagggtttcaccgtgttagccaagatggtctctatctgaccttgtgatccacctgcctcagcctcccaaagtgctgggattacaggcgtgagccactgtgcccagccccctcctaatcttaaaattttagaaagttacattcattttacctgagttcctttctcaagaaactgacctctcggccttccagatagtattaaggaattgaaatttaccagatcactatatgtggacaatgagatgccagactcctcaaccatcacgattgcctaaccaaccacctgcatcctgttgaccagattctcttccttaccccttcctaataatttcccagaaaaaaaaaaaaagaatagggatgtatcacaatgtaacacatggttgcgtttcttccttgctacctctaattttagtgggttgaggagatggatttgagtctctttccatctcctcagctgcagcacccaattaaagccttctctggcaatactcattgcctcagtgattggctttctgtgcagcgagtagcaggatctagacagaacccttgatgttgctgcaacaattgagtgagtgagtttgaccaatcacttatgacctctctaagcctcattttattaatctagaaagagaggttgatatgagctagatcatggctccggtaaacacccaaaatgagcaagctctggggccagtactaggcacgtaaagttataaagcagaagtaaaggcagaggttgtgcagggcaccctgagcttaaattcctaccatgacccctgattggaaaagatgggctaggaaaggtatctctctggtccccagcagtttaaccctccaagcttgtatttaaactagaagtttttagatcaccagccctcatcctctatcacctccaccactcctgtccctgggtagccttactttttgttttgttttgagatcagtgattaaacctgctggtgcataccagggctgcccgggtgctcagctcttgtttgctggtgccaccgctcaggaagcatgcatctccctggggtggcatttggggatgggaagatggatttagctgcctcttcccccagaagtgactcagctcctggaagctcaatgacagcagtggcagttggagccctggggacgtctgtgccttcatgctttgctgtctccacacagcaagcaagctcttgcttggaagtgtgcgtgagagacttgttgtctctagccagcttgaaatgctcctcccgtttcttcccgtgatttgtcctcctcgtggagacattccttggcagctgtcggatgcctgccttctagttggaaaatgtgatcaagaaaggaacagtctagcaggctaatttctatcacacaagttcagactggaaagaagctgactgtgtgtgatattcatttattcaggtcctgtatcagcatttttcactctgatctgaagacctccttcattaaggtccctggacacaacaccccaacccaggtttatcctaatccttggaggtggaggcagggaattgtttcttaaacaacctccctagatattcaccttgcccactgatgtctgggaataactactccctctgtgtctaaagcaatacagtctactcagttttgttatgatgatgatggtacttacgtagggaggtagttcttacatgaatatggttgattacaacaagagctttggagtaagagagatcttgttttaaatctcacctccatcacttactccctttcctgagcctcgacttccccatctatgaaatgggataacagcactgaccacccagggctgttttgagaatcagataaggtaatgcacaggtgctggcatgtgataaatgctcgataaatgttagttattatcgttactgggtaaacctggctttcctaacttttaaactggagagattacagtataccacccagggaaggggttggccaactttttctataaagagccaggtagtgaatatttgaggcttcgtgggccagggagtctctgtggcaactactcagtttttgcaatgcaaaagcagccataaatgacatgtaaatgaatgagcgtgatcagtgtccagaacaactctacttacaacatcaagcatggggctgcgcttggtcccctggccatagggtatcaacccctggcctaaggtattgtgcagactaaatgagatgagattcattcctgtaatcccagcgctttgggaggctgagatgggcagatcacttgagctcaggagttgggagaccagcctgggcaacatggcaaaaccccatctctacaaatagtacaaaaaaagtcactgggtgtggtggagtgaacctgtaatttcagctactcgggaggctgaagtgagaggattgcttgagcccgggaggttgaggctgcagtgagccaagatcatgccactgcaatccagcctggaagacagagcgagaccctgccccaccaaaaaaaaaaaaaaaaaaaaaagatgaggtttacaatgagcccaacacagtgcctgatgcagagacagctcatggcaagaaaggattctaacgatttgtatctgattcaagctttaggcttcgttcctttctcttggggaagaaaaacatccttgagcaagacttttcaacataggtctttgttccattctttgccccaaatccaagctaagcacctggagcctggcaccaccgcctccatcctcccccggggatggaggtaaaatgccagttcctgggatgtgattaattctcttcgtcccacgcctcgccccagggtgtgttgccgttttcagcatctgtcccatggaaatcaggttgcccatctgaactgtgatgagaaaaacaaggatactcatatcgtggggtggttaactacgcactttcgcaggcacaaatgcattcagccctcaccaggaggctggattacgtggttaaggtcacgtggttgtggagtggaaggggggtggggggggagagagagagcacaagctgggtttgaatactatctctgcaatgatctggctgtgtgatgttgaacaagtcactttccttctctaagcctcagagtcatctcagtaaaatagagattaaatgagataatacacagaaagcctccagcacaggtaactattgaattcttgtacagaggaggaaagtgacgcaaagacataaagggactcattcgaggtcttgcggctgatgactagtgtcaaatgaggatttctgacactgcccccgcctagctgttttttgccagaccccacttcccccatgcacttccctcaccccctggtgactcccgctgggacccctgctgcttccagccaaggctgtgctctgtgtgcaggatctcaagcccctggagagagtgacattgttgtcaggaagcttgcaaggctgtggccattcattcttgtgggtttgtggcctcctgaagttcatgtgcatcttaaaacatcagaatgtgaccttatttggaaataaggtctttgcaggggtaattcagatcaggatccagatgagctcacattggattagggtgggccctaaatctaatgagacagaaaagaagacacacagagccacccggaggaagaacctgtgaaaacagaggcagaggttgaagtgatgctattacatccagtggcaaaaaccgtaattacttttgcaccaacctaatactacaaaccaaggagccagcaggggctgcaagggccaagaaaagatccatccctagagcctctggagagcgcgtgaccctgccaacaccttggtttccgacttctggcttcccgaactccaagagattaaattccttttgttttaagcctccccactggccatgaattgttatggcaccacgcttgactctgagataggaatgaatggggggtgtcggacttagaacagctgcctggaccagaggcagctgtgagggtcaaaaagcatgaatttgaagccagacctggactcagctctttcccttgccagcgctgagcctttgtttctttgcgaaaatgagaacctactgaacttgctggcttatggcgaggattaaaagaggtgatgggcagagcaggtgcggcggtcataacgagggcaattgcaagcatatattaaacgtgacgtgccggggtaattcatccctcacatctgttttgggtggtgggctcccttacagaggagaaacagagctgctgagaggttaaccaactccccaaggccacacagccagggaggggcagaactggaactcaaacccaggccatctgatctggtaaggctggtcttctagcttggtagcatcacagcacacagtagcactcagtattaattatctttttttttttagacgtagtctcactctgtccctcaggctgtagtgtagtggtatgatctcggctcactgcagcctctgcctcccaggttcatgtggttctcgtgcctcagtctcccaagcagctgggattacaggcacctgccagcatgccaggctaagttttgtatttttagtagagactggatttcaccgtgttggtcacactggtctcgaactcctgacctcaggtgatccgcccgcttcggcctctcaaagtgctgggattacaggcgtgagccaccgtgcccagccaatattaatatttcgatcctattcctccctccttccctcctttctcaagcctgtcctcactgcttcaatcccaggagccaccacagcatggtgtcagggacagtagtaggacccgaaattggattccaggggccttgaagcataaccagatggccccaggagatctttaggcagcacatcacatgagacatttcctacaaatcctctgcaaacagacatcgctccctctccccaagccacagcctgaggtggctcctctgacctctctccttcctgcttctctttgacactccctcctctccctccactgtgtctcccttttcacccttccctggcagaggctcggccaggtggccagataatcttcgggacccgccatctttagaaggcaaggaggaggtgattgtgaatctctccaatttcatgtttttcccattcacccacctccactctcttcctcccacttatacagttgttcagtgaccccctctccaacccaatagcagattctgcactatttatgttctgcacttatctatttcatgaagtattgttgctccctgaaaatataaaagaagcacacattgctctgagatgctgaactcaaagaggagaaaatcttcaataggctgatgactgacaggtcaaatattttcctctccccatataattgcttggccttttccattgcctttgttactgtttctcttgaaaactgggagttgtcaggccaggcacggtggctcgcgcctgtaatcccagcactttgggaagccaaggctggcagattacctgaggtcaggagttcaaaaccagcctggccaaaatggcgaaaccctgtctctactaaaaatacaaaaaattagccaggcgtggtgacatgcgcctgtagatccacatacttgggaggctgaggcaggagaattgctggagcctgggaggcagaggttgcaatgagcagagattgcatcaccacgctccagcctgggcaacagagcaagacttgctctcaaaaaaaaaaaaaaaaaaaaaaaaaagggggaattgtctcagagagaatgaagagaggccattcatttcaatgtgagaatcaactccagagaattaccttctttctgtctctttagcaaaataaggtgttttgattggtggaggggaagcagataattttggcacatggaacggacacatcacggggtaggtaatggaaaggaactccaatttactgagaatccaacgtctgctgaacaactcagggccgggagagtcccacaggtggacaaatgcatcaggtggactcctagaagagggcgctgttctatctagagatccaagcaggtagggactgacttcagggaagcctgcaaatcacagcgccctaaaccctgtgcacgtgtgcaagggccagggccccaggacatagaaggcagttggacaggtagaaacaggacaactttctctgggcacagtgactcacacctgtaagtaatcccagcattttgggaggctgaggcaggaggattgcttgaggccagaagttccagaccagtctgggccacatagcgagacctcatctctacaaaaagaaaaaagaagacctggtgtggtggctcacacctgtaatcccagcattatgggaggccaaggcaggctgatcacttgaggtcaggagttcaagaccagcctggccaacatggtgaaaccccaactctactaaaaatacaaaaattagctgggcatggtggcacgagcctgtaacccaagctactcaggaggctgaggcaggagaactgcttgaatccgggaggcggaggttgcagtgagccgatattgtgccactgcactccagcctgggcaacagagggatactccgtctcaaaaaaaaaaaagagaaaaaggaaaaagagaacaactttccaaatcatgggtataaggtataccaactttcattattccttgagtataaggaaaaagacagacgcccttgtagaactgaggtgtggggtgggctccatcttgggggcgggtgtggaaggaattagcagatacagatgatgtgatggtgtctcagggtacgccaaaaacatctcctgccccgagtctcccccactaccgatcaaaggccttgaatagcacatcacttatatctcagccattcaccctagaaacatagcccgaaggaaccctgtagatgtgtgcgaagttttcactttgagaacgttcttcactggaacattcttacggtgaaaataattcttacatttttttcctcatgattacagtggggaaaaaataggaaacaacctacatgtctgtggattgcttaagtgcttcgtgatacagccacaaatagaaaaccgccccgccttccatgctgctgccgaggaagaccatccaaggacaggcaggagcgctcaaggcatgttgctaggtgaaaagaacacataacgaaatagtgaggtcctaactttatattagaaaaataagacctacatcacagtggatatatgtatatgcatataatagtataaatatacattcacacgcatatatattaacattttaactgctaacattttagtggactttttcagtctttataaagtgtgtctgcccaggcgcggtggctcatgcctataatcctagcactttgggaggctgaggcgggtgggtcatgaggtcaggagttcaagatcagcctggccaacatggtgaaaccccatctcaacgaaaaatacaaaaattagccgggtgtcgtggcataaacttgttatcccagctacttgggagactgacgcaggagaatcactcgaacccgggaggtgaaggttgcattgagccaagatcgtgccactgcactccagcctgggcaacagggcgagactccgtctcaaaaaagaaaaaaaagtgtgtctgtgtatattacacatattatatatataaaaaaccacatatattcatatatgtatatacacacacatatttatatatccgtatgtatgctcacgcttgtaatcccagcacttcaggaggccaagttgggaggatcgcctgaggccaggagtttgagaccaaccttggcaacatagtgacacccccatctctacaaaaaaataaaaattaaaaagttacctaggtgggcctgtagttccagctacttgggagactgaggcggaagggtcccttgagcccagggttcgaggcggcagtgagctatgattgcaccactgcaccccagcttggatgacagagtgaggcctagtctccaaaacaaatgaaaaaatacttaacactacttggtagtagtattactataagataattatgataaaactttcttctgcctagagtcggctggtcttagaggcttagaccacagggcaaagtggtcgtggtcagggggagcagaggcttagaatctgggaccaggcaggagctgacaaggccttaatcaggcttttgtgagcccacttgtgagcctccactagccatcataacaaagttcccagccaggcgtggtggcctcacgactgtaatcccagcactttgggaggttgaggcgggcggatcacttgacgtcagcctggccaacatggtgaaaccccatcactactaaaaatacaaaaattagccgggcctggtggtgtgcacttgtaatcccagctacttataaggctgaggtgggagaatcgcctgaacctcagaggcagaggttgcagtgagctgagattgagatcacaccactgcattgcagcctgggcaacagagcaggactgtgtctcaaaaaacaaaaacaaggccgggtgcagtggctcacgcctgtaatcccagcactttgggaggccgaggcgggtagatcacaaggtcaggagatcgagaccatcctggctaacatggtaaaccccgtctctactaaaaaatatacaacaaattagccaggcgaggtgtcgggcacctgtagtcccagctactcgggaggctgaggcaggagaatggcgtgaacctgggagatggagcttgcagtgagccgagatcgcttcaccgcactccagcctgggcgacagagccagactccgtctaaaaacaaaacaaaacaaagcaaacgaagtaaattactttggaaaacacattttctggttcccaaagggtgtgctcacgaatacacatttgtggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgtgagtgttttggggatgtggccaaggaaagaagtgtgtggaggagagaggaaaacctaatatttgttgatcgtctactgtgtgccaggcactgagataaaggcattatgcacgtttttaaaagcctcatttgattctcaccaccacccagggaagtggatattgtcatctcctgttttaagcaagaccctgaagttggaattgaattcaggccaatctgactccaaaacctttgttctttctgtatcacccacggggaagaaagagggaagggaatgcagaggctgtaccctgtgctggtgtctttcacgagcgcacactctgctctcagataggcctgagttttttttaagcctgtcagcttgggcaggttacttggactctctgaatttcagttccctcatttctaaaatggggaaaaataacaagatggggtctctagcaacatcagagtcacatgggttgaacgttcattatctacagagcacagcattcctgaagagttgcaggtagtctttcaagacaaactctcatttaaaaagttgggctctgagtgtgtggtggtgcacacctgtggtcccagctactcaggaggctgaggtgggaggactgcttgagtcctggagttcaaggctgcagtgagctatgatcgcatcaccacactccatcttgggtgacagagagaggcactgtctctaaaaagcacaaattaaggccaggtgcagtggctcacacctgtaatcacagcactttgggaggctgaggcgggatgatcgcttgagcccaggagttcaagaccagacagggcaatgtagccagaccctgtctctacaaaaaataaaattagctgtgtgtggctgtgtgtgcctttgtcccagctactcaggaggatgaggtggggggatcggtttagcccaggggttcaagactgcagtgaactatgatcataccattgcactccaacctgggagacacagtgagagcctgtcgctaaaagaaaaaaattaaaaatacaaaaaatataaaaacatcaaattaaaatgaaaaagtttttttaaaaattgggcttttgccgacaaacagtgaaaggttacaagcaaaaccaaaccaaaccagaggttaagaggcaacctggctggaaaattccctgcgctgcctgtcagctcacccacccacccaccctccactggaagcagcaggaacatcaaatcttttaggcaggctaggcccctcccctattctttcactgatttttcacaacaccaagaggctgagtctgtgatcatcccattttgcagatgaggagactgaggcttgaagaaatgaaacagcctgcccaaggcctcccagctagtaaatggggagttagggttcagactcagctctttctgcttttaaaacacctcttctttataaatttttagttacttatttagataaagggtcttgctctgtcgtccagggtggaatgcagtgaggccgtcatagctcactgcagcctcgaactcctgaaagcccatactctcactgggacgttatatgaccttccctctcgccacataaaatgaactgcagtattcacagctgtcatttatccagccctttgcatgtgcaagaccgtgagctaaatgcttcccatgcataattccttttcacagacatctctgaggaaggttctagaacatttccacttcatggctaagaaatatcttcccttttgtctggaaataagctaaaatgatacgtgagcattcagaaacaatcctttcctccctgtgttttaaaaggaagacagagaggccaggtgtggtggctcacatctataatcctagcactttgagaggcggaggtaggtagatcacttgaggccaggagtttgagaccagcctggccaacagggcaaaaacccgtctctagtaaaaatacaaaaaatttagccacgtgtggtggcgtgcgcctataatcccagctacttgggaggctgaggcacaagaatcatttgaacctgggaggcggaggctacagcgagctgagattataccatttcactccagtctgggcaacagagagaaactatcccaaaataataataaaataaaaggaagacagagaacatgagtcttgcttttaagtaatcaagatcaagatccctttgtttaaaaaaaaaactacaaaaatacaaaaaatttaaaaatacaaatacaaattaaaaattttaaaaatatatatttatttttatttacctaatggtgctgctgcaggaacaatggttaccactgtgcacttactgacctttactgtgtgcgcgtgtgtgtggatatttgtgtggatgtgtgtggatgtgtgtggatgtggatgtgtggatgtgtgtgggggtgttcgtatgtgggtgtctggatgtgtgtgtatatgtgtattgtggatgtgtgtgtgtggatgtgtgtgggtgtgtggatgtgtgtgtgtggatctgtgtgtgtgtatgtgtgtgtgaggatgtgtgtgtgcatgtgtgggtgtgtgtgtggatgtgggtgtgtatgtgtgcgtgtggatgtgtgtgcatgtgtggatgtgtgtgtgggtgtggatgtgtgcgtgtgtggatgtgggtatggatgtatggatatgtgtgtgtgtatggatgtgcacatgcctgtcacttagcccaggcttaaggacaagaataactagcatttcttaagaggcagctctgcagtaagctcttgacttgtgatctcattgaatgtcctcatctagcccatgaatctgaccacttagggacaaatgtcaacagtagaccctaggataaatcaaattatctaaaggatacagaaggacctgagtgttgttaggacatagatcagggattctgtgacattttccaggggagggacccccttccaggcccccagatgtcttgctggaatggagtcctacagacagtattggatggtgatgacgctccccaaccaggctcagccttgtatggtgtgtagcttgcccagtggtgcacctgcctcatcaatctcagagatagacggtggacactaaggcaaccaggacaaaggacacagtatgctcagatctgcacaaagtcctcatccatcatcctcagccctccaggccaacaggctttgagccaaggccctgcttgaattcactttcttggctgttcctcagagatggtttttcccgaagctgtggggcttatcctgtgagtgtgtcctgttcttatctccattttggatgggaagtaatgggaggttacaaaatttgcctgatgctgcattagctaataagtagccaagctaggatgcagtctgactccagaatgtttattaagtgaatcagggaaggagggaagggagtgggagagaagggagggggagagggaggggagaggcggacaggggaagggagggaagggaggaaagaaaaggaggaaggaaggaagctttgagtataaactaccaagataattccttcaagtttataaactccatgagggcagagaccttatccaatttcctcacaacgtcttcccagcatttggaacaatgcctggcactgagtgtcatgaatatttgtcaaatgtgcaataaattattctttctcactccatccttaccccaacaatcctcttacacacacacacacacacacacacacacacacacgtgagacactcttggcacagagtaggagagaaaaaaatttcagaccctactgatcattttcaggctcaggcgaggaagctttaagtgacaggaatgtgacagccctgggctgaaagactcccggtggccgtagtgtaatagccgcggtgagatttgttttgtcacacctgctgcgaagtaatcaccttaatgcccatcagctgctgcagagaccatgtgagtcagcccctatttcatggttgagaatgtgtctcacttccaatgcttctcgcagcattaactcttttatttttatttcttgtgacagagtctcgctctgtcgcccaggctggagtgcagtggtgcgatctcggctcactgcaacctccgtctcctgggttcaagcgattcttgtgcctcggccttccaagtagctgagactacaggtgcccaccaccatgcccagctaatttttgtatttttagtagagacaaggtttcaccatgttggccaggctggtcttgaactcctggcctcaagtgatctgccctccttggcctccttgggattacaggtgtgagccactgcacccagcctgcattgactcttttaagcatgagtccgggggggactgcctgccccagccccaaagctctggcaccctcacatttagattatttcatgggcttcctttttctcagctgatttaacttgtcctttcccccaagatccacagcccctgcctgttcttcctcttttcctgccacgacagtgaggaagaagaggagggagatttccctactcccagggaatggtgagaactcgggagatgtgggatcagaggtcatcatcctggctctctgacgtccttggtctgtgaccttggacacatgagggagcacacagagttgctgtttcccgcgggcactgatatgccaccctgagtgctacgtcccctgcatgcattcaccccttaattttagcttcttgagtcctcgcaagaaccccaatagagtaagttctatctcttttattttatgaatgaggaaattgaggtcggagaggcaaagtgacttgttcgaggtcaccagctaggataaagtagtaccaggatttgaacccaaggtgtctgtctcgtgggggcagagcccttaaccttaagctgttctgttatctttattctcaatgccaggaccccttttctctttgccttactcttttacaacgcaaggacaaacccccgattagatgcccccagtcccacacttggtcttgtcttgttctgcaatgttgaattgtgtgtggtggaacttggacagattttactaagtcaggctttggacttttctgtaccattgaaactgacccaatagtcccatcatagatgttctttttttttttttttttttttgagacaagagtctcgatctgccacccaggctggagtgcagtggggcacgatctggactcactacaagctccacctcccgggttcacgccattctcctgcctcagcctcccgagtagctgggactacaggcgcccgccaccacgcctggctaacttttttttgtattttttagtagagacggggtttcaccgtgttagccaggatggtctcgatctcctgacctcgtgatcctcccgccttggcctcccaaagtgctgggattacaggcatgagccactgcacccggcccatagatactcttttggataaatacagaagttgacctttctgatcttaaagcttgaagccctcatttgtcttatctgagttatttcctcaggaagggacccccaggcctctcaaaaaatatcaaagaactgaaactcaccagattaccacatccagagatgagataccagacccctcattcatcatgattgcttccttgctcctcccgagttcctgttttcttcatgattgcttccttgctcctcccgagttcctgttttcttatacattgttacatttcttccctgctatgtaaactcctagttttagttggtcagggagatggatttgagactgagctcccatctccttggctgcagcacgcaattaaaatcttccttggcaatactcatcttgtcagtgatgggctttctatgcggcgagcagcaggacctagaccaaacccctggtgtttcagtatcaccatttctctgcacataaactgtttatttcagagaccaaaatgatgagctccaatgcagacagtcaaagtttgtgaagtcagtctgctgggaatgtgctgtagaaaaagaacccggttcccgtaataactcttaaggcccacaacagttggcatttacagaccccttattgtggacctaggcttgtgctaagccctttacacacatgctcacataacccacatcaaatgcttactaacagaaagatgcatcaggaaccaccccaacccaggacacccacttgccctgaatcaggcccaggaggtcaagttcacagaccagccataagtgagctcccagcaggcaggtgtgaactctgagtgtgctcctcactctgaatttccagtgtgtgttcccttgctgacttccctttgcttgacccctggtttccaatgtgcaaaatggcatttagagatctctttcttgaggcttggcaattttatcaactttactggaacagggcagtaacacaaaactgcctccggaaaacaggcagcaaacatctggcagataatgcttgaaacgcctgtgttttctcacttcttgaccctatgttccacccacctcctagtacctcccactgctaccccatctccctacccatcctgcccccatcttactgcaggcaagaactctcagaggctgtcaacaacctcagactcattttctcgccttccttccagcactgaatcacatcattagtttttaataattcttcttgcagcccctctggctcgcttcagcttttccacatctagtctaccaacccgctcctgctgtttatctgggtttcagataattaagtatctttggcctccacatggggcaggggtgtggttatcttccttttacacccgcttgctggattttcataaaaagggatagcatgccctgccactcagcttgctctgggcaaaagcaggttttaatcagccagagacagaactgcagcaggcagggaaggtaggcgtgcgaaggacatatttcaagagcacagcctttgagttccaatatttccagagcctgggcttgaaatccagtaacttcgttttattaagaggtaccaagtgtggtaaagaggacaggccctgggaacctggcagagattcaaaatggggtaatagtgcatgcattgtgttgaaaaccacacacacacacacacacacacggaaagtgtgtgcattgtagatagcagttcttttaaaacattttctatgctggctagttttctagtgttttattgttttgattcatataatcctcactatcaccatccaggcagaaaatatcacatagcctttattttatagatgaggaaactgaggcactgagaggtcaagtctcttgcccatggttgtacagtttccatgaaatagcattctaagtccagatgaaatgggaaaagttcccttgtccccctcgcagggtgtgtgatgtcggagtggctcgcttcttcagtgccccgctgctcaaacctctaggggaccatagagatgggccagttgtcgggatctgatcccacggcagtgtctaggggtggatgtttacaactcctgaagcttcagtgtgtgtgtgttacatggtgctcttttagttttgctatctataggcggcttgtgttaactagctcaattagaccctctacgttgtcccaaggacagagggctttctgtatcctgggttcttgccttggtgcaccagaagaatcggatcacacctggacttggagaatgagagcaaggttttattgagtggaggtagctctcagcagatgggggaagccagaaggggatggagtgggaaggtttccccctggagtcaggccgcccagcagcctgggcactcctccgactgcccaggccaaactccactttgttccgccagtagatggcctgccagcatctgtcatgtgctcttctgccagcgtgttcctcttgacgtcttcttgacatccagacgcttgtgtcttctttgccgatctgcagctcttgacgtccagcagcttgtgtgtcacctgctagggtcttggggtttttatagatacaggatgggggcatggcaggccagggtggtcttgggaaatgcaacatttgggcaggaaaacaaaaatgcctgtcctcacctaggactgtgggcacaggcgtgggggtggagcccttaccagggaccacaccctcctctacccagcacttcccttccttccttctgtagcatttaaagcgaccatgcccttcccttcctatcacctctcttgcatatcacagagtccatggtctcagtcatcaagctgtggggtctctcaactagctttgaattctacttcttaccaactgtgtggcctggagcaaatactttgtcctgtttcagcctcggcttccccatcagtacaagggggacagtgatatctccctgcagcatcatagcaagggatgaaaacagacacaggtatgaaattgggtggcccttcctaggtagtaagcaattcaaaattcccttctttcctttcattgttaacattgtgcttcgtgggagagtagggcatcagggctgcttatggttgtctccagagaattcccagaaaatattcctctccccaagagaagatgggattcactgtggtttccttgagatcctcttgggaggtgccaactctcttgagagtggctctcaaccattaagtgcaactctaccctggggccttgattttattatgatgattatttaagatttttttataaacctgcattttttcccctttaatgagctgataattctgaagtctgttaggaagagcttcaagccaagggcaaaatgaagcatgtgcgtttatgtaacttgacacatttcagccacattcaggagctctgcgtcactttagttgcacacagggttttaaatagcatcttccaggaacaggtcaccattgccggggccactgtacatatcggatgggaagagatgcccttaattgcagaagatctaagaagcagtttgtcttggacaaaatatacaagaagttggggtgtaggggagggaaaggaaggaagaagaaacggagagactaaagggaggagagaggagggagaatttctaagctagacttctgaatggaaggaccctcctcctgaatttctaaatgtactgggaggtggggaggaaggtgggaatctgtgttgattgaatggagaaatacatgttagtctgggcgcagtggctcatacctgtaatcccagcactttgggaggctgaggcaggtggatcacctgaaatcaggagttccagaccagcctggccaacatggcaaaaccccatctctactaaaaatacaaaaaaattagctaggcatggtggtgtgcacctgaaatcccagctactcgagaggcttgaggcacaagagttgctttaacctgggaggcagaggtttccatgagccaagattgtgccactgcattccagcctgggtgacagaatgagactctgtgtcaaagaaaataaataaatcaaataaatgttctgtacttgacaagctcttgctgctacgagttgcctttcatggtcagaacaagtttcgagaaggaaaatactctctagaagttccgtcttcctagaactgtattacattctgctcagaggaccacctctgaaccacctagactccattgggttgggagggagattaccatgtaagaccctggtgattatcaattttatgcatcaacttgagtgggccacagggttcccagatgtttggccaaagattcttcgatgtatgtgtctgcaagagcattggtggatgaaattaacatttgaattggtaaactgagtaaagcagactgccctccctaatgtagaggtgggtgggccccgtccaatcagttgaaggcctgactacaacagaaagggtgagtaggagggaactcctgctgcctgattgcttgggctgggacatgggtcttttccggcctttgaacgcaaactgaaacatcagctcttcttgggtcttgagcctgccagcctttggactggaacttaacaccgtcagctctcctgggtctccagctgccacctatagatcttgggacttcttggcctccaaaatcccatgagccaattccttatcataaatctttttccaggccaggtgcagtggttcacgcctgtaattccagcactttgggaggccaaggtgggcagatcatttgaggtcaggagttttgagaccagcctggccaatgtggtgaatccctgcctctactaaaaatacaaaaattagccggctgtggtggcgtgtgctttcagtcccagctactcggaaagtcgaggcaggagaatcgcttgaacttgggaggtggaggttgcagtgagccaagattatgccagtgcactccagcctgggcaacagagtgagatcccatctcagaaaaaaaaaaaagaaaaaagaaaagaataaagaaaaaacaaataaaataaatctcttcagtagtattggttctgtttctctggagaaccctgactgatagagccctttttattctcagaaattttcatttggatagtttatcaggttagcaaagacctagcaagttggataaaatgaaaatatagggaaattggccttatctctttggaaaacagttcattgttacctagtaaagatgaacaggtgattataacctgcagttttgctcctgggtctacccctggttagccagtagcttcatgtggctatttcagtttaaattaattaaaattaaatagcatgtaaaattcagtctctcggtagcctgagccatatttcaagcactcattagtaaataatggctagtggctaccctattggaaagcatacatttgtataggacatttctattgttgtagaacattctattcaccagcactgccctagagaaactacacatgagcatcaggaggcatgttccagaatgttcataactgcctcgtttgtggtctagctgtaccacagaatactatacagcagtgaaaaatgaatgagcaacaggtatgaacatgaaagcatctcaaaaacaagatgttgagcaacaggtttatataaagtgtataaaagtaaaaaatataggccgggcgtggtggctcacgcctctaatcccagcactttgggaggctgaggtgggtggatcacaagttcaggagattgagaccatcctggctaacacggcgaaaccccgtttctactaaaaatacaaaaattagctgggtgtggtggtgtatgcctgtagtcccagctagtcgggaggctgaggcaggagaatcgcttgaacccaggaggtggaggttgcagtgagctgagatcccgccactgcactccagcctgggcaacagagcgagactgcatctcaaaaaaaaaaaaaaaaaaaaactaaaaaatataattgttccgggcttcatatatgggtggtaaatgataaaaataaaaagcattaccacaagtttgtgatagtgcctacctctgagggaatgagaaaaatatgagggaatggggcacacggggccgtctaaaagtcacacacagatttttacttaagtaggatgttgggaaaataactgctttattattccataaaaataatataataataattctatgaagtatgaaataatagtaaataataataaaatataataaatcatattttattatattttattattattatagtatattttatataaattttactataaaaataaaacattttatgcacacttatatgtagtttgcacacacacttctattttttaaattgtggcaaaatatatataatatttactatctgaaaccatttctaagagtacagttctatgtcattaagaacattcatactgtgtgtaaccatcaccatccctccccagaatttttttcatcttcccaaactgaaactctgtaccattcaacactcactccccattttccctttcccctggctcctggtaaccagcattctgctttctgtctctgattttgatgactctacatacttcataaaacaggaatcaggccaggcgctgtggctcacgcctgtaatcccagcactttgggaggccaaggtgggtggatcgcctgagctcaggagttcgagaccaccctgggcaacatggtgaaactctgtctctactaaaataccaaaaattagccaggcgtggtggcgcacacctgtagtcccagctactcaggaggctgagggatgaaaatcacttgatacctggaggcagaggttgcagtgagctgaggttgtgccactgcactctagctcaggctacagagtgagaatccgtctcaaaaaataaaataaaaaaaaaagaagtggaatcacacggtatttttctttttggacacacatttctaaggggaaaatgctgagaaagacaggcaggggaaggtacagtatctgatatctccacttaaatgtctcaaagatacctgtaactcaatctgtccaagtcaaactcatgatccccccatctagtcccaatacccaccagccctagctcagcaaatggtcaagcatcaccatctatccatggaaatctcaaattccaaaattagacatcattcttgacccctcccaaccctccacctcatatattcagttcatcatcaactggtgtttgttttacctcctaaaataatgctcagctgtccatctttctccatctccatggccaccacccaggttcacatgcccatctctgtcctgcagccagagggattttctcaccatgtgaatctgattataactctcagatttaaacactgtcttagtccgttcctgttgctgtaacaaaattccttagactgggtaatttataaatagaaatttaattctcacagttctggagtctggctgggaagtccaagatgaagatgccagcagattccatacttagaagggctcattctctgcttccaagatggcgccttgcttctgtgatctccagagaggaagggcaccgtcttctcacaagcagaatggacagaagggcaaaaaggactgaacttgctctctcgagcacttttgttagtgcactgatcccacctcctaatggccctcaccccttaatactattgcattggaaattaagtttcaacatgaattttgaagagtcataaacatttacaccatagcaaacaccttccagaatttgttagcatgataaagcccatgagatcttgctggatctgctcacacctcttctccaacttcttttcttcatccattcctcacccccagctccctcccttacacacacacaccactcccttgggcctccttttagtctccacctccccaccccccgatacacacaccaggtcccctcctgccgtgggggcctttttgtttgtgatgttccctctgcctggatccctctcctcccacccccctctccttccctggtgctatgatctgaatgtttgtatcacccctaaatacatatgtcgacatctaattcccaatgtaataatatcaagaggtggggctttcaggaggtgattaggtcatgagggcagatcctcatggatgggattcgtgcccatgtaaaagaggcccagggtagcttgtttctccctttcactgtgtgaggacacagtgagaactcactatctatgaggaagaggtcctcaccagacactgaatctgctgacaccttgatcttggactttccagcctcttttaccatgaaaaataagtgtttgtttgtttgtttgtttgtttgtttgacggagtctagctctgtcgcccaggctggagtgcagtggtgcgatcttggctcactgcaagctctgcctcccaggttcacgccattctcctgcctcagcctcccgagtagctgggactacaggcgcccaccaccacgcccggctaacttttttgtatttattggtagagacagggtttcaccgtgttagccaggatggtcttgatctcctgacctcgtgatccgcctgcctcggcctcccaacgtgctgggattacaggcgtgagccaccgcgcccggcggtgtttgttgtttataagccacctaggctaagaaagggagaatggcagcccaaatggactaaggcacctgataaactctgtcccctcgaggactgagatctagggcatttctggagggacaccttcccagcacttccccagtccctgtcccattaccatccctgcaatcctttccttagaagccttttgtaaatttgtgttcattggtgtgagtgtatgttcaatatctgactctcctcctagatgctgacctccatgaggacagaggctgagctattttcactcccaaaaatgttgacggtacccagcacacagccaaactcagcgtaggcactctgagtgaagattgattgaatgaattaatgagggctcatcttcctgcttctcccacggtcacataatctcaagggttcccttccatgtggcaggtctgggtggtgagaactgcctggctctctgatggttagggtgaacagtgggtccattcataggaaggaacagagtgataatgcagctaagtgcgttattttcctgtggctactgtaacaaacagctgcaaatgtgttaaaacaacacacatttcttttatcttacagttctggaggctggaagtctgaaatcgatttcactgagctgaaatcaggtgttggcagagccgtgctttctggaggctctagaggagaagcctcttcctcattcattccagcttctagaaccgtactctttgcatttcttggcttgtgtttccctcctccatctccgaagccagcagcatggcatagtccagtccctctcgattgaggtcatcctgtcgcctttgctcttctgtgtcaaatccctctgtttttctcttaaatgtatgcctagcattccattattggaacactaagcatgtgggagttatttatatgctacttctcaaggctatcaccaggtctgatttctcaaattcaaaaaattgcaacctcaggcataaatgggtaggggcacttgtgatgacattgagggcccacctggataacccaggatgatctccccatctcaggaccccttaatttaatcacatctgcaaatttcctttttaaaaatatatatttttcagagacgaagtcttgctctgttgtccaggctggagtgcagtgacacggtcatagctcattgcttcctttaattcctgggctcaaacaatcttactgcctcagcctcccaagaagctgggaccacaggcacgtgccaccacacatagctaatttttgaattttgtagagatggtgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgtaagtttcctgaggccttccaagctatgtggaactgtgagtcaattaaacctcttttcttctttctttttttttttttttttttttgagacggagtctcgcactgtcactgggctggattgcagtggctcaatcttggctcactacaaccaccacctcccgggttcaagcaattattcgcctcagcctcccaagtaactgggattacaggcacccgctgccatgcccagctaatttttttttgtatttttagtagagacggggtttcactgtgttggccaggctggtctcaaactcctgacctcgtgatccgcccacctcagcctcccaaagtgttgggattacaggtgtgagccatcacgcccagccttaaacctcttttctttacaagttactccttctcgggtatttcttcatagcagcatgagaatggactaatacagttgggatctcatcaccttgcccaggctggtcttgaactcctaggttcaagtgatcctcccgcctaggcctcctaaagtcctaggattagaagcatgagccaccatgcctggcccaaaatcccttttgccgtgtaaggtaacagattcataggttcattaggacatggatatcttcagggaccattcttcagtctaccatattgagtgaccacagcaattcatataagggccaagcccagagcaggagccacagtgtggcagcaacaatgacagagacggccctggtgaggctggggaaaggggaagatgacacactacatggggcaccctcatagcttcatcctgtgccgggttctcatcatttttttgaaatctcccaaaaaagaagcttcttagaaagacagggcaatagataccagtaaattgcatgtaccgtggcctggcgattaagggtttttccattccctttgcttatttctggaaagctgctgatgtgagtggcagcagagattgagaagggcttgtccctatcacgtgatggtctgaattgaataggataatgcttggctgagcctccttcccacattttccttcaaataaaataccaaccctttcttgacagttctaggacaggatgcccaaagagaaatgggagggaataaaactgcaagtgacttagcagagctgccttggtgttttgggtctacacaaccagattcccgagcacccccttaaggcaatatcctgacttacatatttcatgttatgtaattggctgctattcattgagccatcagttacttagatcttgttgtctcctggaattccagtctactgtgtctgtcctcagtcccctaaactcctcggggatctcaagttatattagatcaatccaagacattcctggttgggttctgccaaacgtggtaggatccctgttttgtttttttgttttttttgtttttttttgagacaaagtctcactctgtcacctgggctggaatgcagtggcttgatcttggctcactgcaacctctgcctcctgggttcaagcgattctcctgcctcagcctccctagtagctgggattacaggcacccgccactgctcccagctaatttgtatttttagtagagaccgggtttcaccatattggccgggctggtcttgaactcctgacctcgtgattcgcctgcctcggcctcccaaagtgctgggattacaggcttgagccactatgcccggccttttttttttctttttctttttttttttttttttttgagacggagtctcgctctgtcgcccaggctggagtgcagtggcacgatctcggctcactgcaagctctgcctcccaggttcacgccattcgcctgcctcagcctcccaagtagctgggactataggcacctgccaccatgcccggctaattttttgtattttcagtagagacagggtttcactgtgttagccaggatggtctcaatctcctgacctcgtgatctgcccgcctcggcctcccaaagtgttgggattacaggcgtgagccaccgcgcctggccagatccctgttttttcattactagatatcctggtcttggatggggttgctttctgataaatagacctcgtgcctggtaagtgtgtttacttgctccggattaaattacacctagatttacattctacctctgccatttataggctgtgcaatcttgcacaaatatcttaccttctctgagcctcggtggcctcatctgttaaatagccatgcatccagtatctcgcagggtggtcatgaggagtaaaagagatcaagcatattaagtgctcagtccagtgcctgctaccacgtaagtgctcattaaatgttactttcctttaccaccaggaagaaattgagtttggaaatggatagatacaggcataagtgtagacactggtttctttgtttggaagaggagacacaagagaagggggagattagagggtggaatgatgatcttttccatgtcaaggttgttgaaacgacgagagaagtctcaaggggcacctaagatttgtctcaaaatatctgaaggatattacgtggaagaggaagttcgtttctttctttttttttttttttcctgagatagagtctattgtgttgcccaggctggagtgcagtggttcaatcttggttcactgcaacctctgcctcccaggttcaaacaatcctcctgcgtcagccttctgagtagctgggaccaagtagcagcctcaggtgtaggggggcttgagcctctcctcactcctctctgattggtccaaatttgctcagtctgggccaatcagagtctttctcctgggatgcagagagattagcccaggtggatgatgagggagtggcaaaccgaagtctatgcataagcagagaaagccagtctttgaagggaaagaggacagagcgtctgcctcaagaataacaagagagacagtgtcctttgaaagcagagaaggaactcagccatgacattcccattgcagtccagatgaactgggtagtccataagatgttgcaccttgttcaaccctgcgcatcctttctccagacccttggagaaatacctcccaccccgtgttgccaccgcctagggaaatccaaaatccagctgtacaatgtctgtacatttccaggggcttccatcctcaagtcttctctgctcctaggcttggttccttgagtcctgtacctccatccaactgaatatgaaactcagatgcttcactggtttccataacaacagaataaaacaatgccctatcctactcccacaggtcatttgaggagcaatacaatgaggatcacaaaaagggtgtcattgatctcttcacagcagacagcttaaaaaccatgaccagtgacaatcgtctcctggctcaccatgtaactgtccctccagccccagaggactagccccagccacagccctgcaaagaccttgattttttttttaattgcaaaaaaaaaaaaaaaaaaaaaaaaaaaaagaaaaggccaggcgcggtggctcacgtctgtaatcctagcactttgggaggccaaggcgaaaccctgtctctactaagaaatacagaaattagctgggtgtggaggtacatgcctgtaatcccagctattagggaggctgaggctggagaatcccttgaacccgggaggaagacgttgcagtgagccgagattgtgccactacactccagcctgggcaagagagtgagactctgtcttaaaaaaaaagtcaatgttccagtaaagggcatcgtggtatccatatggccataactaggagaactagaaatccacatttgacattcctggttaacaagatctttttcaccaccctgtgccataaggcagtggggtggtttcctttttcttggccttttccacacacggggtccagtttcatcacctctttttctcttctcctttatctcagctccctccattccaaggaagacacttacttctcctgtcttatccacagcagctttgccctcttctaagaagccacggcaccaatttatgctgagctcttgcaagtaccaccccaggtgtttgtcaagccataattccaagcaaaaaccattatctccccaagatacatatgggtaccatctgtcaagatgctagcatttcccttcattttcttacacctttactaaactatatttttctcaagtgagcttgagtggatttctgttccttctagtctgtgctgcaatattctattaaaaatttaggctgaatgcagtggctcacacctgtaatccctgcactttgagaggcttaggtgggaggatcgcttgagcctagaagttcaagaccagcttgggcaacatagcaagaccccatctctacaaaaaaactaaataattagctgggcatagtggtgcatgcctgtagcttcagctattctagaggctgaggtgggaggattgcttgagcccaggagtctaaggctggagtgagctatgcttgtgccactgcactccagtctgggcaacagagtgagactctgtctcaaaaagaagaaagagggccaggtgcggtggctcacgcctgtaatcccagcactttgagaggccaaggtgggtggatcatgaggtcaagagatggagaccatcctggccaacatggtgaaaccccatctctactaaaaatacaaaaaaaaattaggtgactacagtggtgtgtccctgtagacccagctgctcaggaggctgaggcaggagaatcacttgaacccagaaggcggaggttgcagtgagctgagatcgtgccacagtactccagcctggcgacagagcaagactccatctcaaaaaaaaaaaaaaaggaaagaaaagaaaaaagaaagcttagctataccgagaactttatttcccatatcccattttgtattagtccattttcacactggaaaaaaaaaataccaaagattgagtaatttataaaatagagaggtttaattgactcacagtttcgcatggctggggaggcctcaggaaacttacaatcatggcagaaggggaagcaggcaccttcttcacaaggcagcaggagggaataagagccagcaggggaaatgccagacacttataaagccctcagatctcatgagaactcaccctttatcacgagaacagcatggaggaaactgccgccatgatccaatcacttccctccctcgacacgtggggattacaatttgcagtgagattttggtggggacacagagccaaaccatatccttttccctgtagggttgtgggttaaaagtaggcagaagaggatggtgcgggagatttgggaagtggaaggaaggtgacatcagtgtttactctttgaaggctgtccagatgagacaaggaggtgatctgacagaggggccacagaggttccagcttgtcctcaccctcccctgtgtcccttgcagcttgtcttcctgaccgctgggcctgctgaccaacagcagcccccccgcctctggatgcttggcagacgaggcagcagccccctagggacccctctacctgtttcccctctgccactccatcttaacagctggacgcatctgactctcatatcagctgtcggtgacttctctcatcctctccacccttcccagaccgccatctccccagctccctggacaattgtagaaggtctaattcctataacgcatcccttgccccagagcacgtagtgaccctgcttccccgattgagcactgactaatatccctcaacagcctttacagaagtagccagaagttggaggcaatgtgtccatcttgcaccaggccaacatccccccatgcttccgcgtctcagccttgactgcctattgcaatcacatggagaactttaaagaaaatgctggggcctggtcttacagccagagtcttgtctagttgttccaaggcatagcctggtcattgagagtcttagaagcaggtaggctgatgccccctcacctcccacggcacagacatcccctcacctcttcgctggctgaaatagaagaaccctagtgtccatcagctgcttatagatgactcatcttcttaatcctttcttgacgaaaacttgcttcagatgttaataaaaagtacaaaatctgccctatgttagtttgactccttggcacagcagtgggagcctctctctctcccctgtagcctaggatcgtgatcagaatcataatgaaatgtgtgtttgtggtctcccgtggcgtcagataattccgatgccatctgttgtcttcatcatcacatccgttattgaagtccgttgattatgcctttgattgaacctggggctatatttatcaagaaaattataagcacaggctttctgacagtgtccaaccaaacagaatttgtcatcattcaatgactattgctttccatttgttcctgttttggacttctaaaaaccaacacagggtctccttttatttttatttttttaaagaaatcaagtgagctggccaagagcagagcagaagatagatttttcttattcttaattttttttttttttgagacagcatctcgctctgttgcccaggctggagtgcagtggcacaatcttggctcactgcaaccttgtctcccaagttcaagcgattctcctgcctcagcctccccagtagcggggattacaggtgcccgccaccatgcctggctaatttttgtatttttagtagaggcggggtttcaccatgttggccaggctggtctcgaactcctgtcctcaaatgatccacccacctcggcctcccaaagtgctgggattacaggcatgagccaccatgcccggccgagaaatatatatgtatttttaagagacgggctttcactctgttgcccaggctggagtgcagtgatgaatcatggcttactgcagccttgaactcctgggctccagtgatcttcctgcctcagccccttgagtagtggggactataggcacatgccaccatgcctggccaattttttaatttttttgtagagatggggtcttgctgtgttgcccaggctgttatcaaactcctggcctcaagtgattctcctgcctcagtctcccaaaatgatgggattacaggcatgagccaccgtgcgtggctgaaaattcttaaatgtctgccacctatgaaagcattttggagctatagtttgacccaagacgaaaactgctcatttagataatgaagtttaatttacctttgaaagcaacactttgggaaatgcctgaataaactgacatcttgagtcgataggaggcttccccacgtggagtttggtgagctataccaggtcattaaaaagcccttagatgggccggatgcgttggctcatgcctggaatcccagccctttgggagcccaaggtgggtggatcacttaggtcaggagttccaaaccagcctggccaacatggtgaaacaccatctcttactaaaaatacaaaaattaactgggcatggtggtgtgcacctgtaatcccagctacttgggaggctgaggcaccaggatcacttgaacctgagaggcggagattgcagtgagccgagatgtgccagtgcactccagcctgggtgacagagcaagactctgtctcaaagaaaaaaaaaaaaggctcttagattggaagtcagtgctctcattcccccttgaagatggtgactgtttgctactgttccatgtcttcaatgctcatgctgctgcttagacctgttagaactgaccttgagttattccagaggaaaattccagcggatcctagaacaatcagagtattctggactgaagcatagtccagaatcgctctggtgattaaattcggaaagcttgcccagggcatcattaaccgcctggaggagtgagccctctcaccatctgttgtctgccatcactatttggtttttctctttggtctcatttagagccaagttgagaaatttccagttcctctccacttgctgcccgacacagttaaccagaaacacaatgtggtgaaggggcccatgttgtagctaaaacagccctagacttggaggcaggagcctgggttgatatcttggctgtttgactttatagcagcgatccccaacctctttggcaccaaggactggtttcatggaagacaatttttccatggaccagggatggggtgggggcatggttttgagatgattcaagtgcattacatttactgtgcactttatttctatcattattactttgtaatctataatgaaataattatacaactcaccataatgtggaatcagtgggagccctgagcttgttttcctgcaacaagatggtcccatctgtgggcgatgggagagagtggcagatcatcaggcattagattcctataaggagcgtgcaacctagatccctcacatgcacagttcacaatagggtttgcactcctatgagaatctaatgcagccgctgatctgacaggagggggagctcagccggtactgtgagcatggggagtggccgtaaatgcagatgaagcttcactcactcacccgccactcacctcctgctgtgcggcctggctcctaacaggccaaggacctgtactggtggtggctcaggggttgggaacccctgctttatcagacttagttggtccagtttttcccaaagttgggtacgctctgggatgattttaggcagcatttaggaaaacattaattaagaattttttttcggccaggcatggtagctcatgcctataatctcagcactttgggaggcctaggtgggaggatcatgaggtcaagagatcaagaccagcctagccaacatggtggaaacccagcctttactaaaaatacaaaaattagctgggcgtggtggtgcacacctgtagtcccagctacttggaaggctgaggcaggagaatctcttgaacccgggaggtggaggttgcagtgagccgagatcgtaccactgcactccagcctggtgacagagcaagattccgtctcaaaaaaaaaaaaagaaaaagaaaaagaatttattttcaggcaaggcctagtggctcatgcttgtaatcctagcattttggaaggccaaagtggaggatcacttgagcctaggagtttgagtccagcctgggcaacatgacgaaactccgtctttacaaaaaattagcccagtgtgctggagtgcacctgtagtacccccagctacccaggaggctgaggcgggaggattgctggaacccaggctgcagtgagctgatatcacgccactgcactccaacttggacgacagagtgagaccctgctgaaaaaaatatatataattttcatgtcttttaggaacaatattaggtttgcatttatggtgatgtaaaaaagagaatcaacataaagaaaagtattaaatagacaataaaagagaacacgcctgtaatcccagcactttgggaggctgaggtggggagatcacttgaggccaggagttcaagaccagcctgtctaacatggcaaaaccccgtctctactaaaaatacaaaaattagcggctctcggtggcatgcacctataatccaagctactcaggaggctgaagcatgagaatcacttgaacctgagaggtggaggttgcagtgagctgagattgtgccactgcactccagcctgggtgacagagtgagaccctgtctcaaataataataataatagagagggcttgaggcatagcaactgttgccatggtaacgtgcaagtgactgatgttcaggaaacactggctttgctaccctgagccacacttttccttcttgcctgcaaggcgataaggatgttgcacctggtggctggtgtgaggaggtcaggcgcagcaagaggcagcacacgtagcagttacagtcacagactttgcctgcgccagggtctgtgtcccagcggagatgcttaccggctgtgtggtcttgagcaaattgctcgacttctctgttactctgtgtggtgttttctgacgccacttctgacaccaaatgtgttttttctgataccaaatacgtgccatttttctacactaagtctctgattcttggatgccaactgggtgcccaagcaattcaattcagctatcacactatgtcctggagttagcatcaggtcctgcaagttaaaagaccccatcccaccagactgcccctatctcagatgccagtcgcaagtccggagccacccacccttctgcctggccaattacaaacttgggggttcccacgaccacctcctcgggtttgatagtttgctggaatgactcacagagctcaggaaagcccttcacttatgtttactggtttattacaaaggacagaactcaggaatagccaaatggaagagagatgcattgggcaaggtgtggagagggagccgtgcagagcttccatgatgccctctctgggtgcactgccctcccagcacaccagtgtgtccaccaacctagaggctccctggatctcactgttcaagagcttttataattcagtcgccagcctcctcctcttcctggcaggtcagcgagtgggactggaagttgcccgccgaattgttttttttttttttttttttttgagacagggtctcactctgtcacccaggctggagtgcagtggtgagatcatagctcactacagccttgacctcctaggagtgagcctcctgcttcagcctcacaagtagctgagactacacaggtgggtgccaacatgcctggctaatttttaattttttttttttttttttttgagacagagtcttgctctgtcacccaggctggagtgcagtggcgcgatcttggctcactgcaagctccgcctcccaggttcatgccattctcctgcctcagcctcccgagtagctgggcctacaggcgcctgccaccatgcctggctaatttttttgtatttttggtagaggtggggtttcaccatgttagccaggatggtctcgatctcctgacctcatgatccgcccgcctcggcctcccaaagtgctgggattacaggcttgagccaccatacccggcctaaattttttttttttttttttttggtagagatggagtcttgctatgttgtgcaggctggtctcaaactcctgagctcaagtgatcctcctggctcagccacctgagtagctgggattacaggcatgagcctctgcatccggcagtgcccccgaccacctgtctttttttttttttttttgagacggagtctcactctatagcctaggctggagtgcagtggcatgattgcggctcactgcaacctccgcctcccaggttcaagcaattatcctgcctcagcctcccaagtagcttggactacaggcacgtgccatcacacccagctaatttttgtatttttagtagagacgggggtttcaccatattggccaggctggtctcgaactcctgacctcgtgatctgccggcctggacctcccaaagtgctgtgattacaggcgtgagccaccgtgccctgcccacccctctcccctgtctttatcacacatttgctcttctggtgacgaggccccaacctgaagccatctctctagggaactcagcctgagtgccctcattagcatacactcagatgtagtacaatggggattgctatggataacaaaagacagtcctatcgctcaggaaactccaggggctttaggagctctgtgctgggaaccagggatgaagaccaaatagatattttattaaccacactagtggcttaatgaattacctcctagggattttttttttttttttttttttttggtcaggagcagatgagataagatacataaaaaagatattacaatacctaaccacataataactgttcagtaaatgttagcagtgaaatgggggagctcccctgtcccctttgcaggacttgtgacaggggtgtggctcgcttacttggctgccactgcatcaaaccccttgcaggagggggagcatgcaggtgagcagattggggctggggtgagtgcttttgggctctggtcccatggcagcgtctagggatgtgttacaattaatactcttttagcagttgctgtacgcagatgactaagtgttaaccagttcagtggagattcagggtgatagccttttacaccctgccctcttggtacctgggttcttgtctggtgtccaggaagaatcaggtcacatggacttgaaggatggtgaatacaaattttttattaagtagtggaagtggctctcagtggaaggggagctggaaaggggatggagtgggaaggtaatcttcccctggagttcagccatcctcagatgatctcctctctgactgtccccagccaaactcctctcgatgttcagacacttcttctcttctctccttctctgccacgccactctggtgctattctgattgtggagcctggggtttggggttcttaagggcataggatgggggcagggtggtccagagcggttttggaaaaggcaacatttgggtgtgaaaacaggaatgcctgttctcatttagggctgcaggtccaggcttgagggtggagccctcacctgggaccctgtccttctgccgcctgtccgtatcagcaggatgctactgctgctgctgatacctggggaattgccaggtgtgaggtgggcattagaaaaatttcaggctgggcacagtggctcaatcctataatcccagcactttgggaggtcgaagcaggaggactccttgagcctaggggtttgagaccagcctgggcaacatcacaagaactcctctctacaaaaaattttgaaatgagctgggcatggtagtgtgtacccataatcccagctactcaggaggctgaggtgggaagattgcttaaacctgagaggtcaaggctgcagtgagctatgattataccactgcatgccagcctggaccacagagcaagaccctgtctctaaaacacaattaaaacaaaaatttcagttgaatatgttcctaagaagccacaaaagagtcttttgttatgattcttaaatgaaaattaactaaaaattggaaataaggaagaatgtcttttccatgtcatactgaggcactgcttaatgacctgcccacggatgattaattatcttggagagagtacatgtatctgactttgttatttattatttgattagagcactgacatagtgaaattacacgttaacttgtagatttctgtccagtagaaaaaagacgacattaaaggttatggttttattgcccttatagcatgttaaccagatttctctcgaatttagcaatcttatgctaaggttttcattaaagatgctgatgagtccactttttaaatgcccttggagcgagctttaccattttactggttccctcattaatgggttaaataaattttttgacaagtgttcattccacatttgtatgagtcacattttaaattttgaaaatatacttcagcatgatcttaataatgccaagtcccagagagttctctgtgcccataatttagttcactgggcacattcccagagcacgttcagtatgcaaagcatcatggtgggccccgcagggaagactaaaatgggtaggactggtccctatagttgcagatttagtaattacttatgggcagaaaagaagtatataaattacttcctacactgtgagaaagagaaaagctgcccctggcagccgggagctggcttgacactcacagcttggccaaagtgttctcctgttgaatgtaaacaattttgcagattgccggcatcagacaaggccatcctgagaccgtgatagatcaagacaaaataacactactcctgaaggcagataaagacatgaacattgtcccagccacaaaaatcacccaatagccccatttcctagctcatatgagtgactgctagttctccatcaatcacagtttcagtcttactctgttcttctccctttaaaggaaagaattaggaagacactctatcagagaattacctccacttcctgacaacatccaatccagagtaaatgctcacttcctttaaactgtcccccaaagcacctaacacaagcccaaattttcttttcttttctttttctttttttttgagacggagtctcgctctatcacccaggctggagtgcagtggtgcaatctcggctcactgcaacctctgccccccgggttcaagcaattctcccgcctcagcctcccgagtagctgggattataggcacccgccaccacgcctgactaacttttgtatttttagtagagacggggtttcaccatgttggccaggctggtctcgaactcctgacctcaagtgatccacctgcctcggcctcccaaagtgctaggattacaggtgtgagccaccacacctggccccaaattttctaataagtgctttctaacaccctcttactgatatctgcccacagctgattaggtgcaagctagcccagtaccaatcgatagaagacagtacagactcactaaagtgatatatgatggagaaaattgtccccatccagacttcccttagagagaagacccggtgtggttggtgggaacactctgacgcttcttttggttagggttgttggccacaagcaacagaaatcaactctgcctgactcaaccaaaaaatgggattgtagaaggctatgagtggggatgggggctcaggagtcggaaggacaggcttggaaatgagtatggatcaagaaagccccagagactggccacaggaccaatctggccaggaagccgccattgctggacagcacaagtctaatccctccatccttttatctctgtcatttgctctgtggtcaaagtcttggacatgagcttctgattggctgagtctgaggaagtgggggtgctcccttgttgaacttctctaataatgactgacacagtgaatgctttccctaaaactagggtttggaggttgagcagccaaaaattccaacttttttccattacaggagggagacacaaccccacccaagaccatgtgtaagtaacaataggtagtctgtaaacagccttccatggccaggaatggtggccaaagaaggtcttctttgacagaggtcaaagaagagggtgggggccaggcacaggggctcacgcctgtaatcccaacaatttgggaagccgagatgggaggattgctttgaggccagaagtttgagaccagactgggcaacatggtggaaccccctctctataaaaaatataaaaattagccaagcatgctagggcacgcctgtatttccagccactcaggaggctgaggcaggaggatgtcttgagcctgggagattgaggctgtggtgagccatgatcaagcaactgcactccagcctacatgacagagcaagaccctgtttccctgtcacaaacaaacaaacaacaaacaaaaacacatacacataaaccccgtcgttctaagcaaagtgagtcctgctatctgcaggattttgatttttttccaagagcattatgctgaactggtatcagaattaaattgcttggaacaattgttcctggatcaaactgagggttgggctgcttattctagtgacccaataacgagatgcaaataaactgggaaaggagggagtttctatttctgttaccagttacagggaaaaagcctggaaaataccaccagaccaactcaaaattacaaagtttcccagagcttacataccttctaaactatatgtccacgtgtaagtgtgcgttcacctaaagacctaaataatcagcttcttctagtctaactaaggtctgagtcctgaagaccttcctctgaagcctcagtaaatttacttaatctaaatgggtccagttgctggggtgattacccttatcttgtctcctgctaaatcatggaggtttggggacttccttcacactcccaataaacttgtttgtggaggcctggggagtttcttcacacccccaataaaacttgtttaatcctaaacgtgtcctgttaagaattgcctcgttatctcgtcatgtttcaaggcccaggaaaggcctgagcaaaactgttggaggatttctgttacattccagcctttgtataagggcactggctcttttagctttttttttttttttttgagacagagtctcgctctgtcgcccaggctggagtgcagtggtgcgatctctgctcactacaacctctgcctcctaggttcaagcgattctcctgcctcagcttccgagtagctgggattacaggcatgcgccaccatgcccagctaatttttgtattttttgtagagacatgatttcactatgttggccaggctggtcttaaactcctgacatcaggtgattcacccgcctctgccttctaaagtgctgggattgtacaggcatgagccaccatgcccagtaggctccttcagctttgtttttttcttcttcttttttttttttttagtgacagagttttgctcttgtcgcccaggctggagtgcaatggcaggatctcggctcactgcaacctccgcctcccaggttcaagcgattctcctgctgcagcctcccaaagtagctaggattacaggtgcctgccaccacgcccagctaattttttttgtatttttaggtgagacggggtttcaccatgttggccaggctggtcttgaactcctgaacaaggtgatgcatccgccttgggctcccaaagtgctgggattacaggcatgagtcactgcctgcccagccactttcagcttttaatgtttaacttaaccacacagtccctgctgaaatagctgtcatggaggcctgcgttagtgagacctgacctgccacacaatgaaggagatgttcttcattgagataatgtgggtgtccgaatcaggatccacaggtcagtgtcccagctccaccattgactagctgtgtgattccgatggagccacttaacctctctgagctgtgggatcttcctgtataaaagagacaaccacgtagtgcccacctcaaacagtggttatcaggattgagatgatctgtgtaaagcatttagtgcctatgaagcacttcttagtgtataaagcacttagggtgtaaaaggtgcatggtaaattctgtttgtcgcccgggctggagcgcagtggcatgatcttggttcactgcaacttctgcctcccaagttcaagtgattctcctgcctcagcctcccgagtagctgggattacagctgtgcaccaccatgcctggctaatttttgtatttttagtagagacgggatttcaccaggttggccaggctggtcttgaacccctgatctcaagtgatctgctggtcttggcctttcaaagtgctgggattacaggtgtaagccactgcacccgccctgtgcgtggtgaattccgagtaaatggtagccaaaatcattgtcatcatcatcgccacaggtaaccttttccccaaataatactcagcttctcttctaagtaaacgttgaatgaatactttagagtgttgaagaagcacccctaaatctgcccacttgttgattctagccagtgatgttaaatttttaggaatctggagaaccagttgttcaactgtgggtagctcaaaatctgcagcagtgggagtatttacaccgtggaaattggcaaatgattcacagcaaggcttctacctccctcccctgcttccagccagttaaacattccccagcacatcactcattctagtcctagcctgccctactttggggcatccaacagagattacttgcgttttctttgtggtttatcaagccccagggtctcgcttgcctacaaaggagaccactaatcactagcatgctgaataaacatgaagttgacttaaacattaatttacttattatcaaaagcttatctgcttctgctggtgcaatgactctgatgggaattgccagtggtgatggtagataggtgatggcttcagagaagtgtgctctgtgctttggcaggagcagggctaagctgagacagtggtcctagtggcccagtccatgggctaagcaggaatgggtgggaagagggcaggggaggcttccccggggcctgcagattgtgttcttaagagttttttccttcagtccttagaagctcagctgaaaggaatgactgcggccggatgtggtggttcatgcctgtaatcccagcacttagggaggccgaggtgggcagatcacctgaggtcaggagtttgagaccagcctggccaaactggtaaaaccccaactctactaaaaatacaaaaattagctgagcatggtggctggtgcctgtaatcccagctacttgggaggctgagccagaggaattgcttgaacccaggaggtggaggttgcagtaagcccagatcaagatcacaccactgcattccagcctgggcaacagagcaagcaagattctatctcaaaaaaaaaaaaaaaaaaaatggagtgattgctttaaaattcttaaacagggccgggtgcggtggctcacgcctgtaatcccagcactttgggaggcagaggcaggcggatcactaggtcaagagatggagtccatcctggccaacgtggtgaaaccctgtctctactaaaaatacaaatattagctgggcgtggtggcgggcgcctgtagtcccagctactcaggaggctgaggcaggagaattccttgaacccaggaggcggaggttgcagtgagctgagatcacgccactgcactccatcctggcgacagagtgagacattgtctaaaaaaaaaaaaaaaaattcctaaacaggaggggcttagggccagccagttggtcacatgaaacaatcaggggacttaccttagagctgccttcgcagtagggagtccatggtttttagtgagatttgtgtcgtacaaattaattaaaattgcatagtttctatcaagtttttttcttacactttccacaaaattgggaaaaatgtctatttcccatttctttatttcattttctcttattgcttctatcctacctgatatttcccatttcaaaagcacgtttttttttttgagatgcagtcttgctctgtcgcccaggctggagtgcagtggtgccatctcggctcactgcaagctccacctcccgggttcacgccatgctcctgcctcagcttcccgagtagctgggactacaagcacctaccaccattttttgtgttttttagtagagacagggtttcactgtgttagccaggatggtctctatctcctgacctcgtgatccaccccgcctcggcctcccgaagtgctgggattacaggtgtgagccaccgcgcccggcccaaaagcactttttaaatgttgaggtggtttgaaggctaatggaaattacgaggtgggactgaaaccattccctgccatccctaagaaagcccactccttggaactgccactggtgaaagtctcactctgtcacccaggccagagtgcagtggcacaatctcagctcactgcaacctctgcctcccaggttcaagcgatcctcccacctcagccccgcaagttgctgggactacaggtgcccaccaccatgcctggctaatttttttttttttttttaagtagagacggggtttcaccgtattgcccaggctgatctcaaactcctgagctcaagtgatctgcctgcctcagcctcccaaagtgctgggattacaggcatgagccaccgcgcccggcctgaaagcattttagaaggctcctgactgaaagaacgggataaagtaagggggtatgggaacagaagatgacagcctggtatatctgggtgacatgcgtaggcagtctgttgtagtggcaattgtcagggctctggagttagactgtcttctttcaaatcttgcaagctgtctgatctcgggcgatttacttaacctctctgagagttctgtaaagtggagaataagaataccaccctacagatgatgaggattcaatgagattgggctggatacaaatcagcttttgttggcatcagcttgagaggagggatggacttgggagtggagagggtggatttgggggagaggacgccacacagtggcaggaactcgcagcaggtgactgagagtggaaggcacaagagagcccagatgctgagccagctcagaatagaaacggtattgatagcagaatgcaaagcagtatcactcgaatgacggatgtttaattggatttctccagggctgactcaccgcctttgatagatgcgattgccctcgtggtgtctatcatgagacttgaaatttttccacctgcacctgcagtctttaggccttgtttcaacaaaatgcagtactgtgtgtaccctccatgcctgccagccttccttccttccttgtgtatttactgcaatgtatcagggacggggtggtgtgctagaaccatgaaggaaaaaggcaaagtcccttaaaggaggtgcagtctgttgaggcagaaacacaaatgcctagatggttctggaatgcctagatgtcaatgggataacaagggggctatggctgcaggaaggaagaggacctgatgtagctgagggcatcaggaagattccagaaggagaagggattagtgaagctgcagagcacttagtttgagacaaagatttctgagctgagggaggagttgggcaaaggcttgagtgcaggagttcaagagaactccttggggccaggctttacacagggatgcacatgggctgtgtaccagtctgttctgacactgctgtaaagatactacccgagactgggtcatttataaaggaaagaagtttaattgactcacagttctgcatggctggggaggcctcaggaaacttgcagtcatggcagacggcgaagggaaagcaagcacgtcttacgtggcggcaggagagagacagcacaagagaaaatgagtgtaggaagtgccacatttaaaaccagcagctctcttgaactcctgcactcaagcgatcctcctgcctcggcctcccttagttctgggataacaggcaggagctgctgtgcccacctggagcttaatctctgttcacatctttaattattctgggccagcttagccaaaggccttaggggtagggttagggacaccaagggccagtcttctatccacttcacagctcgctgggccctccaagggaaggactatgtgtctcattctaggcactggtaagagtctgggggaaaaaaaatcaaaaataacaagtggacgcggtggctcacacctgtaatcccagcactttgggaggccgaggtgggtggatcacttgaggtcaggagttcaagaccagcctcgtcaacatggtgaaaccccgtctctactgaaaatacaaaaattagcagggtatggtggtgtgcccctgtaatcccagctactcaggaggctgaggcacgaggattgcttgaacctgggaggcagaggttgcagtgagctgagattgcaccactgcactccggcctgggcgacagaacgagactccatctcaaaaaaaaaaagaagaagaagaagaagaaatgaactcacaacacttactgtctccttcaaaggagtgaaggatgtgcagagggctaagtgcggtcccagaaactgccaggtagcatcagtgagcaggtgcaggaaatctgttggccaaccttgcatgcactgggcacggcccagttccctgccagagcccagagaagaaaacaagctctggtctcagtcgaagcagtggggtgggaagagccctgctgtctcgccacatggccttggtagctggcctatgtctcaatgtctcttgaaagtgaaaatagatcaggagggctgacacgtagtaggcgctcaagaactgttttctggatgagtcagtgaattggtgaacagcattcacctctctgggcattgatttcttcattcatgtaaggtgagagctcttctagctgcagaaatttctttagagccaggcacagtggctcacccctgttatctcagtactttgggaggccaaggcaggagaatggcttcagcccaggagtttgagaccagcctgagcaacatagtgagacccccatctctaccagacattttttttgagatggagtctcactctgttgcccaggctggagttcagtggtacgatctcagctcactgaaacctccatctcccaggttcaagcaattctcctgcctcggcttcccgagtaactgggatcacaggcatgcaccaccatgcccggctagtttttgtatttttagtagagatggagtttcgccatgttggctaggctggtcttgaactcgtgacctgaattgatccacctgcctcggcctcccgaagtgctgtgactacaggcatgagccaccgtgcctggcccaaaacgtttttttaaaattaccaaggcgtggtggcatgcgcctgtagtcccaactacttggaaggctgaggcaggaggattgctctagccaggaggtcaaggctgcagtgagctatgattacactcctgtaagttcagcaaaatatttctgtaaagggccaagtactaaacaccttaggctctacagagtgtacagtctctgtcgtgattactcacctctgccactgtcgggaaaaacagccacagacaatgctgaaatgaatggacatgacttcgttccaatagcatgttattcacagatgctgaactttgaatttcatataattttcatttatcagaaaatgttatgattttgattttccccaagtatttaaaaatgaaaattaaactattcttagttcgtgagttgtaccaaaacaggcagtgggccagattttgactgtgggctatagtttgccaaccccagctaaagattgaggagcaaacgcatcttccaggaattccttggatcgtcttagacagaaggtcaaagggagagtgcactctctccttggtgtggaaatactgatcaccatgtcttccaaactgggtttcatagacacatctccatgccatgctctcactctagaacctaagatggctcccatgttaaggttctttacaacgcagacacatatgtccctgatatgtcctaattgggcagactcttcattgtcacctaccctggcataccacacccattcctaatatttgtctcagctcccccttctctctgagtgcctggaatcttttcctgacccctccaagttgtgccctcccctgtaagttgcatctcgatttgagcagccttctcccagactatcctgatctctgtcttccttgaactccagtcactggctggagctttcacagtcccagtcgagagcatgggctcagatcagactgcccgagttcaagttcctaccacttactctgtgacgttgaacaagttctttatcctgtctaagagataataataatagtccttacctcatagagttgctgcaagagttcactgagatgatttgtgtaaaatgcttaatccagagcctgacaccaatcatatgaaagcattcaataagtactagcaattatacttctgtattgtttgatgtttttatagtgagaccatatttatgtaatatttgtataattttttaaatagaccaagctgggtgtggtggtatatgcctgtgttcccagctacttgggaggctgaagcaggaggatcccttaagcccaggagttcaagtccagcctgggcaatatagtaagaccctgcctctaaaaaagaaaaaaaaaaggaccaagtattcttttttttttctttttttttttagatggtgtctcgctctgtcgcccatgctgcagtgcagtggcatgatctcagcgcactgcaagctccacctcccaggttcacgccattctcctgcctcagcctcccaagtagctgggactacaggtgcccgccaccacgcccggctgattttttgtattttcagtagagacagggtttcaccgtgttagccaggatggtctcgatctcctgaccttgtgatccgcccgcctcggcctcccaaagtgctgggattacagacttgagccaccgtgcccggccaggagcaagtattcttttaggtctaaaacaaaggtaactaagcaatactggtgtttgtttgttttgagacagggtctcactctgtcaaggcagacagctggaaacccacgtcaagaaaattgactattttcaaaagtcaatccttgcctcccaggttggagtacagtggtgtgatcatggctcacccaggagctcaacctcctgggctgaagtgatcctcctacctcagcctctctggtagctggaaccacaggtacacaccaccaggcatagctaatttttttattgtgtagagacagagtctcgctatgttgcctaggctaatctcgaactcctggactctatcgatcctcccatctcagcctcaaagtactgggattacaggcatgagccactgtgcctggccataatttttttatatcatacatacagaaaagagcagtattagtagttgttattgtaagaaaaatgaaaactaaggcagtctagaaagcccttggaagagagaagaataaactgcgcttgaggaagttgacatttgggaacagagtgggaacaagggtcttgaagaaggtgacatttgtttgggaacgagtgtctgactgcaatcaaaggaaaggccagtgtgacaggtggatgtaaatccacagtccattaaaatggccacagagagaaaacagacatattggccttccagggtgcaacatgagggcattcccttcctatgtacactggcaggcacctctccggtcccttggtccccagcaagatgctgagaaattgctgaggccaggggctccctggacacttatcaacacttatccttacccagggatagcgtttaagctcatgaatcctacgaaagctgaaccaatgcacatgtttatcatcttggaaccatttgatttgaggaaattgtaatagcacatgctggccaggcgcggtggctcatgcctgtaatcccagcactttgggaagctgaggcgggtggatcacctgaggtcaggagttcgagaccagcctggccaacatagtgaaatcccctctctaccaaaatacaaaaatttgctgggcatggtggcaagtgcctgttatctcagctacttgggaggctgaggcaggagaatcgcctgaacctgggaggtgaggttgcagtgagccaagatcccgccattgcactacagcctggacgacaagagcgaaactccatctcaaaaaaaaaaaaaatagcatgtgatagtgagatacacattttgcacagaaatgttggctgagatagtccaggagagtctctgtgagctgactttttacctagggtggaggagtggatggaagtggctgttcctacacacccacactgcctgtgcaaaaccgtgggctgcctgcaccacacacacaagcctgtttgattctcatacaaccccaagacaaaggtgtaatcccttttcaacagtgacagcactgaggctgagagcagcaaagtaggtcatagccagtcaatgggggtactgagatctgcattgagatctggctgtgtctaaagcgggttgtatcctctctgtgcttgcagaatggggctcgagggctcatctaaacccctcatcttatttatttatttttatttatttatttatttattgagacggagtctcgctctgttgccaggctggagtgcagtggtgcaatctcggctcactgcaacctccacctcccaggttcaagtgattctcctgcctcagcctcctgagtagctaggactacaagcacgtgccaccacgcccagctaatttttgtatttttagtagagacagggtttcaccatgttggccaggctggtctcgatttcttgacctcgtgatccgccctcctcggcctcccaaagtgctgggattacaggcgtgagccaccgcgcccggcccagacatgacatctttttctcacctgtcttaagatacctgcagcctctgtaacttatttttaaaaggagacaataaagactatttttaaaagtcaatccttgcctctgaaaacctacctctgcctttgtcgtggtctctgctgggtttccattaggctgcaactcaagctgctgatgcctccatttcatgtcgttttcacaaacattttgtaaagcagcagctctattattccagcagggcctgatcacctctccgcacccaacgctgataaaaatgacccgctttcccctatcgtcccagcgtgaaagaccaagatgctgaatgacacgggttggctttcttttccttccgaacattaatcaggttcttgaagataacatctctctctggaacgagccggcagcagcagagtttgatttccaggttcagccctaatggtacagagacctggactaatgtggcttattcaaagttccagccatgcttctaaagcatggcttattcgaacttccagctatgcttttaaagcactttgcatgaactattcacatgtcttttgaacaatatgatttaatggcattggaaaatcatcatgatgtcatgcttgcaatgagcaggacagctgtatgtcttgatccaatacacattaaaaatgcacctatccacacatatgtatctgtgaaaatgtcttcagctgcaagtaacacagcgtccgacgactagtgtcttaaatcttgggtgaccagctgtctctgtttgcctgggactgagaggtttccaaggatctggaaactgcagtgcagaaactgggacagccccaggcaaaccaagtcagttgttcacactacttaagtcataaggacatttaatatttacttgaggctggacacagtggctcacacctgtaatcccaacactttcggaggctgaggcaggtggatcacgaggtaaggagttcaagaccagcctggccaagatggtgaaactccatctctcctaaaaatacaaaaattagccaggcttggtggtggatgcctgtaatcccagctactcgggaagctgaggcagagaatggcttcaacctgtgaggcggaggttgcagtgagccgagatcatgccactgcactccagcctgggcaacagagctagactccgtctcaaaaaaaaaaattttttttgacttgataagcagtccagatgcaggtggcccgagggtcagtggggtggccccaggatgctatcaagggtctggctgtttcctttcctcccctctgccctagatagcgaacctgtccccttctgcccatgggtagtaagccaatcgctgttatgatggatttggcaaaagaaaagaatttattcacaccaacgcagccaagcaaggaggcaggagaaaaggtctcatacttgcctccctgaagatggaatttagggatctttatggaataaaggagcagggtggtctaaagtgtgggaagaggtgattggaggcaaggaaaagtgaggtcattggcaatctgcacatacatagccaagcttcctggatcttcatagggtgcatgtttagaaaatggcagcattagcatgatctcggggagttttgggccctctgacgtcaaaaggtcacttctccggcatttgcacaggttcagttgaagggtcattgatctcaacgggttcgaactggacaggagctgcccccatagtcctgaaaaacaactttaagcaaccattaccgtagtcacatatgtgtcgtagcgacatatatgtgacatatgacatatatgtaccataatgacatatagtgacatatgtaaggaagccggtgggggggttaggtatatatcatttggctgcttgacttttagctatataagttttaagaccagctagaagtaagtggttaaaagcaagcaaggcaagttaagtttggtgggcttcatcaggttagcgttcggtttcgccattctcacgtgagtggctgtaggagcttaggaccaggacaggggagaaccgaaggccctaattatccttcccagaagcctgcccaagcggagtttctcttaagggctttctctaagcccaccaaacttaacttgccttgcttgcttttaaccacttacttctagctgatcttaaaacttatatagctaaaagtcaagcagccaaatgatatttaactaaaccctccactggcttccttatatatgtcactatatgtcattatgttacatatatgtcatatgtcacctatatggcactatgacacatacgtgactatggtaatggttgcttaaagttgttctcttacatttcattggcccagagtagatgtcatagctacctccacttgcaagagagcctggaaaagtatgtgtctagccaaagcaaatgggattctgtgactggcttccatcaaggcagggcaggttgcctcctggacaaatcagagctctgggagaaagcgggaggggaaggtctacaaccagtcatgcccgctgcaactcatggagccacatggagaggagacaacacggtgaaattgtcaagagcaggagctagggctgaatctggaaggccacttaccagtgcagagctttgggtgtgttgcttaacctccatgtactcatctgtaaaatagagctaaaaacaatgtttctcttcctggactgctgtgacggtctagaagagtttatgcacagaaagtgcatttacatgtaaatgctccgtaaatgctgacttcttgtttgccttaatggcagaacccatccttccatattccagaaaaagacttgatttttagttacgtgaatggacacctaaccctgatggacagcttggggtcgggggacaagcttctttcttggaaggatgttcaaaggaccatgaagcttttggttttgccaactggggtttgtaagttgaagaacagagctgagtaattcaggacaggggtgtccaatcttttgtcttccctgggccacattggaagaattgtcttggaccacacataaaatacacttatagtaacaatagctgatgagcttaaaaaaaaaatcacacacaaaaaaaatctcatgttttaaaaaggtttacaaatttgtgttgggctgccttcaaaagccatcctgggcctaatttggacaagcttgatttaggacctgatggtcctcctttagcggaaggtgtgtggaggaggtagagagagagagagaagagatgagacatgaggaaaacagagccatctcatagggacgttgatggagtcctgcagcgtgaatcccgtcagcagttctgtagagctccacctcgcttgtcaatgggttgtgggcttggatcttttgggaggattcaatgacatgctaagggcagccttggaggtggacaaagggccagggcaaaggcccccagggcatgcccgccacccttaggttacatggaggaaaaagattgctgtgaaatacaccagaaccctcggagtagaagtggcctctgctacacgtaggtcaaggttctgcatactttcatcttccttctttgtacttgtttgtattttccaaaatttctacaatgattagggatccattctataatcagataaaattgccatttacaaacttttattggccaggcatagtggctcatgcctgtaatcccagcactttgggaggctgaggtgggtggattgcttgagtccaggagtttgagaccagcctgggcaacatggcaaaaccccttctctaccaaaaatacaaaaaattctccaggtgtggtggcgcctccctgtagtcccagctactctggaggctgaggagggaggatggcttgagcccaggaggcagagattgcagtgagctgagattgtgccactgcattccagcctgggtgacagagccagactccatctcaaaataaaataaaataaaataaataaataaaaataaaaacttttacaaagaagagtataagcactgaaagttatttttaaaaaggttttacttgttagctccattcctcagaaatagtgcttcttccacatcattttctctttccttttttctctgctgcttttttttttttttttttttttgagacggagtctcgctctgttgccaggctggagtgcagtggcacgatctcagctcaccgcaatctctgcctcctgggttcaagtattctcctgcctcagcttcctgagtagctgggattacaggcgcccactaccaaccatgcccggctaatttttgtatttttagtagagacaggatttcaccaagttggccaggatggtcttgatctcttgaccttgtgacctgcccacctcagccttccaaactgctaggattacaggtgtgagccaccacgccggccattttttttttttttttttttttttttttgggagaaggagtctcactctgttggccaggctggagtgcagtggcatgatcttgactcactgcaacctctgcctcctgggttcaagcgattctcctgcttcagcctcctgagaactggggattacaggcatgtgccaccacacctggctaatttttatatttttagtagagaaagggtctcaccacgttggccaggctggtcttgaactcctgacttcaagtgatccttccacctcggcctcccaaagtgctgggattacaggtgtgagccaccccacccagccattctctgcttctttctcacagctaatgataataatagtaaaggccaagggtggtggctcatgcctgtaatcccagtgctttgggaggctgacatgggaggatcgcttgaggctaggagttctagaccatcttggccaacatggcaagattctgtctctacaaaaaatttaaaaattagctgagtgtaggggcatatgcctaaagtcctagctacttggaaggctgaggcaggcaaatccttttacccctggcgttcgaagctgcagtgagctatgattgcactgctgaactccagcctgggtgatagagctagaccctgtctctaaaaaacataataatagtagatagcatttactgggcatttgactgtgtaggtcccaggcactgtgcttaatgcttgatgtgcataataatcccagcaaatagtactgccattattcctatttaaaacatgacggctaggtgcggtggctcacgcctatcatcccagcactttgggaagctgaggcaggtggatcacctgagatcaggtgttcgagaccagcctgatcaacatggtgaaatctcgtccaaaaaaaaaaaaattagctgggcctggtggtgcatgcctgtaatctcagctacttggaaggcttaggtaggagaatcacttgaacccgggaggcaaaggttgcaatgagccaagatcgcgccattgcactccagcctaggcaacgagagcaaaactctttttcaaaaaaaaaaaaaaaaacataaataaataattaaaaatgagttaggtgagacagaaaaggaagtcactgtaccatggccctttgagccagagttgtttggtgccaaaactctgcctcctaatcactacctgtctctccttttgtcctttctccatcttctcctctcttacctctcaaaaattatcaataatttgataattctgtggttagaatccaagattcctcaacttcagtgtgattgacatggtggctggctcactttctgttgtgggagctgttctgtgcacagtaggatgtttagcagtgtccctggtctctacccactagatgccagtagcaaccacacccctccccaacacacactcaattataataaccaaatatgtctccaggcattgccaaatgttcctggggaccaagattgccctgatgtagcctgatctctgcaaaagcgtctggagtctctccagttgaacgatcgctgatagaaactcacgggaacagtctgtgccctcccggcaagtccacgctcattcgaggcagctgtcacctgctaggacattccagggcacgacttgaaaaatgcttggcgtgcctctgacaacaagagatgcaggctgaagcaaggcattcctgcctcttgtcctgaaactgggatgctggcattagaatggacagcatgagttgttcttgagtggcaaaaggcaaggggtcctgctgtggtttgtatgtctgtctcctccaaatctcatgttgaaattagtctgttctcgcatttctataaagaactacctgaggccgggcgcagtggctcacgcctgtaatcccagcactttgggaggctgaagtgggtggattgcttgagccaaggagttggcaaccagcttgggcaacatggtgtaactctatctctattataaagaaacaaaaaaatttttttttgggacggagactcgctctgttgcccagtgcagtggcgcaatcttggcccgctgcaacctccgcctcctgggttcacacattctcctgcctcagcctcccgagtagctgggactacaggtgcctaccaccacgcccggctaatttttcgtatttttagtagagacggggtttcaccatgttagacaggatggtctcgatctcctgacctcgtgatctgcccacctcggcctcccaaagtgctgggattacaggtatgagccaccgtgcccagccagaaaaaaaaatttttaaacaggctacctcagattgggtaatttatacagaaaagaagtttaattgacttgcagttccactggctgtacaggaagcatggctggggaggcctcaggaaacttacaatcatgatggaaggcgaaggggaagtcttacgtggctggagaaggaacaagagagcaaagagggaggtgctacacacacttaaacaaccagatctcgtgagaactcactatcatgagaacagcaagggagacgtccacccccatgatccaatcacctccccccaggcccctcctccaacactggggattatgatttgacatgagatgtgggcagggacacagatccaaactacatcataggccccagtgggaggtgtttgggtcacgggggtggatcccccatgaatagattaagctcttcctgggaggtgggggtgagtgagttctcactcttttagttcctggacagctggttgttaaaaaaagcctggcacctccccctctctcttgcttccactcttgccctgtgacttctgcacacatgagctccctttcaccttctatgaatgtagccagcctgaggcccatgccaaatgtcccatcttccagccagcagaatcatgagccaaataaacctcttgtctttataaagatattatttcctcttcattaaagaacagcttttctaaatgttgggggaaatgtccatagtcattactcaatcaaaacttgtgttcccataagcctaaggaccattctagattttttacatgtttttttgtgtgtgtgtatctataaaatgcatacataaatttttttttgtttttaagcattcacccaaacaaaaaatcacaggtaaacccatatttctgagatgccattattccgagctaaataagagataatcacttcaaggtaaattgaaaattttcctgaagccatacatttcaagtgaaataagtaattctaaataggacaatttaaattggataattttaaagcgtctataattggtttatttgcaaaattcctgaaaggaaaaattttatcactgccatcacagcaggtttccacatccagatgagaaaacaagacaaatgctagtgtgttttaactagctaaacaaaactaagttaaatgaatatttaaaaatttccctagtgggccattccttaacaaaatgttgaaatccctgttgctacattgactaaaagatcatgttgaatggaatatgtaagacttggctcatagaaacctaatcagatggttagagatgctggcagtttaggacctgctgccataaatgtgtgaacaaccttttgtaatctaacctactgacctgcatgttttttctttaccccagctcattccttacatgtagcctcaatcttcagtttgctttactggttcagcaaaagccaggaagaacaactttgtagtaatcagaatgttatccaactgtatattgtttactttatcgtaaatactggtgaacagtggttaataaatagttttatattcctttatgcaaaaaaaaaaaaaagcactcagccacaggcattccttgatagcaacactcaggggactaagatagggccccatgctggtatacagatggcactgctgaaaggagtcagcagccccggcccttgatggagacgctgaggaacgaggcagaaagatcagtggactcagactccgaagggtcgatttctagttctggtcctgcccccatgagctgtgtgtactcagttgagcctctttacctgtttccgcatgagtaaaatgaaaatatgatttctgtcctctggtttttcctaggatagttgtcaggagcaaagtaagatactggctccaagctgacccactacatcccttacctgcttcagtcttctttgtaacatctgaaatattgtatttgggtttaccttctgtctctgctagcaaaatgtcatcttcctgagggcttggtcttctttgctgttgcaagcctcagagatgacaacaatgcccaacatagtagatgttcaataaagacgtgcaggccaggtacagtggctcacgcctgtaatcccagcactttggaaggccaaggcgggaggatcacttgaggccaggagttcaagaccaacctggtaaacagcaagaccccatctctatgaaaattttaaaaattaaaaaaagtatgagctgggcatgatggctgcacagctgtagtgccagctacttcagaggctgaggtgggaagatcacttgagcccaggagttcagggctgcaatgagctatgactgtgccttgggtgatacagcaggaccctgtctcaaaaaacaaaacaagaacaacaaagacaaagacacgcagagtgaatgtgaacctgtgtatcacggggaagttatttgaagatacatctcaacagctatggaaatatcaagccctttgtacacagtgattccacttctgagaatctaaaccccaaataatccaacatggagaagaagccttagaggaactgatgttcatcctgcagtggccaaaattgctcaaacctgaaaagccagccttagtaatcaagatgagggtgtaattagcacaatcccgatgaatctcatttgtgaaattgcagacagccattacaaatattgtttacagcaagatgagttaatttttgtagcacacacacaaaaccataatgtgtaatgcaaaattataatgtgtaatgcaaaactaggttgcaaaagcaacccaattactgagatgacaggagccagcacccactgtcccccatggccacactgttggtaatgtcacacatgatctctccggagggcaatttggaaattcctactacaatgtaagtgttcatgccactagacccagcaattgcatttctatgaatctatcctagaaatgtattaggaaacaacccagatgtctatgaataggggaatagttaaataaattatagttaaatagatcactgtataatcagctgagtgcagtggctcacgcctgtaatcccagctactagctactctggaggctgaagccagagaatcacttgaacctgggaggcagaggttgcggtgagccaagatcacaccactgcactccagcctgggtgatacagtgagactgtctaaaaaaaataaaaataaaaataaatttaaaaaataaaaatagatgactgtatatcaatataatggtatactatgcagccactaaatatgtggagatttgcatatactgatatggaaagatgatcaagactattaaagattattaaattgaaaaaagcaaattgcaaaaaatttttgtgcaataacaatggtgtcatatatgatattataagcatacgctttttttttaaatctggaggaggctgggtgcagtggctcatacctatatcccagcactttgagaggctgaggtgggaggattgcttgaagccaggaatccaagaccagccgggcaacataacgaggtccctctctctacaaaaaactgtttaaaaattagcctgtagtcccagctactccgtagggggctggggttgggaggggttgtgcagaggtgggaggatcccttgagcccaggagttcaagtctgcagtaagctatgatcacgccactgcactccatcctgggcaacagagcgacactctatctccaaaaataaaaaataaaaaattaaacattttcaaaataaaaatgtttttaaaaaatccagaggaatacatactaaaccgttgacaatgattctctccgaaggacagagggagactttcctctatgttgtgaatttctgcagtgtttaaaaaacgtaaactttagctgaaaaacgaaactgaatatgccatatgaacccacttatataagcaaacctaagtcaggcacatgaagactggaaggagctctatcgaggtgttattaacagtgactgatggccaggcaccgcggcttatgcctgtaatcccagcactttgggaggctgaggtgtgcagatcacttgaggccaggagtttaagaccagcctggccaccatggtgaaaccctgtctctactaaaaatactactaaaaatacaaaaaaagttagctgggcatggtggcaggcacctataatcccagttacttgggaggctgaggcaggagaatcgcttgaacccggaaggtggaggttgcggtgagccgagatcatgccactgcactccagcctgggcaacagagtgagactctgtcacaaacaaacaaacaaacaaaaaacagtgatcatttctaggtggtgggataattgagcagtgtttggctttttccttttgagggaaaacctctacaatgagcatgtatggcctcttcaaaagataacccacctttaatagcttctttgtgttaaccgggtgatgctcagggcgtaatgctctgctgatgtaacctgctgttgatggtgtcctgtttccccaggatggatgacatccagctctgcaaggacatcatggacttgaagcaggagctgcagaacttggtcgccatcccaggtaaccatttgcaacttcaccttgtgctaaacaggtgcttgggggcccccagcctggcccatctgtacgcctgggtctggaagacagagcctcattcttgcaatgcagtgctccctgactgcatgtgtcaaacacaacttcgagtcaggaagacctgggttcaagtcctagtgaattctggtcaccttcttgtccttggacaagtcactgtacttctctgagactcaatttctcctcctctgaaaattggctagtaatagtaagagggtctaattcattgagtataaatatcctaaagaggctgggcacggtggctaatgcctgtaatcccagcactttaggaggctgagatgggtggcttacttgaggtcaggagtttgaggccagcctggccaacatggcaaaaccccatctctactaaaaatacaaaaattagccaggtgtggtggcacacacctgtaatcccaggtaaccggcaggctgaggcaggagaatcacttgagcttgggaggtggaggttgcagtgagctgagattgtgccattgcactccagcctgggcaacacagcgagacactgtctcaaaaaaatatataattaaattaaattaaatatcataaaaatcgatgagatgatgcaaactaagtgcttagcttgatatttggcctcaagagtccagtaaatattagcaattatgaccattattatcctacttgggaacagatgaagtgtgtacaaactctaactttgaagtcaccccagatttggtagttaataatgcctgacttatttggcatcttctccaaaaaattttcccctgcccatcaggctgtgttagttgccctctgtggggcttacccttatcaaaatgctagtcccaggccaggcatggtggctcacgcctgtaatcccagcagtttaggaggctgagagggcagatcacttgagttcaggagtttgagaacagcctggcaaacatggtgaaaccccatctctagtaaaaatatgaaaattagccaggggtggtggcgggtgcctgtaattccagctactcaggaggctgaggtgggagaattgcttgaacccaggaggtggaggttgcagtgaggtgagatctcaccactgcacttcagcctgggtgacagagcgagactccgactcaaaaaaaagaaagagagaactgagtaatttataaagaaaataagtttaattggctcacagtcctgcaggctgtaccagaagcatgatgctggtgtctgctcagctgctggaaggcctcaggaaacttataatcatggcggaagacaagggagcagacatgtcacgtgcccagagcaggagcaagagagtgaggcgggaggtgccacacacttttaaaagaccaaatctcatgagaactcactatcacaaggacagtaccaaggaggatggggctaaaccatcatgagaaacctccatcatgatccaatcacctctcatcaggccacgcctccaacactgggtattacatttcaatatgagatttgggcggggacacacatccaaactatatcagaatggatgctgctgattggttggggatgcaatcataggtgtgtgaaaaatgattctcaggggtgctaagtccacttctgggtggcaggtccacgtggatcatcattcatcagaaatgcaaaacctaaagagatatctcaaaaggctgatcttagattctgcaatagtgatgttatctgcaggagtaattggggaagttgcaaatcttgtgacctctggaataatggcagtagtcatttatgtctacaccttagcagaattcagcctcctcccatccttctaacatgggggccttttattagctttacaaaggcagtttagttggtggaaaaggttataatcatttaaactataaactaaatgtctcccaaagctagcatggcctaaacctgggaatgattaagggcagcttggaggttaaaggcaagatgggggttggttagatcagatccctttcactgtcctaattttctcactgttatcatttttgcaaaggtgttttcaaataggccagataagcacccaccattacccttgacttgaatgtttttgccatgctgtcagttcaataactatgtcccaagaggctgttctgcagcaagctctgaacctaggagccgggcttgcagtgatgaacagagaacggttctccactctcaaggagcccccaggttagcagaaagagactgggcccagcacacagtgggtgcccataagtggcagttcttactgagctacaagtgcagcatgatgagccttaaagcagcgtttcccaaccttcaactattgacatttggggttgacaaatgtcagtatcttcctttggggttgatcattttttgttgggggtacggggctctgtgttgtgtcttgtgggatgttgagtttcatccctggcctctacccactacaggccattagcacaacgtacctctccgctacccctcaatggtgatgttacctgaaagggatcctgatccagaccccaaagttcttggaccaagagcaagaaagaatttagggcgagtccgtaaagtgaaagcaagtttattaagaaagcaaaggaataaaagaatggctactctgtaggcagggtagcagcttgggctcctcgattgattgtacttatagctatttcttgattatatgctaaacaaggggtagattattcatgagttttctgggaaaggggtgggcaattcccacaactgagggttcctcccctttttagaccatgtagggtaacttcctgatgttgccatgacatttgtaaactgtcatggcactgatgggagtacctcttagcatgctaataccttataattagcatataatgagtagtgaggacgaccagaggtcactttcatcgccatcttggctttggtgggttttggcagccttctttactaatgctgttttatcaggaaggtctttgtgacctgtatcttgtgccgacctcctatctcatcttgtgacttagaatgcctaacctcctgggcattcagcccagtaggtctcagccttattttacccagcccctattcaagatggagtcactgtagttcaaacccttctgacagtgacaaccaaaaatgtctatagatgtacagatgttgctgaatgtaccccaagcgaggtcaggggggtgtgcaacattgccctatgaaaggaaaataaagtcccaggaccccaattcactataccaaaaggaaaagttaagcttgggaactatgagtcatacaaaaacctacttttttttttttttttgagacggagtctcgctctgtcccccaggctggagtgcagtggcgcgatctctgctcacagcaagttccgcctcccgggttcatgcctcagcctcagtctcccgagtagctgggagcctgtaggcacctgccaccacgcccggctaattttttgtatttttagtagaggtggggtttcaccgtgttagccaggatggtctcgatctcctgacctcatgatccacccacctcaagcctcccaaagtgctaggattacaggtgtgagccaccacacccagccaaaactgcctttctttttttcctaaacagatagctgcaagatagaaaggccacctatcttcccaggggcctccctcaccctgtcaatgtaaattaacagcttatcctaacaggtaggggactaagacaagactataaatcatcgtccctccgcccacccggagacaaatgcacatttgacttcctcctctactccgcgtttcctttatcctatgtaaaatgcaaattcactgagggccagagaatgcaatcctccccttcctgccctctctttcccctttaaatattgaagtccttaagatcctctgcagaaaaaagcacaggccggggatcctattgctgcctgtgtctctttttcccaggtgcctcctcgactttggcaaaataaacctccagattgattgagaccttctcagacactttgcagcttacagctcccacataagaactactactttagtaattagagtgcagcaatctgggtttgaattcagccttagcaggcaggtgaacttcgtgaaagttcgcgacttaatttctctgagccttgaattccttgttgggaaaatgaggccaataatactaccccccgcatggttgttgtgaatatcccataaataacaaaggcaaggtgtaggagtcttccacacagtcttgttgtaagggtagtgtgcgcaatgacagtagaactgaatcctctagctttcgtgagcatttactaggtgcccagcactgtgtaggccctaaggataaacgagtgaatagactttcctagttgaaagagagcgacagctagtgggtatggggtttcttctgggggtgattaaaatgttctaaaatggattgtggtgatggttgcacaactctgcaaatacacttggaacagatgaactgcatggtatgtgaatcatattgcaataaagctgttaccaaaaaaagttaaatgtcaaacataaaacaacgaaggaatgagggaaaagtaccaaagtctattctccacccactagaaaccccaatgcaattgatctggcattgttggctttggactctggcattgtaatagaactcaacttgtgatatggtttggctgtgttcccacccaaatctcatcttgaattgtagctcctataatccccgtgtgttgtgggagggacccagtaggagatgattgaatcatgggggacagtttcccccatactattctcatggtagtgaagaagtctcatgagagctgatggttttataaggggtttcccctttcgcttgattctcattttctgtgctgcctgctgccaagtaagacgtgccttttgccttctgccgtgattgtgaggcctccccagccacgtggaactgtgagtccattaaacctctttttctttataaattacccagttgcgggtatgtttttatcagcagcgtgaaaatggactaatacaactagggtctgctttcctggcacagtaagaccagctgtctccccagagtttttgcagtggtaaaaaggaaacagtttatttgcaaggctccaagccaggaggactgggcagctaatgcttcaagcctgacctcctcaatggcttataggtaatgttctgtccaacaggttcaccttgccctctgcctagacaaacctgacttatcaagactggggaattacaatagagaaagagtaattcatgcatagccggctgagggagactggagttttattattcctcaaatcagtgcccctgagcattccaggatcagagtttttaaagacgatttggtggatgggggtgggggtgcagtgagaatggagtgctgattggttgggtcggagatgaaatcacagggagccgaagctgtcctcttgcactgagtcagttcctgggttggggccacaaggtcagatgagccactttatctgggtggtacccactgacccatcaagtgcacggtctgcaaaatacctcaagcattgatcttggtttttacaatagtggtgttatcttcaggagtaatctggggagggtcagcatcttgtagcctccagctgcatgattcctaaaccataattcctaatcttgtgcttaatttgttaagtccattttcacactgctgtcaagaactgcccaagactgggtataacggaaagaggtttcattgactcacagttcggcatagctggggaagcctcaggaaacttacaatcatggtggaaggtcaaggagaagcaaggcactctcttcacaaggtgacaggaaggagaatgaacgcaggaggaactgcccaacccttataaaaccatcagatctcatggaactcactcactatcataattcctaatcttctggttaatttgttaagtccattttcacactgctgtcaagaactgcccaagactgggtataaaggaaagaggtttcattgactcacagttcggcatagctggggaagcctcaggaaacttacaatcatggtggaaggtgaaggagaagcaaggcactctcttcacaaggtgacaggaaggagaatgaacgcaggaggaactgcccaacccttataaaaccatcagatctcatgggaactcgctcactatcacgagaacagcatggggaaactgcctgcgtgattcagtcacctccacctggtctctcctttgacacgtggggatgatggggattataattcaagatgagttttgggtggcgacacaaagcctaaccgtatcacctacaaatgcagtctagttcccaggcaagaagggagtttgttttgggaaaaggctgttatcgtctttgttttaaatgataaagtaagttcctcccatagttagttcagcctatgcccagtaatgaacaaggacagcttggaggttagaagcaagatggagttgattaggtcagatctctttcactgtctcttataattttgcaatggcgatttcagtgcaggtttttaaaggcaggggtaaatttcagtcaagcagaagttacaggcaaaattgtaaatcaatacattgagattacatatcaattttggcctaaaagggctgcatacgttgaagctggggctcacaggtcataggtagattgaaagattttctaatttgcaattggttaaggaagagaagctttgtttaaaaatcgggggtcaaggccaggtgcagtggctcacgcgtataatcccagcaccctgggaggccgaagtgggcagattgcttgaggccaagagttggagaccagcctggccaacatggcgagacccccgtctctactaaaattacaaaaattagccgcgtgtggtggcgcctgcctgtacttccagctactcgggagactgaggcaggagaattgcttgaactcgggagaggggggttgcagtgagccaagattgtgccactgcactccagcctgggcgacaaagcaagactctgcctcaaataaataaataaataaaaataataaaaatcgggggtcagcagaaaagaatggcatccctggcccatgggtgtgactccctccaggcctctctggaagacacttagaacaaggaaagatggtcagaattcagtccttagtcttcctttatctgacgtctatatgccagtggatccatttggtagggtcctgggtttctgaaaaacaactcagacatatatgctaagatgtttatcttcagtttctatagaaaacaaaacatctccagattctaacttccttggctattgttttaggctactattaccttcttactgataagttgcttattgacttttcaaggctagctaggtgcctagaatttcctttgagggaactcaagattttcctttatttccatgcttggggtgggggtctcccacagaccccaaaagggagtccctgtgttactggtggaaggtgtccaggttcttggtgttttgaacaaagaattggacaaaatgcacacacaaacaaaataagcgaggaaagaatgaagcaacaaaagcagaaatttattgaaaatgaaagtacactccatagggtgggagtgtgcctgagcataggggctcaggagccccaatacagaattttctgaggtttaaataccctctagaggtttcccgttggctacttggtgtacaccctatgtaaatgaagtagtggcccacaattagtctgattggtcgcagaaagcttttgcagttgctttctgcgaccaatcagatatactttcaatttctcatgtgacacacagaaaaggaggagggtttgcaaagggagtagcctccagtccttttgttacttatgtgtggaaagttggggtttttcttttgatttagttctaggaagttggccctaggttccctgcctccagaccatattctcctgcctcacctgatccatctcagcattagtaatttttttttttttttttttgagacagagtcttgctctgtcacccaggctggagtgcagtggcgagatctgggttcactgcagtctccgcctccggggttcaagtgaagtgattctcctgcctcagcctcctgagtagctgggactacaggcgcccgccaccatgcccggcaaattttgtttttgtatttttagtagagactgggtttcactgtgttagccaggatggtctcaacctcctgatctcgtgatctgcccgcctcggcctaccaaagtgctggaattacaggtgtgagccaccgcgcctagccgagcattggcaatttttaaagctttgcacctgattgtgataagcagggacggttaggaaccgccaggcctgttcccctctctcatttcacaattctccaaggattagtctggctgaaaggtacagaaacccatccaagcttatgtaagcacaaaacaaacaattactggaaggacagtggagtctcctgaagccctagggcattacattcatttcccagagctgcctaacaaattggtgcaaactggatggcttaagcaacagaaatgtattctctctcggttctggatgtattctctttcggttctggaggccagacatccaaaatcgaggtgtcaacagggccttgttccctgctaaggctctagaggagactcctttgcctcttagcttctggtagtgttagtgaagtagtgttgttgactggggtaaatacccaaggttcgttgtctctctccaagcagattaaggacacagacactgacatacagaggagtgagtttaggagtggaggtttaataggcaaaagaaagagaaaagggaacagctctctcggtctctctcgagaagtccctgaatgggaattccggcctgtggcagactgcaccaaattttatagacaagcttgaggaggtggtgtctgatttacatagggcccacagattggttggagcaggtgtgacgtttgcatagtgcatgggaaggctggccaccccaccctaatcttatcatgcaaatgaactttccacttgggcggcgccatgttgtcttctccttactgtacacatggctggcaaagagaagggagcgtggagccgccattttgaacatacctagaccaggtggccttttcctatgggcacagctgccagcattcacccgtgtaagcttccagctcccttgactatgtctacagctcgattttactggctgctccttgttagaaaagaaaatgatttgggggttgcttttcattaaaaggaaaaccttaccgaggacttccttaccctatctgcctaaataatttcttcttcactcctgtatcattagcagtagcaaatccatacgagtctgaagcaacttgatacttgcctcctcagaggaaataattccaccagcgggcataaggcagagtgagagaccgaggcaagttttagagaaggagcaaaagtttattaacaagttttagagcaggaatgaaaggcagtaaaggacacttggaagacggccaagtgggtgatttgagagatccaagtgcaccgcttgacctttgatttggggttttatatgttggcatgttccggggttttatatgttggcatattccagggttttatgtctctcctcccttcattttccctcagggcaggttgtgcgcatgcgcagtggcctgccagcgcttgggagaggctgcaaacacagtgtatttacagaagtcatgggcctgattatttgagatgtttttccctcaccagttgagtgttcctagaggaaggtcatataccagttagactccgccattttgcctcttaatgtgcatgcttgagcccagttgcccaactcctgagatctcatcgggaaaccgctgataacttcaggtgttttctgtctgttgggagatggcctttccctggcaccagctgtgaccaattattattttagagagacaattttaacaactgcctgacatcacctgatggttgcctggcattccttgggggggaaatcccctctcctttcttgctcatggctgcctggctacctactctaacagtaacacacacaattcttggcattgcttgccttctggttgcaccacttcaatctctgcctccatcttcacgtgaccctgtgtgtgtctgtgtgtcttctcttctcctctttttttttttttttttctaaaagacagggtctggctgtgttgcccaggctggtctagaactcccaggcttaagtgatcctcctgcttcagcctcccaagtagctgggattacaggttcaggccaccatgcttgggtctctttcctcttctcataaggacacaagtcattgggtttagggtccatgctaataagtatgacctcattttagcttaactattataattacatgtgcaaagcaacttacaaattactttggaaatagagtatttccaaatagaagagatataaactggggaaaactatttccaaatagggcacacatgaactttgggggtgccttagtctctgtggcttgctctagaccgggggcttgtaaacaacatttattacagttctggaggctgggaggtgcaagatcaaggtgttggcagatacagtgcctggtgacggcctgttccttatagatggtaccttctcactgtgcctttgtgtggtggaaggggcaaacaagctcccttgggtctcttttataagggcactaattccattcatgagggttctaccttcataatctactcacttcccaaaggcctcatttcttaatactatgaccatggaggttaggatttcagtgggtggcacctgtaggcaagtggaagatgatgggaaaggtatgtggcacacacgcacgtgagcagcattggccaatgacttggagacttgggctagtcataggtctgtgagctgacgcaggccacttgtgtgagtaggtggtttctcctgggagttgctgcagctgaggctggggaatgcctctattggtgagtgacagaacacatggatgaatggcttggagacagaggtttgcagatgttgggggcccagccagttgttgggtgattctggctaagatctagagagcagtggagggcacttgggaatgtcagagtgctgtcaatggttatttggagagtaaagtcacaccacgagctcctgagtgagcaggggtcctggtgagtcgatgggtgttggtgcgtgcttggagagggcagggagcggctctgcggtgctgacgagtgatttggggaatcagacccaacccacaagatttaccacggcaggagcagtgacaccatcatccaatgcaccaatggctgggaatggggagcggctggcaagcctattgcccttcttcgtgcagtggtggactcctggttaatgagagaaaccaactttctgtcctatccaaatattatgttctccttacccctggttctgcttccagatccagaaaaaatgatcaacgtcagtcgtgggcaggcagacaagctgtcccacattttttattctgaagggatttgagcagaaagagcccaagtgggtttaagtttttgcctcttaattttctcaaacctcatcttcagccctctctcttttttttattttttctctttggcatcctagcacttggtgtttgggacagggttagtgtcattggcatggatgattttcttctgataaattggtttaccttcaccaaagggaaaaaaacaactagttccctcccagcacccctatctgagcctctcctcaccccctgcctttgcagaagaccctggctttgtcatgaccatttactgaaggctctcagccaaggccaagcactccactaagccatttactaacactactgcatttcaaaattgtatgcaatttagtatgcaggatgtgcaggtttattacataggtaaacgtgggccatggtggcttgctgcacctgtcagcccgacacataggtattaagcccagcatgcattagctatttttcctgatgctctccctccccacactcaccctgccctctcaatttttttttttttttttaagagacagggtctttctctgttacccaggctggagtgcaatggtgcaatcataactcactgcagcctagaactcctgggctcaagagatccacccacctcagcctcccaagtagctgagactacaggaacactccatcacatgtggctaatttacagagaaaatttttgtagacataggagggtctcactatgttgcccaggctggtcttgaactcctggcctcaagtgatcctcctgccttggtctcccaaagtgctgggattacaggtggcaggcactatgcccagcccattactcccattttaagcctcactgtgtattttacagatgagaaaactgaagcttgaagaggtcaagttgcttctccaagttcatccagagggtggaagggcagagtcaggtctccaatcaatcctggccgctcagctcaagtgcttttttttttttttttgagacagagtctcgctctatcacccaggctagagtgcagtggtgcgatctcagctcactgcaagctccacctcccgggttcatgtcattctcctgcctcagcctcccgagtagctgggactacaggcacccgccaccacacccggcgaattttttgtatttagtagagacggggttccaccctgttagccaggatggtctcgatctcctgacctcgtgatccgcccaccttggcctcccaaagtgctgggattacaggtgtgagccaccgcacccggccagctcaagtgcttttagtggtcaccctctcatctgtctctctgtaattttttgttttttttttctttcttgaaatgaagtctcattctgttgcccaggctggagtgcagtggcgcagtctcagctcactgcaacctccgcctcccaggttcaagcaattctcccgcctcccgaggtggtggctgacagcctcccgagtagctggaattccaggtgtgtgccaccacgcctggctaatttttgtatttttggtagagatggggttgtttcaccatgttgaccaggctggtctgaaactcctgacctcaagtgatccgcccacctcagcctcccaaaatgctcatctgtctccttgttgatgtcttctttccagaaaaagaaaaaaccaaactgcagaagcagagagaggatgagctaatccagaagatccacaaactggtgcagaagagagacttcctggtggacgatgcggaggtcgagcggttaaggtgagtgcactgcgggtacccgatcactgggctgcaggacagcaaccttctgcttccttccagaacccatcttctgctcctgggactcacagccttgcctaacaggcatggccttgatccacagtctctggacactgaatcccaaggaaccccagccttctggcttgagaattcattttgtatataagagaatttcaaatctgtgcctcttgagggaatgttgttccaggaagtgaccagggaggagtcacatcccataatacatggcagagcttccttcacatcctgtcactcctgaaggcaatgtcttgaaacttctgctatcagtttctaccgaaactctgccacctgaactgacttgctcccaacctctgtcctcccaacctcccagctttgttctcccctttcccttccccttagtggcgccaatgcccttttctaagtatcagggtcttctctttgcatctgctgccttgacctcgacaaccacagccctggagctgcagtgtaaaaacatgttgtaaatgttgaaaatgtggaaagctgtacatgttggttcttgatttttgtttccttacaccagagcaaagcttttagggcctttcacaaggaaaaaggcccttccaacccagagggcaacttgctctttattgtctgtgttctcagagacctttcttcaagggtcctgggactagcagttccactgcccttcttcatgctgcaatggacttctggttaatgagagaaaccaacttttccctcctatccaaatattatattctatggtcgggtacagtggctgacgcctgtaatcccagcgcttctgggaggccaaggtgggtggatcacctgaggtcaggagttcaagaccagcctgggcaacatggtgaaaccccgtctctactaaaactacagaaattagccgggcgtggtggtgcatgcctgtaatcccagctacttgggaggctgaggcaggaaacaatcatttgaacccaggaggcagaggttgcagtgagccaagattgcaccaatgcactctagcctgggtgacagagtgagattccatctcaaaaacaaaacaaaacaaaaaatacagaaaactacaacaaatattatattctccttacctccggttctgcttccagatctagaagaaattatcaatgccagtcttgggcaggcagacaagctgccccaacatagtgagacccccctatctctacaatttttttttttaattaactaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctcttcaaggcagttcagcaagtctgcacccacctactttatcttggtgatccttggaagagctggggtgactcgctctctgagacctgcctcatactttgtgggagcacaggtgaatagggtggcttcaaaatacaaggtcaggagaggtgctgcctcactcactgaccccccagcagggtcctgtaatgtccctgcctctgccctggggtcacatacctacctctgggtaagcatttaccccatcattgatatgtgtctctggttcagagcaggttcaccagatacaacatatacatactgtacacgcataacacgtgacaacatacatgccccatccacaaagcctgttgcttaacctattggtttatttcattggttccttgatgctttccttgcttgctgtgtatcttcttttcttttacccatctactttcacagggagcaagaagaagacaaggaaatggctgatttcctgagaatcaagttaaaacctctagacaaagtaaccaaatctccagccagtgagtatatacattattcattcccctcccccacaaaagagaaaagtatatttcaggccaggcccacagtggatcacgcctgtaatcccagcactatgagaggccaaggtgggtggatcacctgaggtcaggagttcgagaccagcctggtcaacatggtgaaaccccgtatctaccaaaaatataaaaattagctgggcacggtggcacacacctgaaatcccagctactcgagaggctgaggcaggagaattgcttgaacccgggaggtgggggttgcagtgagctgagattgggccactgcactccagcctgggtgacagggtaagactttgtctcaaaaaaaaaaaaaaaaaaaaaggccatttcagagaagtctgggagccataaggggcgcaacaaaatgctttctagagatcagatctagagatcagatttcagcatgggatgacagcaggcaggaccagcctcacgggcctgcaggcagttgcctggggcctcatgcctgaccagcctcatgggcctgtaggcagttgcctggggcctcatgcctagaagggtgccatgcttggtttaatgttctcctgttgctgtctagaaattgttaatacgtttggaacatggggccctacattttcatattggattgaactctgcaaactacgtacctggtcctggtagttgttcctccctaattgcaaagtttggtgcatttcatagaaagaattgggtagctactgaggctcagggagctctggcctctcttaggtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtcaagaaactgtcttttctttgttgacccagcgtttctcaaatgtgtttaactgctgtattagtgaggcctctttcagttagaagaaatggatgcctggctgggcgcggtggctcacgcctgtaatgccagcactttgggaggccgaggcgggcggatcacaggtcaggagatcgacaccatcctggctaacacggtgaagccccgtctctactaaaaatacaaaaaattagccgggcttggtggtgggcgcctgtattcccagctactcgggaagctgaggcaggagaatggcgtgaactggggaggcggagcttgcagtgagccgagatcacaccactacactccagcctgggtgacacagcaagactccatctcaaaaaaaaaaaaaagaaagaaagaaaagaaatggatgcccaattcaaactggtctaagcaaaaaaaggaatttgttggagaaagagcaacaagaactagagcctcaaggactgaacactattacctcccctccttttcttctttttctcatctctgcctctctttgcatgtaagcatcattttttcctacaacacaggccttctccatgggaccagaaccctagaaccatagcttagcaactctgaagcaataccacaggttcttttccctggtatcgaaatacataagtctcagggaaatattctcacccgcccttctgggattatgttcccacctcttagatccattaccatcaccaagaggctgggggtactgggattggccaggaatgtataacatgcccactcctgcagccacagggacatgagctgttagaggaagagggacttgaaatcttgctgggaagacaaaaaccaaaagctgccactgtctataaaactacaaacccagttttcattaacatcctgtgaaagatggttggagggagtaaggaaagagaagggcaatgatctcttctgctggctcctataaccacaaggcacgtgatcactgccgaaggccagcatcctcagtggaccctttcatgaaaggcaaggtagaaaaactccacttagcagcatggaggaggagcaaggaaacttgccttctctattggattatgggtggaaaaaagaaatgattctggcgagaaatcaaaacaccaagcatgcaccacatgcaaggggccaactttacactactcatctggtactggaattccaagttgaaaaataaaaactattgtaaaaccagtgaaatctctgggatcctagcagatttagcaaatgcaaaactgctcagtagggattcttctggatcccatggtatacagtattctcacagaaaaaagcaacccccttgaagatgagccctcaataaaaatgaaaaacccggccgggcacagtggcttatgtctgtaatcccagcactttgggaggccaaggtgggcagatcatgaggtcaggagctcgagaccagcctgaccaatatggtgaaaccttgtctctgctaaaagtacaaaaattagccaggcatggtggcgcacacctgtaatcccagctactcaggaggctgagcaggagaatcgcttgaacccaggatgcggaggttgcagtgagccaagatcacaccactgcactccagcctgggtgacagagcgagactccatctcaagaaaagaaaagaaaagaaaaacccatgaagaactgaatcaccatgaggagaatcagtagatgcaccaaagagaatgtcctcccaagaaccaaaaatatagaactatttaaaaaggaaaataaactaagtacttttaaatgatcaaagagctaagagaaggaataaaacccaaaatgaaatagtaagatgctatgaaaaaagaataagtagacatgcaaaaaactggccttctgaaatttttttttatcaataaagtaaaaactcaatggattaaatacagagacacagctgaagggagaatttatacattggaagacagccctgagaaagttacacagaatgcagcacaaagagaaaaagagatgagaaatatgaaagagaagttataaaaccgagaggatagagtgagaaggtccaacttacatgtgataggcattctaggagataaaacagagaatgggaggtggaggtatctgaaaagacaatgtatgagcattttcaaaaattgaaaaatatgagccctcagattgaagtgacttgaacaaaatttcccatttatctatttaccaaatacttcttggatgtcaggccctgtgctaggcttggcaggtacaatgatgataacagctgactaggagaagggctgaaagttagggttggaagctgagcattgaggaccatataaaatgaggactataaaatgaggaccagctgaggatcatatgaaatgtgcatcagctctccataccacctgaacaaggcctggaacaagacctggccaggggttgcagtggggctgggctgcagatggtcagggctctgctcacctcacctctctctctctgttcctttctccccctctccctgtgcccacatcttgctgcaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatcatgccaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctacttgggaggctaaggcaggagaatcacttgaacccaggaggcagacgttgcggtgagccgagatcgtgccattgcactccagcctgggtgacagagcaagactccatctcaaaaaaaaacaaaaaaagtgtcttgggccaggcgctgaggcgggaggattgcttgagtccaggagttcgagaccagcctgggcaacatggcaaaaccctgtctctactaaaaatacaaatagctgggcatatgcggtggcgcgggcctgtgatcccagctacttgggaggtgggaggattgctggagcctgggaggttccagctgcagtgagccatgatcacaccactgtattccagcctgggcaacagagcaagatcgcaccccctggaaaaaaaaaatagtgtcttgataaacatctagggggataaggtttcatctgaattttttattttttccttaagataaactcctagaagtaaaattattgggccattcataagtagcattttcaaaatatttgtaaattggctgggtgcggtggctcgcatctgtaatcccagcacgtcgggaggcagaggcaggctgatcacttgaggccaggagttcgcgaccagcctggccaatacagagaaaccccatctctaccaaaaaatacaaaaattagctgggtgtggtgacttgtgcctgtaatcccagctactcaagaagctgaggcaggagaatctcttgaacatgggaagcagaggttacactgagctgagattgcgccactgcactccagcctgggtgacacagcgagacttcgtctcgaaaaaaaaaaaaaaatttgtagatcaaaaggtctttggttggacaggccctcccagcaggctgctagaccccagtcctcccactctgcgtgttcgcggctttggtctgcacaccacttcccaccattctgatgctgaaaagggtcccttgggctactcagtgccaccacaatggcctcagaggaccccgtgtcctccttcaccaacctagaccaatcatgaagccagactcttcgtgtactggggatgccataatgaatgaccttctactgggtgacttaaaacagtggaaccgtctcctttcacagtcctaaaggccagaagcctgaaatcaacctgtctgcggtgctctgctccctctgtggggaagaatcttcttttgcctcttgcagctcctggtggctcctggcaccttggcagttccctggctgcaccactccagtcttcacctctgtctccacgtggccgcctccgctgtatatgtgcctctgtgcaccctctcatcttaaaaagacaccagtcattggagtgagggccacccgaatgcagtatgatctcatttggaccctttccttaattacttctgcaaaaaccctctttccaaccaaggtcacattctgaggctccacgtagacatgcatttggggaggacccaattccacccaccacagacccctcccgctccaacgtgcagtgaaaactcaggctgcaaagggcccaccgccctcttttccccataaaaaatgtgggtcaaggctgggcactgtggatcatgcctgtaatcccagcactttgggaggccgaggtgggaggctcacttgaggtcaggagctcatgaccaacttggctaacatggtgaaaccccatgtctactaaaaatacaaaaattagcaagtgtggtggcacatgcttgtaatcccagctactcgggaggctaaggcaggagaatcggttgaaaccaggaggcggaggttgcaaagagccgagatcgcaccattgcactccagcctgggcaacagagtgagactccatctcggaaaaaaaaaagggggggcttggggggtccgggcgtggtggctcaagcctgtaatcccagcactttgggaggccgaggcgggcggatcacgagttcaggagatcgagaccatcctggctaacacggtgaaaccccatctctactacaaatacaaaaaattagccgggcgtggtggtggacgcctgtagtcccagctactcaggaggctgaggcaggaaaatggcgtgaacccgggaggcggagcttgcagtgagcagagcttgcggtgagcagagattgtgccactgcactccagcctgggcgacagagcgagactccatctcaaaaaaaaaggggagaggggagtgggggggtcagcgaggtctgacctcaggccagttatacagcagtcactcacagatccaacgaaccagaggagatcaaaccctcatcaaaatcctgcctctggtacttccgctaagctctgggtacacctactgtatgttcctgtaattcctactgatttttttaaaaaaagaaaacattaaaaaatccaatttatttaagctgtcacagacgcttccagattaccagggccaccttccaagctgggaaaccttgcagactgtggggtcctgcacacctagacttgctccttttagaagccatggaggaggttgataatgggaataacatttattgtagcttatctctatgccttgagcaatgtgctcacactggctggttccctcctcacatcagcctgatgagtcagatcctgttattacttctcactttacagatgaggaagtagcagtaaatccattacccttttcaagcggaggttgcaagaggttgcaagcggaggcagaataaacacttgaaacagtgagtcagatcctgttatcacttctcactttacagatgaggaagtggcagtaaatccactgcccacggtcccaggggttgttagtgacagagtcatcattcatctccctccctccccaccactgtagccccaattgttctttctcttcccatcggagggatttaaacaggtctctcccatttaaaagcaaacagggctggacacggtggctcacgcctgtaatcccagcactttgggaggccgaggcgggcaaatcacgagatcaggagattgagaccatcctggctaacatggtgaaaacccatctgtactaaaaatacaaaaaaattacctgggcatggtggtgggcgcctgtggtcccagctacttgggaggctgaggcaggagaatcgcttgaacctgggaggcagaggttgcagtgagccgagattgcgccactgcactccagtctggagacacagcaagactttgtctcaaaacacacacacacacacacacacacacacacacacaacacaacacaacaacaacaacaacaaaaaaagtgtcctcttccttttagagaatttaaaaaacagggtgaaaccccatgtctactaaaaatacaaaaattagcaagtgtggtggcacatgcttgtaatcccagctacccggaaggctaaggcaggagaatcggttgaaaccaggaggcggaggttgcaaagagccgagatcgcaccattgcactccagcctgggcaacagagtgagactccatctcggaaaaaaaaagtgggggcttgggggttccgggcatggttgactgtgtgactatattatatctatacataatatatagatatatatctatatataatatatagatatctatatattatatatagatatatatctctattatatataatagatatatctatttatatatagatattatagagacatctatatctatatctatatataatatctatattatattacgcctgtaatccccgcactttgggaggccgaggcaagtgaaccacttgaggccaggagtttgagacgagccagagcaacatggcaaaaccccgtctcaaaaaaaattagccaggtgtggtggcagcatctgtaatcccagctgttcggaggctgaggcatgagaatcgcttgaacccggtaggaggttgcagtgagccgagatcgtgccactgcaccccagtctgggcgatagagtgagactctgtctcaaaaaaaaaaaaaatgtatttcctgattcttgccacacctgcccttgatgcatcagactctggctgctgaaataccaagggcggcgaccctgcagccccagtgtggatttgtctgcacttgctgataccagaaactgcagtgggggcaggtgggtggtaggagcgggggttccctcatgcccaggccctgcacctgggaagcctttggaggccatcacatgagctgcctgaggcggatggaagagacggtgccaagcaggcccaatatgttccctgctggccctggtactgctcccctgcggatgctcctggttggttcaccacctcgtgcggagtgaggagctgagcagcccagccactgagcaggatttccctctaagaacggccccttccaccctgcaatgccttcttcctctgcacctcagctcccccacttccaaggcgttccttcccggaacgtgtgtattcttctcttcatcttgctaaggaaagttctggctcttggtgctctggcttggcaccttctaagctctctagcccttttccccccgccccccccccccccaaaaaaaagcgttctcagccaggcgtggtggctcatgcctgtaattccagcactttgggaggctgagcccagaggatcacttgagctcaggagttcaaaactagcctggccaacatggtgaaacctcatctctactaaaaatacaaaaatttgccagtgtgatggtgcacatatgtaatcccagctactcgggaggctgagacaggacaatcgcttgaacctgggaggtggaggttgcagtgagctgagattatgccactgcactccagcctgggtgacagagtgagactgtctcaaaaaaccaaaaaacaaaacaaaaaaccactcaggcttagccatttctctggggtcttcatttccttatgaagactctcgcaaaactggtatgaagtaaaatttgtttgcttttttcctattaatgtctttgtcagtttaaggcccagccagggacactaggagaattgaggaagttttgccgcccaccgcccccccccccagcaatggggacagcaggtgggtggaggccgctgagggcttctgcgccatgactcaccctctgcccatggaagcagctagaaagtgaaggtgaatcccaaagcgcaacgctccttctggcaaagggaacagagagggaacagatcttcttcaatcagcgcagccccctctgctacggacaggtctgctctcccccagacagctgtcttctaggcccccacctctgaatcaccttcctaggtgggaaacaaacaaagataaatgcaaagccaccgttccagccccagtccacacctaacaagacctcctgacgccgctcaaaaggggcacgatggctactcaactttttctgcacaaatttgccatcgtgaaatgtttggaaaggtctttagcagcttttaacattgctgaacttgaaaaaaatgtcatcaagaagcaatttactcaagtctcttctgggtccttttaaattcttgccagagggtgctggtggcaggggtgacggggtaatggcggtctcaggggatgggagggcttcacaactgtatctgtggaataactcttttccaaattggcttattcaaaaagcatgcttagcagtgaccaaaaacgagacagcgggcacgctggatttctttcacaagaagagagagcctaggaattaatagagttttctaactggaaggtttttgtggttactgtattttcccacatgtaattataagctggaacaaaggctggaaaacttggaggatcctgacgacgaagggcccaccatccagccacctgcttcggcgtgtgctgagtttaaaaggcctctaagatgtagacggatttactctccacctcacaattctatttccagaaggggagagaagttgaggagacccaaaatgaaagatggcagaactgtattggtttgtaattcctccccacagacagacagacagacaaaaccactcacttgggaaactcaaaatagatgctcgcttgtaaagtttattgacaactgtttggtcccaacacacaaaacagcacttgaaccacaacaaaagtgttcaaacaaagtagacaactaagaaaaacatctctttcccccaaacccaatccaaaacaaacagtgcaagatgggaaagggggttttggtgataacttttgtcatttttttaaacagataaatttaatccggtatatctttccacccagaaataaagaattacattgtcttaatgctcaaacatcattttaccacatcatttaattaagcctctggataaaaaaatagatagcaattggactggccattgtggagtacattatgaacacaatgtgcttccgaagtcttctctctcattttcagacagcaattgttaagagtcacacacacgtcccagacctaagcagcaactccagtgaatggtactcagacacactcacgggacagcacagaacttgattcttctttgtctgttgcccaaagaacctgttctttgagtctgttccaggtgacttgtaatgatacctcttacggttttaaagtccaccactctttacatgctagcagaactgaagtccaagcgtgcaaactcagccttatgaaatcttagaataaggcaactgatgttctcaacaccaattattattactttgtttaaaagctcctttaaaaaaaattgcacatttgcatttcacttcctgtaacactatgtctgtagaggaaatgccttcaggaggattcggagagtgccataatacttacagggttttttccatggtgttctgtcttgactggggccatgtgttgagaactgggagtcactggcttcatttaaaagatttggggaacaaaaaatctgacttgtaaaaatctctctatagcccttattttgtggcattttatcaaaatgctatgaaatcagagtccattttctggctttctagaagttaccaaatataaacatttccccaaaagaaaccatctaactagtggaagaccttacgccaacaggttctttctgctctatgaatgaatccgccttttttgccggacaaatacaatccattgtaaatgtcaggtttctctagaggggggtgagaggccacccgtcagcggacacctcaggcacctagagaggaaggccattccacaccagacgccacaagaaacccagagatgcttccaacagcgagaagtaacgagagtaaaatcagacacgattaaaagatgctgagctgacatacacacacataaagcttcccagctaccgataccagctttaaaattacaataacaaggttaagtggatcaaccttggccttcctatgtgtaggtagaattcctgtctcttcccagtggaaatcgtattgatcccgctgctgctgaagcacctccccactcagctctgatttgtaatttatgcacttgatgcatattttagaaaatcaggctctttccaatgctgcctctcgacacacaataatgtgtgttgtaatccaaatgctgactttaaatccatgacatcgagaccatctccttttccttaacctaacccatatcaaactggaacacagaagggaagcttcaaacatcctcaactttctagaaagctcctaaatggaaccccaaagtagaaacgtttaaaaaaatttgtgatgaagccacttttgtcaactacagacatagtttaaataaaaaacaaggcacacttacaagtcacatggaagccaggaaccttcacattccaacctgaaaatacactccgaacccctcgcctacccttctcctttggtgtgtgaacacacaggctagcgggacaggctttgcttcaaagacatgccacgcactgggttaatactgtcggaaacaccagtaagcaaaggctgagagactctattatgctacatgtaggatgacaccaccgacgtggctcaatggaagcaaaaccgcttcctgctagttgagtttttagtgctttcttcttttggaacaccattgtatttcataatagttactaaaaatttggtaaaatatattaaggattctttaacaaatgccacaagttcttcaaataattgaaaaaagaaagaaaaaggaagaagaaaagaaagacttcagctcaaagctgtgttcaatggaaaagaaaaacatgatagaacacaggtaagatgaagtcaatggcttcggggggttttcatgacacagaaaaggatgtatttttgaaacccacttttgtgtgcagaatcagacagtgttttcccatcctaattctatattccaaatgggagttaaagcttggttataggtgctaaggaaaagttggctgccaatttgactctatttttgggttgctttttggccgggctttccacggggtccttgctgagcagtgactcggaggtttccgaggaggggcagggaggcacggggacagctgctgagatgcaggacgagctggagtcagaggtcagagttttgctctttcctggtattggaatctccattttttcttcttggtttaaaatcataatttctgtaaacacagaaaagcaaacagattcagatccaggaactgtaagaagtgtgggttttctcttccttgctcatattttctcaaaagataataatagtaataaaaagcttctaaatgctacatctatgccacagtttacatatgagttgtgtggccagtgaacttggcacagaaatcaagtatctataaactgcatcccacctctcccactggattacaaagttggaaagatctctattttgagctataaatgaatgagcaaaggttaaaactttttgtttttccattttggattctctgcccattcattctgcctgccagatattaaggacccataaagctatccacgacttagagacttcctgaggcgggaggccgtgggtggtagggggtggggtcggagcatctgggtgtcagggagctcctggcctgctccatttagagaggacctatgctccccatgggtctattaccggggataaggaaggactacgcagagtgagaattaccctcagaacccaggaagttgagcacagccagctttcccacagtgcttctggactgccatttctgtggctgagccacatgtaattcacctgctctacacacagggccacgctgcttgaaagagatgcatcattatgccttagactcccactgcatagggcacagggctcctgctcccaaaggcccatggaaggtgagagtggcagaggggacagcagagccagctccctgcctaggctgaccctcaagagaagagcggctgacagaactgcccacagtgttttaattattttcctctcttgtccggtgcatgcagttgaacttgcccagactgaaggcacaaaggccacaaccccacaaacgagctaacatcaatgtgccaccaaccctaggggggcactgcacaggagcagggcatggtctaggtctgactgcacaggctggttctatccgcaggcagttacttccccatctcctattttccaagtcaacagcctcagttcttttcctgggcaacagtgctgaacgctgccaagaacaaccaagatggtaaaagccaagccaggagtccacgggttgttcctggtgacctggaaagcagcaccagcagtggggaggagttgggttccaacagatgaagagcagggagggatctgtacagggcagatgggccatcctctccagaggccaggagacaccgcaggacaagagggcttgggttccaatgccggctctgcccttgctagcccagcagcccggggccactgcctctctagtgacggcaccagctgtgccttagtcacgcagcctgtggaataaagcagctgcctttattccacggctctcacctggagccgtggtaagagttaaatgtgatggtgtctgtcagccctgagcacagggtcagtgccaatgcctgcactaggctgggactcagtgtgctcagcttcctgtctgttatatcactgggcagagtccggggctccagccacagacacctccctccattcacccctttataaagcccttgggccctctggacccccaccatgggtgacgtgtacatctggtgacaggtgtgcctgagagcagctgaaccttcacaaagtctgggagagcagaagcccaggaggccccacccacccctgtggactcgcccacagccccgagccaccagccctccagagctgccaaatcgcccttgcctgatgctcgccaggcaacctcaggctgtgcatcccattctgcaggaacccaggtggggaaagaaggtcgaataatcagcacagtgttttccacctgaaaaggggtagtcccttcccacctccgtcatttactatatcagtatctcatcgtggttttgttttaaaccccgaagaaaatccccatgacaacatggagtcacccaccagaaggctcttgagggcgctcctcaaactgaatgagatcagcagattggaggataacggggtctggtctcagctgaggggacggcaggcacgaggggacaggcgcacacaggaggtcgacgggggagtcgtcggtcaggcggagaagctcctgctctgtgtgactgggccctgggcaaacaaggagggccgtgacaccacaggacctccacgcccacccccagcacacaccctgggctcacacctgaagttttccttctaagccttaaagataagagagtcaagaagtatttaaggtattaaaaaaaaaaaaaaaaaaaaacaaaaacccaaaacccactaacaggaagatcctggtaatggaacgccttaataagctagttcttctgaagatccgtgttcttaggaacactggcccctcaaaagacccaaccagagaaaagggtcctgcagtcagcttccaaagagaagggacagcctgagacggggtgtacgtagttaacagcaagtggaagctcagaatccgaagccctgggcctggttccgtggcttcctagctgctgactctgggtgagctgtaatacgtgactgcctgagatttccgagcctccgctgcacaacggaggtcagcactgctgaaggctgtggggcagcttcggcagatgattcccaggagggcgcttcataaaacgtcaaatgctgtgtaactcagttatcctaagggcacaggggacggtaacgtgctatctcgccgcatgttatgaagacaaaattctcacctataacgatgaattcaaaagtccttcagaaaagttagaactgctataacattccaagaattggcctctatctactacagaggtggatctatctgaaatctatgtgactcagtgtaattttgggtaatattaatgcattagtatatcaaatcctgcctagggctgtcctgtgacaaagacgccttgaccagccatgagtcaggcaccctgagccctcttccggatcaggcctgaccttggccttccatgtctgttgctgaacttgccggctcgctctagagtcttagcttgagtcagtttagtgagaatcccctcacccttcacagctgatcgaattccttattcccaaccactgatgtctagatccttggctggcctgcatgcctatagcaagaatcctcttagtaattttccacccactgagccctcactctgctcctaggctatgtattgggagttggctctctctcccctgttgcaagtgtcatgaatatccattataataagtgtcggaataatttttttcttcaacatctgaactggggtaagatgatcattatgggggtgccaacatccttcagggactttaaccagtcaaccatgcaatgctaacagataaaggtcaattttatcctgttactaactaaataccaaaactgctttgaaaaatgtgtggctatgtaacttcagcagattggatgacttgctggagtcctttccctcgctctccccgaccccaaagccgtttctcctagaatttcacaagctcctatgtctctgcttttcctctcttaccactgccgtcagctccaagcttgagttccgaggctgtgtgcgattcgggcacctccaggatgcgctcgccctccgagggctggttttcatgattggcaggggagagactgagtgaactcaaacgacctacaggacaaagagcacccgtcagagagaaatgtcagtgagagaaccgtgattttttaaggggggaggggatgggtgcttacttacttttcatgtcattttttaacactacaattctcttatgaccatgtccttttatccagaccacctgcacacaagacatactactggttaagcagcggaaaaggaggggacagaagccctaacattcaggaagagtgtgacctacggagcctgccttaggctagaatttaggagctgagttactgccaagaagcatgtttctctactctctccttagcttttaaagcaacagaagctgacagaaacatacccctataaaaagcagagtagttcaaaaatcatgagacacagtttcagaaatatcctttataattcttaaaaagactgtcttccaaacaccagctttggcatataaattaaggtagttctcacatgagagctctttgccatttttttgcagaaactgaacaaccacctaaaagaattaagagcaatctctcagaccctttaaactaagttcattatcagcatcttaaagtcctctccctgatggtgccgctctccatctcagccaagcagagtggtagtagtggagctaggctcccaggccccctacatgtgcacaccgtcgccaggtcactgatctcagctcccaggcaagctttgcctgggtccttcctacttcctctattctactatttttactctggctcaatccctccatctaacactgacccagacctctgcagtggccaggatcctagcccagttcccttctccatgcctgcttctctcggctctaccatggacagcaccactggggtgcttttcaaatgcaaacctgggctccagctctctccaacacagtcctccctccttacctggaggagccacgccctccctaaccgagctctcagctccctcttagcctctcgacactccatgccacttgtcacaaccctgcatctgctcatgtcatcatcccctttgcccagaatgctctctcccctccttgtcacgtgcttccctcaggcacatccttgaaggttttgcaacaggctccccaggcttgggaagtgggccctgacacggccctcctcagcgcgcccactgccctgaccgccctgactagttgcctgcttgggggtcttgactctcccattaaccaacacctttctagagttacagcctgaaacttactcacctggcatatagggatttaataaaggtttacagaaagaatcaaggagaaatgctaaaatcatttactttagaccaacagtatgttttgaaaggatcaattcaaaatgcctgccgttccattattctggcagcattttatttttctgttcaggacagttagcctgtggctgttcagaagatgctctcccggaagctgagaaaaatgcccacctgtggaattgctcccaagagctcctccacgctgctgtggccgtaggtcttgggctgcagagtttctccgacatacttggtataggccatggaaaactcatgaaggaaaatctgctggtagtggtaagtatgaagtaaagaccgcacattctttgcaaacaaatacagacttgtgagcttcacacattcttccatcttatcattagtgaaaacctggttaaaaagaaaacgcagcattagaaatattagtgactggccctgccccgtggaaagtgaaggcctcccactgagggaaaaggcccagagttgaagacgaagacaaagaagaaaaagaaggcaacgaagatgagaagatgaagatgaagaaggagacaaagatgacgaagaagaaggagacgacaaagataaagaagacaacaacaaagaagatgaagacaaagacgacgagacaaaaacgaagataaagacgacaaagatgaagacaaagaacaagaagacgaagacaagacgaagacgacgatgaagaagacgaagacgacgataaagaagacgaagacgacgaattggacaaagacaaagatgaagaagatgaagatgacaaaaaagacaaagaagaagaaaggaggaggaggaaggaaagaaggaagaggagaaagaaaaggaggagggatatattcaaggatttcctccaagagaaggctatagcctccagcaaacttcagttctatttgcaagtcgaaggctgcagcggtctgaagagacagtgtgtgagtagggaagaaatcgggggaggcaaactgtgttggcaaatcacggtacacacagtgaacactggggccattaaactgcacctccaaaccagttttccaagaaacactgtgataagaggatgacactagcattctttaaaaacacatcaaaagcaacaagaaacaaacacaaaacccttgtgtatgcagggtaaggaagcagatttctttaccacaaaccttttcaaagtgtttaacatgctatggaatcgccaagagaaaggatattcccaatcttagctggacagggaaagtcctttgtcctgaaatatgcattaacacctgtccagaactggtgttcttaggatagatattaacagagtttagaaaatgctggatgtatatcctttcattatttaatgatgtgtcccacagttagatgataatggcatatcattcttttaaattgctggagctcatttgttaatatcttatttaggatcattttaagggactatcttatgtttttggtattaaatttattttggcttcgtaaaaataaatggtaagctttccttttttctttttcagcagcctagaacagtattttttttcttggggatgggttcttgctatgttgcccaggctggcctcaaactcctgggctcaagtgattctctagcctcagccttcttagtagctgggattatagacgtgtaccaccttgccgggccccagaatggttttttaaaaggtagatttatctgttcttttagggttggttgaaattcaattgttatctcacttggtcctgatgcctttttcactggtatatttcagtgatcttttatagtctcttttatggtaattggtctaatttttaacttcttgagtgaattttggtaacttattttttccaggatttcatttatttactctaggtttttatatctgtcgcccgagaattgcatgcagtattctcttaagattctctcaatcttggagcgccattcttgaaaggctgcctgggggactggctggccaaccttcctttctgccctcaccttactcatctctctcttcaagccaccacataaaccatctcattcagaaagataaaacagtagcgaaatccatcctggaatgggacaaacacaccccagagccaggatcaggagaccaggctttcatcctagaacgggacaaacacaccccagtgccaggatgaggagaccaggctttcactggcttctgccacccatttaggcagggctgcttcactgcctgaggtctcggcgtgttcatccatgaaatggtctctcgggtcccttccagctctacacactctaatctagaccatcaggtaatccggaaatgcccaatcgatagttttcaatgatagttctaaagagccattaacgtgcctacctcaaccaagtatggcaggctcttcagcagttcggtcaaggtcatgaatccatattcacaggggttaaggggagtgttgtgggtactttcgtaatgtctcttgagctcctcaacagaaagatgggtggttccttcccaagacatcaacaataccagcaactgggcagtgagagatcgcagagactttcggttgatcagctgaatctgtctgccagattctatatcggcaacctggggaaaacgagaattcacacttttcagagctcaagagagacaccctaggttatacccaactcagctcacttcattttggttaatgagaccaacagatgaaaaatctctaatttttttctcttacactgaaataaagcaagtgggtttgtttttagcgtctttgggacaccagaccaacatggaagcagaaactgtcctccccctgccggtccataactgaaaactctcaacaagataataatgggggaggaaattgcatcattctctttatttttcattcattctttccaaaccccactataagaaggacacagactggccagctgatggccagtggtccaagcttgtgaagtgtgggttgctgtgctcgaaggggggtagggatggggaggctagactctaagcaacactcacatggcttctgtgcagacccgacttgcccatatgcgtccccagggcgggctggggaggtgagagagggcctactctgattacaaggcaagctgcatttttctagtctgctattactcaccacaaagctggtattttcatctgactagtaactgtccactcctcaattatttcagattctcaaggagataaagggtttaagcggttaaatgcgctgagagggaaaccttacaaaaaagacagagattgtcacttggggaccaaacaccatgtgaagaaacacgcatctggtgactgagccagcaggctgtgggtggcgagggtgaggctgtggcgtgagcctttcctggcacaaaaacaggcagagctttggcacacacacggctccggcactgctctcacaaaccaatgctcatcctgacagcttgtttgccccctttatctggttttcctgccagggccaaaggtcttggcagggctaagtcaccacaagttggcactctttggaccgtggattctgagaggcagagagaggtgggtggcacttgaggagccatcccaagaccagggcatctttatctggttctgacatgtgcccagagccaaggcaggagggaggctggcagggtcccaccctacttatcatgattatgggactgtatagatttcctcctcagaagcgggtttaatcaaccaaccgatacaagtccaggggatcccagtcatcttagccacccagacccccaccatcactacagctgcttaggaaagaaaccaaaccagagcctgctcctctggtgcgacttggatccatcccttgattctcaatcccggctatgcattagaattgcctggggagcttttaaaaacaccaatgctcagagtgtgctgggactaattctataagaatctgaaaggtaaggttggagaagctcccaggagacccagtgggcagccagggaggcaccacggagcctctctcagctctccccattcttgctgctcacaccccagctgcccacccatcacactcacccagcaaagccctaggtcatggcgtggggtcttcctatccacctgagtccacccctttcatcatcctgggcaactgaacacccagggacctgtcccacaccacagccgtatagcctttcaatgccttgcctctgtcatctccgacgacatcctcctgtgttcaatttcactgcagacacccatctccagggtcacagtgcaaacctgtcattaccccatccaacataaatcattcaaacctcctgagcatcccacttgcaaaagcaagtctggagctgctgttggggtgggagtgcagaaagagactctacccgctcaactccgccccttctcaaacctcagcagcatcactgcctcctatctgctcccaatttgccagcccactcccttgcttcactctcctcttttgtcatgctggcactgacattcttgtcaatatttaaattcgctcatcccatgccttttcctgacgcccatcggtaaactcccaccttgaatccaaccacctgctttccctgaaccgacacctgcatagccacaccccaactgctgctctcccagagtctacggtgccaacttgcagtgagctctcgatacccctgcactccacgtgacatcctgatcaagccactctccactcaccatgacaactgtggaccttctccccactcctaagtcctgagccctgcctctcctctctctctctaagcagagatcagtccctctctctagtggaaaaccactcttggaagaggactcccttctattcctgatgataaacatcagacctgcccatgcctgcccccagcctattgccctgtatacttcctccttcctctgtgtgctgtttcctagtctcccacacctcaaggccctcctgtcttaccccttctcgcccttgtatgttcatcttctctctctagacagatccacatcaatggctttcagacatgctcaagtttttccaggtaggaaaaccaacagcccaaatcctcccttgctccctcagccccacagcctctagctgctgccacagccctccatcttcacaagcagacaaaccaggatgctgtccagatgacctgggccattttctcacctctcctcactcctcaccacactccaaggtggcttctgtctacacaaccaacactgccactgacctggccagcagcaccgactcttcccactgagctaaacctggaagtcaggcagtccctctctgaccagccctcctgcgatgctgctggccattcctctgccttggctcagggatgttcggctctcctggttgtgcttcctgctctctcacctcctcctccaaccaatcagtacctaaggagagctctgagcgttcctacctctgccaaggtaagaacgtcttcttagctgcagtccaatacattaaaaaacagtgggggctgggtgcagtggctcatgcctgtaatcccagcactctgggaggctgaggtgggcggattacctgaggccaggagttcgagatcagcctggccaacacggtgaagccctgtctctactaaaaatacaaaaactagctgggcgtagtggcgggcgcctgtaatcccagctacccaggaggctgaggaagaagaatctcttgaacctgggaggcggaggttgcagtgagccaagatcgcaccactgcactctagcctgggccacagagcaagactccaactccaaaaaaaccccacagtgggaaggaaagggagagtgaacccgttctggctgtttacggaattaaatgacacagaaatgtgtgcagctagtaatgggcctgtaactgagggtgccgtccttcatgcttccctttccattccttcctcctggcagtgacttcttctggtcctgtgggggaggaggccgaaaactggcagctgctctgcctaggacaggaagggtcaagtgcagtccaggacagcaaacagcacgagctgccctctctactacagctctgccagtgacaaaggccactctgcaccctcgcttgctcctaagcctactcctaagtgggtgagaatgtggagggagaggacactgtgtgattacgggctcccaagaacgtcacaggcaaaactcacactggaaggagtcaagctcaggccagcagtgctgaggcagctgcacctcatgaccgaaccctggggtgaagagtgacctcatcagttcacaaaggcattgctttggcaaggccattcagaaacacacaagaggaagaccaaaactctcaacttccaaaccaaggcttctattacctaataagcactaatgacacaaaacgagtcataatgctgtgacagttaagtagttcaaggtgtaaataaagaaacgctacagcacacgcaaacgtcctaatgagaattaggtcactgtgagttttatcccatgagggaaaaaaaaaaaaaaaaaaaaaaacatttaccttcacgacatggcagagtttctgagttaaagccgaaatggaactgacatcatagtcttggagacgaaatgtataaccaaaagttttagcatattctgtaaggagatctgtcatcataaggcagttatctttttgggaccgaaggagtttaacaaactgggcagctagagctttgaaccgctccacctctgtcagagtaaggatcttttcttctccacattccaatacctttgaaaacacacggggggaggaaagggaaaataaacaaatcacgggtgtttacagaatagcaaaaaaagtatgcagctagtaatgaaaaaacaagtcagcgttactgaatgggtataaagtttcagttgtgtaagatgaaaaagttcagaagatcggttgcataacaatgtgaatgtgctgaccactactggacaggagatataaagatagttacgaaggtaagttctatgttatgtgtattgtgccacaataaaacaatttttaaaaagcacttcagtagtaaaaaaagaaaataaaatcaacaacagaaatttggtttaacttagcaacagcgaacagcttagcactgatgttacctcatgtactcagacctaccttcaacacgaaggattttaaaagtataaaagtaatgaacaaatattcagtgtaagaaatcagcaggtgtggtggctcacgcctgtaatcccagcactctgggaggctgagacaggcggatcaactgaggtcaggagctcaagaccagcctggccaacgtggtgaaacaccatctctactaaaaatagaaaaattagctgggcatggtggcgggcacctgtaatccccagctactcgggaggttgaggcaagtgaactgcttgaacccgcaggcggaggttgcagtgagccaagattgcgccattgcactccagcctgggcgacaagaaagaaactccgtctcaaaaaacaaaaacaaacaaacaaaaaaaagaaaacctactgaatctttttttcaataattacccccaaaacaagtttgaataatcctttattgaaggaaaaagccatatttatctaaaaatactaatgagtcaggaatatggcttctctgactggaatagcttagattttcatcctctttcgtaactccctacttcccagaaaaacaggtctggaacgtgaaaaagtatttcctatacgttgttcagaaaaatactttataaaattagaatttcttcactcacttgtaaagtatcaggtatggcttcaaaaagttcaagtagtttggtaaacccatagtacgcaagtttgcactgccggccaaagtggtgatggtaagaagggataaatttattaaagggcatccggaaatggggttggtgacgcagcaaatcaacgacatccttggagaactgttttgtcctttctatttcatcctgagtgcgttcttttaaaaaaaccaaaaaacataaaatcacagtttttttctacccatttgtgttcaacatccacactagagtaaatccttttgggaatttataaacgatatcatccttgccttccaaacacacacaacctaaaacaaacacatatactcttccctctttgcaagtggttctcaaacatgttccagggcagaacaccaggaagttatgatattattatattatgaaattcatatatattcatcttataagctagaaacaatgtcatcttataagctagaaacaattttctagcccctgccccatatctattaacatgacacacacccaggtccctgtacttaagcaagtactctagaaattattcccatgaaatcacgcttctgaatatccccactttttttgtttattcatctgatcttcagttaaaacttgctagcagaagagagaatcaggcttcaaaagttgaacaaaaataaacaggagggaaagcttaagctgagattgtttctattaatttttaagtgagaatgggccctggaattctatgatttcatggacatcaatgttctgcaggagcaccgtttaagaaccagataatagaaggaggatacgaccatacagtcaccccttggtgttctcaagggatcgggtccaggaccctgcctggataccaaaatccgcacctactcaagtcttgcggtctgccccgcggaaactgcagacacgaaaaattggcccccagtatccatgagtttcgcatccctcaaatactgtactttctacccgtaactggacctgtgcagttctgacttcaactattaaaatttgaaaggcaaaagaaaaaaaaacattcgagttgtcttcccttctcaagtgtgcacagtaaataaagtagctcagagttcaacagaagagcaaagccaacaggcacggtgacagattctcaactggatgactaaggctcatgtagccacagccaggctgcagaaggcatttgagcaaagtgctgatgatgcccctttttccccttagagtcaattctaaaaagccagcctgcttttgttcttgagaacagcttcacctactttgaagaacacagaatccaaagagcagcagttttcacactgtgctttctgtggaatcttcaggaagcacggacagggagggaaaaccacatcttccatgccacactatgttaaaataacaggagatagacaatatccttccagcaaatgttaagtcacatacctcttttggggatacaaatcaccatttcattatcttgttgggacaagcagatggttgtgtctggaatctctgatacgatgtcaatcaactcacaaacaccatattcagtgacatcccagtcctttgagaaacacctaggttttaacaacggaagtggatacggaatgagtagtatcatcggtagaagaactacaagttttccggccgggcgctggggctcacgcctgtaatcccagcactttgggaggccgaggtggacggatcacgaggtcaagagatcgcgaccatcctggctaacatggtgaaaccccgtctctactaaaaaatagaaaaaataagccgggtgtggtggcgggcgcctgtagtcccagctactctggaggctgaggcaggacaacggcataaacccgggaggcggagcttgcagtgagccaagatcgtgccactgggcgacagagcgagactccgtctcaaaaaaaaaaaaaaaaaaacaaaaaactactacaagttttccaaaagaatgcttaatagaaatactagataactatttagagtttggcagaagataaaatgtcctaaaatatttactttcatttctgttcttttcatcaactcaccagtgataagcctgtgagaattctctcacaatgacctgtttgctggcctgggatttgagaagttttagtaaatcctgagtaaagcgcttcacctgggccctgtgggtaagggtcagcagacgtttggagcccattccaagaatctgcaaagcaaatagtttatttatacacataagacctcagcagacagcgacttccttgctgctggctcaccctctcgttactagcctcagagcatgactccctttatgtagaatgtgtgcaatttgaaacacatgtcgatcaacaaaatgtagttggtcaaaaggaacaaatgtccaaggccttctgaaactcttatcgtttttggcctggcacaccttctcccaaacagtcgttgagtataaaaatgaaaagtgtaatcttttgaaaagaaaagtcgtgagtacagaaatgaaaactgtattggttgtccagacaaattggtctacaagtttttcaagccgtttttagtgagtgggaagctgttataacactgtgagttaactggtaaaagtcttcataggatccagtgctacactctagcccagtaacttgtctccaactagttaaatttagaagaaaggttaagcccttgactctcacataggcaccaacatacaagtatgtggctattcatgggagcttccttgtaatcatgaacagttctggagaaagctgtgctgggatgaagaaggtctatagagcttagagggaaaatactcctcagtcctccaaggagttcctctaaaactggaaactagcagcgttctgaaaaattgagaagccgcctgtgtgtgttattcctgccctctgaagaaagtttttagtggatgttctgcccagaactgacttcttaggaattaaactgtttctttgatggaggcagccaaagccatggaggaacattcctgcctgtaaacaagtaatcccgtgacacgccttacctgcaatacatgaggcactgcttctaataactcaatcagcttggagtatccgtagtctgacactcggcactgctttgcaaaatgatggtgataggatgggatgaaatgactgatgggtatgacacaagatggctggcttttcagcaagtcaatcacttctctactgaactggatcagctgggggttacctacaggactcttcgaacgcagaagccaagggtctagaagaaaaagaacgtgtataagacagaaagcacagatttcaccagctgaaagaagggaaaatggccctgcagtccctggcttgagttcgatcatggggaagcaaacaaaaccaaatacagtagctgctttacgtctcagtttctatattcaggtctcatagtccaataactagctaactaacttattcacgggctgtcaaatgctgtcccactaatcctcaaagttaagcggccaaggtaaagcagagtctactatagtgttatttatagcagaagtcaaagtacacaagaagctcccagtttagaaactagttatatttccaagatccttctgaaacttggtcatgtggaacgtacctttccacaaagttataaatggtcatcaggtaggtggcccagaagagcaaaattaatccatagtggagctgaaaacgttacccagaaaaccacagaaagtgataatgttgtaagattagcatgacataaaagggtgtaaggaacaggtttttgcaccatcttgactgcttatacctattaaaaaggtataagtaatcaaacggaaatctttatagaaaggtggagaggcttgctggtcgcggcggctcatgcctgtaatcccagcactttgggaggctgaggcgggcggatcacgaggtcaggagatcgagaccatcctggctaacaaggtgaaaccccgtctctactaaaaatacaaaaataaatacaaaaaaattagccgggcgtggtggcaggcacctgtagtcccagctactcaggaggctgaggaaggagaatggcatgaacccaggaggtggagcttgcagtgagcctagattgcaccactgcactccagcctgggacacagagcgagattccgtctcaataaataaataaataaataaataaataaaataaaataaaataaaataaaaagtggaggcttgtgggctcatggcttaggagaaaggaggagtggcataatctatggcccctgagaagtctaagacagagggaaaagaaaggaggtgtcccgtaagaaacctgagtacacacattcctaagagcaggctgactcagaaagaattccttggttatcctcaccttttttcctgtagggtaagggaggtgggagaagcaaaagtgttggggacaaagaggaggaagtatgtgtgtatacacaggaaggcaacaagtaaagtgtcgttcacgggcagcagccttggatatctgcaactcaggacatgcccgtaactcagacactcacccaagtctaggtccaaataccttggtcttttaaatttattttcacatttatcaaagtccaaaacgtggaccaaaatgactttcgaaggtaaatctgcattaagtggtatttccttcaaatacctgaaagtacttttttttttaaagacagagtttcggccaggtgcggtggctcacgtctgtaatcccagcattttgggaggctgaggcgggcggatcacgaggtcaggagatcgagaccatccttgctaacacggtgaaaccctgtctctactaaaaatacaaaaaaaatagccgggcgtggtggcaggcgtctgtagtcccagctactcgggaggctgaggcaggagaatggtatgaaccgaggaggcggagcttgcagtgagctgagatccggccactgcactccagcctggtgacagagggtgactccgtctcaaaaaaaaaaaaaaaaaaaaaatcctgggcgcggtggctcacacctgtaatcccagcactttgggaggctgaggcgggcggatcatgaggtcaggagatcaagaccatcctggctaacaaggtgaaacccgtctctactaaaaatacagaaaaaaaaaaaaattagccgggcgtggtggcgggcgcctgtagtcccagctcctcaggagactgaggcaggggaatggcgtgaactcaggaggcggagcttgcagtgagccaagattgtgccactacactccagcctgggcaacagagcaagactccgtctcaaaaaaaaaaagacagagcttcactcttgtcacccaggctggagtgcaatggcttgatcttagctcaccacaacctctacctcctgggttcaagtgattctcttgcctcagcctcccgagtagctgggattacaggtgcccaccatcatgcctgatttttctatttttagtagagatggggtttcaccatgttggccaggctggtcttgaactcctgacctcaggtgatttacccacctcagcttcccagagtgctgggattacaggtgtgagccaacaggcccagcccctgaaactatttttaaaaggtcagtcaactggcaagccaaaagcttcacaaaattaggttgctaaaaggatctgtaaatgtgaaatttgagtttcaaattttttacatagcttatgttggtactttcaaactggccaggtgtggtggctcatgcctgtaatcccagcattttgggaggccatagtgggacgacatcttcagctcaggagttcaagagcagcctggacaacacagcaaggccctatctaaaaaacaaagtctaggccggttgctgtggctcaggcctgtaatcccagcactttgggaggcggaggcaagtggataatgaggtcaagagatcaagaccatcctggccaatatggtgaaaccctgtctctactaaaaatacaaaaaattagctgggcgtggtggctggtgcctgtagtcccagctactcgggaggctgaggcaggagaatcacttgaacccgggaggcagaggttgcagtgagccgagatcgcaccactgcactccagctaggcgacagagcaagactccgtctcaaaaaaaataaataaataaaaaataaaacaaagtccagtaacgccaacccctcaagcattttaggaattttcaaaagatcaaaggacacatccatggtgttttcacacttggcaaattgtgctgctgtttaaaataaaagccaatagcctcctctggtctcatagtggacaggtggtagctccaggacaaaatacctgacacctaccagtgttgggaggcgggggcttgttgtgaatccatttaaccactttgatgccattctgagcagtggcaatgtttacacctggaacacaggtaatgaagtgttctaagggaacacctccttggttttcttgcactacttctagatcgccaaactctgcaatgtaacaatctggaaagctgaaataggaaaaaacaacaaaaaaaggaaaggttaaatcaaaataacagaaaaggaggcgcttgctaaacagaaggctttggtttaatgtatgtgttaatcatttgtctgaatgcccaccaccaggtttgaaggttaaaattaaggacccagggaggcaagcactgaggcactggcctctctgatgcattctgatggcattttctgggtagttttccaggagggggattaaaaatagggcaactgggctccaagtcagttacgcgtctgcttccacatcagcagggacgtgcaggccactgagtcctgtgttggcctttgtgttaagtctactgttgtggctcatggagtgattaaatgaacttctgaagaatacttttctctcacaagtcttgaaatgtatgcatatttgaagctgtgtactctcaacacttgtggagatttcgactgcagcacttatgatacatctcccctctgtggaagaatctgccctcctcacgtttacgtttctaaaatgtagcgcaaacacacattttcttgttgaagtactgagtgaatggatcccatttcagataaacagtcacgtgctgcttcatgatggggatatgtactcaataatgtgttgctgggtgattctgtcacctgagaacatcatcaggtgcacttatgcaaacctagatgctgcggcccactgcacacctaggctggtgcagcccatggttcccgagctacacatctggacagcctgttactgtactacacactgtgagcaactataacacaatggtatttgtgtatctaatcatcgaaaggtctagtgaaaatatgtgattataatcttatgggaccactgtcctatatacagtccatggttggccaaaattttgttatgtggtgcatgactgtactttgactgaaggctaaacacatgaggatgaagcattgtagagtacttatttgtaaagagatgtgggcagaaagggcaggcttcctataaaaagcagaactagggcattatatcgacaaaggctttgagatggttcacctcaataaaggcacggtgccctcgtgggtctggagaagactgtgaacctggggcgcaaatgtcttcaaagaaagaatcacaaaaggaatcttgtaagagtctggatcaaattcatgttcgctgaagaaaagagaacacaattggaagctgacattccgcaggggtctaagatgttcacaaggtcatcctaacatgttccacaatcttatagaaaagaattacttctaaaggaaaacgaacggcacacctgaaatccttattggaacaatgctgtctgcagacaggctcgtgatattctaactcttcaaatataattgggctgcaattcgtggaggagccgtcgtgtgactgggaagaccccaaggggctctggcgggcctgactgctgggtaggagacacaccagccgtccgtttccttgttcacggattgcgaccgtgtctgttaatttatatagatctgacacattcaacttgtgtccaaacctaaaagcaagagaagagagacgctgacttagaaggtttttctttgattatacagaaacacgcatcctgtttaaataaagaacaataaccaagaatggttcctccatctcttcaaaggtaaaactggaataattctactacaaattcattcactagcaaaccagtgatgcttggtactcctgagtcgtctctggctccgaccatgacaatgctcacttcatttgaaagccacccccagcccctgcccagtttctttaagtgacctcaccaaattctcttgagttggaaacctctctcgatgcagctcccctcacttccaattctctgtgttacttctcaccatccccattctcccctctcagaagtatatgtgctttccgtgaccctctcaactctcctatgcctcaactgcatgatccacacaccctctgacactggactccccagttctcctcctgacctgtatctttcttacttggaacttaaaggcactggccctggaggctggcagatttgagttcacatcctgactccacttcaacctgtgtgaccttagtcaagttccacgaccaatcggggcctcactttttccatctgtaaaatggggtgatgatagcgcctatctcacagggtcaatgtgaggattaagtgtggttaggcctggacagaacttggctcatagtaagtgctcagtaagtgttccctggtcttctcactgtctgaccagtgttttcttcccagtgtcctacatatgctcagattcccatctaccaaaccagcccctggtcctcttccacctcccggagagacacactctcccttgtactctcattctcagtctcgtactctaccctgtccctgtaatggaaacatccagctgctcaggagctgcttctgctgtgttacccccgagtctctcagccccttccctactggattttagccacaggactctgtagtgatgactcaaaagttatcagcggcctctgcctcatccccacacctcatgcatttcctcatggccttggatccccccattcctgatgtgctctcttggcacacatcctgggtgctcgcccacatccctggccctggtggcattccatccattcctgccctctatttctccttccccctcccaaccttatctgctctctagtctgtcccaatcgtcttaaaggcaaatgactgccctatctccagagcctacttctctcccaaagaagtccctcaatgtgcagaagactatgtgacctctccacccagctactccaatggcccctaaaacctgaatgtccaaaaccaagaccaaaaacttgctgtacctccttgccatgctttatttccctatttccagtttaactgtgcaaccatcatcccagtcatgcaaggcaaaacactcagaatcaaaatgacctctcccttttaccttgcttgctacataaaactagttactctggctggacgtggtggcccgtgcctgtaattccagcactttgggaggcctaggagggagaatcacttgaagccaggagttcaagaccaccctgggcaacatagcaaaaccccctcattacaaaaattaaaaaatattaactgggcaggatggcggatgcctgtggtcccagctactcaaaaggctgagatgggaggatcatctgagtccaggagtctgaggctgcaatgacctagggtcgtgcccctgcactacaccctgggtgacagagtgagaccctggctcaataaaaattgtttttaataaaaaaaattagttacccactctagtttcaatgacatttgacattttgacatttctgtaacatcgagttctgtcccaacagtatctgctctgaatttggactgatgtagctactttccctctctgcctccttctctcccctgttcctgccctctcagacaccactgctacgagaagagtcttcctgcagcatgattcccatcaccacacctttcccctcccctccttcctccagcacttcagtggctccctattacctgtgggataatggccaagttccttgttcttcccttcctctgtgttctcaaagctttttctcctcctttccaatcagttttcttcactgtccataaggattcacgagcattttctcttcccgctagacataagctcctcaaggacaagacctaagtcttgcccagttctgccttctctgcagtgccttggtcttgtactcactagtccctgctaagcatctactatgggctgggtgcttaggatacagtattatggcagagctagtccctgctgtcctggagcttatagtctagtgcttaaaaatgttcatccaataaatactaaaacttggccaggcgcagtggctcacacctgtaatcctagcactttgggaggctaaagtgggcagatcacttgaggtcaggagtttaagaccagcctggctaatatggcgaaaccctgtctctactaaaaatacgaaaacttagcaaggcttggtggcacatgcctgtagtcccagctactcgggaggctgaggcatgagaatcacctgaacttgtgaggcagaggttgcagtgagttgagattgtgccactgcactctagcctcggcaacagagcgagactctgtctccaaaaaaattaaaaaacaaacaaacaaacaaaaaaaacaaactaaagctagtcaattaggggaaaaataagcacaacactgaggaccaaaggtctaactttgttaaaaataaaagacgttttaaaactgtctgctaaacattcattgacatgtaaatctgaatgccagtgtctctgtctcctctcctctaccaggctgaagttcctcaagagtcattaccatggttttgtgcatgtaagccaccaatcagtactgactggataaagaaaaaatatacctaacttactttttttcatagatatctgtaaatttaaacagaggcaggcaacaggcaggggcatcctgaagaacagacattgtttctgcactgtaaaacagaagtttgattagggaacagaccatttcctccatattacaagttatataaacagagttcataaaattaacccagtgcatatgcaaaataaatttacggatttctggtatgtcagaatgtattttccagaaaaatttaaagaaaggattttagggacaaggcaatgaaagaagattacgttacacagtagaattagtatcaatcatagggttttccacaccagtggagcagaaaagcatgatgaattcagagcaaaagggagaagagcttaaatatctcctgccacactgcagtttgttagatatatgtgattggcgttcccatagataaggatacacaactgaatacaacataatctcaactacagttttaaaaaaccagaggcaccaaaaaacgctcaaagggaaaaaatccaaacaaaactaaaagaagatgccaaactgttaagtgcaattggctttgggccataggcctgtggatggttttttttcccctgcttcttttatgtttctaaactttccaaattttcttcaataagcatcatttttattctgagaacaacaacaaaaaaaaaacccgtaactcgtaatttaagtaatagtgaagtacaagttagaaaaaagatctctgatcatccaaggaaacactcaggagtgggtcctgttttgccagtctccccgaaacagggagacccaaagaagtatcacattttactatgaataaaaccatcaccagacgcttgagactgagatagtcttaaggtagacttatggggctgagtatctatttgacactaaggatatatctgcaaatggagagcttgaagatttgtagatctagtctttacacacaaatctaccttctacctaagatctcaaggtaatattttagacttttcaggcttataaacttttattgtaggggtctactatttttagaacctatttgaacatgttgcgtattattttactcccaagtgcctgtcaagtttaagctgtattccagctttgattaatgacttagacaagagtcaaatggcttgtttctaactgtatcaatctagaataagcattattccacatgcaatcatcacaagggggtgggaatgtgattgaatctatttttattatttctaaaattgtttctgggtcaaatgttatttcctgaaataaacagcttgcttgtttcttacctcagtaaagagagtgatttgctggcagccccggtggcaagtgagaccaggatctttttgctgccaattttgtatctgtggaggctattcactgcaccgatcgcatcttgtaagttttccatttgcacaacagccttgagttgataatctgtatgggggctgagctcaacactcttcacctacaacaggaaaagcgaaaactaaacgctatgtccgcccagaaccctgtcgtcttaaaactgaaggtgaaccatgaaggaacacatttgtcgactgcagcgcttccatgaaggagtatgtctgaactctgctcttctgctgaccaggacgtaagaaagtgaggatagggtgacctttagagatgtgacactggcccggcctgcctgtgtgctctggcacacacaggtttccaaggcaggctcagaggccaacacatgggaagagtgtttggggtcttttctagactctacaaaacccaggacatggccatttttaagaatctactaaaaaggtgcatttttagcaaaattgcacctaaaaaatgagtcaaatataataaggcataaacaagaccagccaacattattttagaatcctacctgtatttcagcaggaagagctaactgaaatccatcaatgttttacttatcaaattgcctttttttttttttctttctgagatggagtctcactctgtctcccaggccagagagcagtggcgtcatctcagcttactgcaacctctgcctcccgtgtttaagcaattctcctgccttagcctcctaaggagctgggactacaggcgtgcaccaccacgcccggctaatttttttttagtagagacggggtttcactcgccaggctggtctcaaactcctgacctcaggtgatctggccgccttggcctcccaaagtgctggaattacaggcatgagccgccatgcctggccacaaattgccatttcaatttctgcctaagacaagagcttttcactgctaggcgtcttgctctctggggctaacattgtaaaaactggatttatagcaccaccctgagcagaccaaagggaaaaggaaggagttcaaacttgttcagtcacacttctatcccggctgtggttatgtatatcaaattaggtcctcttgactagagactccatcagagagtataacaaagcaagcacaagagggaaaaagttaccttgccatgcctggcaaatgcttcctgcaggagctgctgcagctccttccgggataatctgtagtctatgttgctgacttggacatcagcaccatttgcaaatgggtctgggcagtcggcttcgctgctcgaatttgcaatgttgaaagcaagcggggatgctctgtttaaaaggtttggagacatactcctgcttaaaacacacatattgacattattttaaaaaactgttctgtatatttagattttatcatttaggctttgtttgaaactatatacagaagcagattttccacaacacaaccaaaccaaacatttggttttcaaatgtgtttttaatctttttttttttttttttttttttgagacagagtctcgctctgtcacccaggctggagtgcaatggcacgatctcggcttactgcaacctccacctcctggattcaagcaattctcctgtctcagcctccccagtagctgggactacaggcatgcaccactacacccagctaattttttttatttttggtagagatggggttttaccatgttggccaggctggtcttaaactcctgacctcaagtgatccacctgcctcagcctcccaaagggctgggattacaggcgtgagccactgtgcccagctgtgtttttaatcttaaatacacattgatttcagacattgtcaaaagtactatctactgacccctaattaccgccaaccaattaatatatattcttcctttgggttaaagctaaaggcaggaattagaggcagtcctgatgaattaaccttctgctttgtgcattatccttaggaaatcagcctgtgataccaatttaaggcgtctaacctcctctgtgtctctgaaagagttaaacgttcttgcctacatgttacagttctttctgcacataaggaaaacttttatgtggctttttagatgtaattttatagatccatagtcactttctctttttttttttttttttttgagacggagtctcgctctgtcacccaggctggagtgcagtcatgcgatctgagctcactgcaacctccacctcccaggttcatgccattctcctgcctcagcctcccaagtaactgggactgcaggcactcactaccacgcccggctaattttttgtatttttagtagagatggggtttcaccgtgttagccggttagccaggatggtcttgatctcctaacctcatgatcctcccgcctcggcctcccaaagtgctgggattacaggcgtgagccaccacgcccggctgatccatagtcactttctacagtgatctgccaccaactcagcagaacaaacacaatgctaaaaggagctcatgggaatgcaacacggccttacggcttctctgtctcccaagcatcaagaattccttggtgtgagagacagtgataaataattaccatggtttacagaaaactttacttccaaatagcttcctatacagaaccatatgaatcagaaccaccaatgcacggctcgtttgggctttttcctcaacacagcgaacatagggacatctttacatgcccccctgcactggccagggactctccaacaggcttctctttctgacctctgcttaccacaatttccagatggaggaagaagaaatggtgaaagcattgcccctaaatgttaacgatgattacctgaggagagggggactggcagaagagtgatgggagacttactttgtgcatttcagtactatctgaattcttttcaacaaacatactatttcataatccttcctattacatgtaaccacccccatgggtcaagaagctggactcacctagaagaccaagactgagatgcgagcagaggactgacttgcctggatgcaactaacttgctaaaagcagacgggtaactcacttggaatacagtctcctctttatcttttttctctacaggagaactggtaacacttcgggcactgaggttctcctttctaacagaaggggaaaattgaaggcaaaaggtcatatgtcttccttcacattcaagaagcagctatgagaaagagtagtttcacatacttctgactggttttgtaaacgggttctgccacccccgagtttttcggcgtcgacactgcagcacttgagttaccgtgagtgggtacgaccagcctcaggtgaccttgctggtgctcactgtttctatgaccagtttttgactccatgcggcacagctccttcaaagacacaagcacagtggggtttaaattttaagtacccaagatgtgttagatcctttacagaaaacgattgactttgagtatcatcaaacactgaaatcaaaaagggacacgccaaaagcaagcgggcacgtaaaacacagaaacaaaccaaacctaccataaacttcagaaagcaagaggtatcaaaattacctgtaaacttttaacatttgtattttttgtagcagatccagaatttgcctgtgacccttttccaggcgtggctttggcactggaagattgttcacttgcatctttgatgaggcacaattttggattcttaagttttttgggagacttcactttatcagcaattgcatttgaactctttgtttcacagagttctctattttttggagtaaatgacacaatgatcctattaccaaagacatcttcgttttccattcgcttctgagcgcgctctgcactatcttggtttatgaagcggagaattgcactgcagcctgtgatactcagcactttcccaccacaattatcggacaggcgtctgagcctgttgctgacgctcttgccatccttatttgctggtaggttataaacatagagcagagtgtggcactgctaatacagaggaaagaagtgttacgtcaggttaattcaagggcacacattcaatttcaaaataagaacaatgggtgacctccaaacttcagttaacaactttgaagagaagatgacagtgatttagatgggagagggtaaattatttagtgttgacaaagtaactgaatattgttttaaagaatatgctttagctgggcatggtggtgcatgcctacagtcccagctactcaggtgggaggattacctgagcccaggaagattgaggctggagtgactgtgccactgcactccactctgagtgacagagtgagacactgtctcaaaaaataaaaataaaaaagaatatgctaggcacagaggtctgtatactatatgattccatttctataaagcatccagaaaatacaaatctacagagacagaaagattagtagtgcctgggagtggggaaggggattaattataaattagcataatagatttactgaggtgacaaaaatattctaaaattgtacaactcaatttactaaaaattattgtacacttaaaagagctgaattttgtaatatgtaaatcatatctcaacgaagttgttttttaaaagtctatttattctgcaggtctgctgaataataacttatagagccagaaggtgagcagggtcagtcctggttggtttttgcataggagaatgcctgggaatactaggagctataggcttaagtaaacaaaaatttttttaaaacccaacaatttagagcctgttcagcttcaacagcagattgccagtagttaggctggaagttttatttggcagtgggtagtcataattcttccagataagttgaaatttatgtattaagaagtagaacttggcctggcacagtggctcacgcctgtcatcgcaacactctgggaggccaaggcaggtggatcacctgaggtcaagagttggcgaccagcctgaccaacatggtgaaaccccatctctactaaaaatacaaaaaaagttagctgagcaaagtggcagacgcctgtaatcccagctactccagaggctgaggcagaataatttgcctgaacccaggaggcggaggttgcagtgagctgagatggcaccactgtactccagcctgggcgacagagcgagattctgtgaaaaaaaaaaaaaaaagaaagaaagaaagaaggaagtagaactggagaaaaagaaagaaaagagagagagagagagaaagaacgaacaaacgaacgaacgaacgaactggccaggcatggtggctcatgcctgtaatcccagcactttgggaggccgaggcggggggatcacttgagcccaggagttcaaaaccagcctgagcaacacagtgagaccccatctctattaaaaatttttaaaaattgccaggcattgtggctcactcctctaatcccagtacttagggatgctggggcaggtggatcacttgaggtcaggagttcaagaccagcctggccaacatggtgaaacctcgtctacaaaaaactagccagaggctgggcacggtggctcacgcctgtaatcccagcactttgcgaggccaaagcgggtgatcacctgaggtcagaagttcgaggcaagcctggccaacacagtgaaaccccctctctactaaaaatacaaaattagccaggcgtggtggcgggcgcctgtaatcccagctactcgggaggctgaggaaggagaatcaattgaacccggcaggtggagtctgcagtaagcggagatcacgccactgcactctagcctgggtgacagagtctcaaaaaaattttttttaaataagaataatattttaaaaagcagaaccattaaagcaccaggagaaaacttaagataattatataaagggttaaatccagaaaccataagagaaatcactaacaacaggcaaaggatgtgaacaatttacagaagaaataaaaagcaaacaacgataatcataaaaggatattttgcactgtgttaaagattaaaagtcaattataagatgatgctgtttttcacttactggcctggcaaacatttaaaacagacactcttatgagtgtaaattagtaccaccttcctggaggaagacatggatcttgctagtaaagttctaacccagaactcttatgccttggaaattaccctatggtatgtcagcccaggagcctaaagatataaattaccttgctggaaatggtaaaaaacaaaacaaaacacaaaactgggtataaacaaaatgtccactaacaggtagactggttaaataaagaccagccatacaagtacttttcaaaccaaagttctggtttttaaaatgtggcagatttatattaatatatattaacatgaaaagacatccaagctctgacatagtttttttccaaaagccacagaacactgtatatgtgacacatttttttttaaacgtacattttttaaatctggagggcaataccaaaatattaacagtggttacttctggagggtagaattgtggggttttcactttccacatttctaaatattgtgttttgtttgtttttacaatgatcataccatactattcttttctttcttttttttttagattttttgagacacagtctactctgtcacccaggctggagtgcagtggtgtgatctcggcttactgcaacctccactttcaggttcaagtgattctcctgtctcagcctcccaagcagctaggactaccagtgcccgccaccacacctggctaatttttgtatttttagtagagatggggtttcgccacatcggccaggctggtctcgaactcctgaccttaggtgattggtgatctgcccacctcagcttcccaaagtactgggattgcaggcgtgagccacatcactcggcccacaccatacttttctaatcagaggcttttctttttatttgaggggtactgaccaattatcaacaaaatctacacttttcctattacacctgggactcaaaacccaggcagtaccaatgtatgtttaatttattaaaattaaaggaacagactaaagaacataaaaagaaatgtatcttaaattatcactctagtggatgggaaaaaacatccagcaaaactaaatggtttgaattatcaaaacattgttttggtttttttaaccataaggaataagaatctccaaagtgggcaagttcttacctaaaacactacatttacttttttttttttttttgaaacagagtctcgctctgtcgaccaggctggagtgcagtggcgcgatctcagctcactgcaaccttcacctcccaggaaaaaacaccgtatttacataaggccttcaaagttagaaaagtgaccgtcaaacagaagcagaagggaagaaatgtaactacagccaagtgactaaaaacaaataatgacaaaggtgagttaggaaagagcctcaaaagattaaggtaaggcctgtatatgcttactccctgggtaagcctctggtatccacaactctcaactgtccatagcatgagtttcaacttaagccagaccgcagggggcttgttgggtatcggggacacaggtgactagcaggcaagtgccggaatcaggatacccggggcccactctcttaactgctgcaatcaccaatgacacgtttactttttctaagagctgatttctttctcccttaaatgaagactttgcatgagatcatgtctaacgtacttctgtaactctcagttattaaattatatgtgaagactttcatttaacgtatgggattgcccactctcctggatcacccacaccatggctccttctccattatcattaattctttcagagttacacacatattcgccagcggcttaaacacagcccagcactgcaataaacattcttatcccaagtcaagtctatcagaaatgctagtcctggaaatgtgctcacaccctcctcccagtatatggcataaacaggctacacacaggtggagcaataaccactcctgctaattgtgtccatgcaccacagggaatgcacaatagaaagcacagactcagaggcccgctgaagcttaaggattaaataccgaaaaaaatgcacaattgactccacttatttggtgccaaccacacaagtatgtgagaaccctcgccatattctctacccataatacttggaagcaaaaagaatcatgacttttaatccgttatttctatccacctgacacaaaacactgctagctttgaagacactggcaagttgggaaggtaaatctacaagtcaatttcatatgatattttgaaataaataaaagcaaacttcatacataccaattatctgtatatttgtgagaagaaccgaaggtttctaagccttacttcaaaatctaacccacctcttacaaagaacagccccatctgggcctggcaacccccttattatgggctgtctttcagcctccacaatgtaatattggaaaatggcaaaaataacgcaaacccacttactggcatttttagtggtaacctggggggcaagtcggaaatgaactcttcaaatctgatcagctcgttagcatgatgcagcagtgcttctgaggcctggtttttatggaccaaaataatgtggaaaccatgcctgtgtctcaggtcactaagttccaatgcaaaattgacatcagctgaaagaaaaggtacagaccaaccccatccccaaacattagaaacacttgacaaagacagacaactctattgacacccactgagaagaaaggaaaggctggactatattcaaaattgcttcccccgtttcttaggaaagaaacacgtttcacatcagaagaatgtaagacaatcttaccaaaagaattccaagacacatatgttactttcagtattaaaaaggagcaaatatgttggggagactcaaatttgaaaattaacttaaactttaaaaattattaatactgagcacaaggtaaaaaaaaaaaaaaaaatcacatttttctttaataaacctggtcccggccgggcgtggtggttcacgcctgtaatcccagcactttgggaggccgaggagggtggatcacctgaggtcaggagtttgagaccagcctgaccaactggagaaacccccatctctactaaaaatacaaaattagctgggcgtggtggaacatgcctgtaatcctagctacttgggaggctgaggcagaagaatcacttcaacctgggaggcggaggttgcagtgagccgagattgcgccatcgcactccagcctgggcaacaaaagcgaaactccatctcaaaataaataaacaaaaaaataaaataaaaaataaacctggtcccacaataactcaagttccaaggaggaaatacagaaatccacctagacccaattttttttctaaacagttctcaacaataaccataaacatgtctcatgtacttcagcctctttggggatacattttactttcacatgttgctggcttctatgataatttcccacacagtgagtttagctgaaattagcagatgtttctgtacttacttgacacaagaaccactgtggctggagcagtgtgtgtatttgcaaatctgcggagactctgccgcagtttatcatcagcggcattctttgcagtagcattgatgtgggcaacggttacctgcattaatttataataagggtgaataagcaggagctgaggctagaaaattgctacacattctgcccatattttttattttttaaattttattatactttaagttctggggtacatgtgcagaacgtgcaggtttgttacataggtatacatgtgccgtggtggtttgctgcacctatcaacccatcatctaggttttatgcccccacatgtattaggtatttgttctaatgctcttcctccccttcccccaaccccgacagacagaccccagtgtgtgtttttcccctccctgtgtccatgtgttctcactgttcaactcccacttataaggcaagaacatgcactgtttggttttctgttcctacattagtttgctgagaataatgacttccagcttcatccatgtccctgcaaaggacattatctcattcttttttatggctgcatagtattccatcgtgtattatgtgccacattttctttatccagtctatcactgatgtctgcccatattttaataagtaattcttgagaaaaaaattcttattactattgggaatggtaaaaaattacaacagatctcagtaatctcaacattggttcttgatatgaactgggtttgtgactaaccctgctctcatctccaatcttctgtttttgcatttctttcatcctcctttcagaaaataagtagaatataggaagtgaaatttgaactcagttaaatttgctctaatagcttctgccaacaatttggaggtggtaaagatcagacaaatgactaaaataagatttaaggctgtgttttatgtcaactgtccatgctacccatgcaagcttgtgcaatctgccttttgttgttgttttctgttttgttttgttttgggcttttagcagctggaagccatagtttttagtttccgtccctactaataagcagaaaagagagataaggaaggtgctttactagcccaaccagaaacagaaactgagaatccatgattgtattctctcccttggacacccctggatggctttcaggatctggggtgaggtggtagagagaggagggaggatatcccctaagggagctaaaatgcatttatttctgttaaaactatcaggctcgcatataagtccccaaaggaaggaaaggtttattttgagaaagttgcctcaggcacctgcaatacacaataataacttgctggtttttgtaaagaacatgggtatatcattttagacaagcaatatggactatcaatataattaattatctaagagtcaaaagacccaaattctagtttcagcttaaaagcagactctgggggtcagacaaatctagatttggatctttgctcttcctggccaagtgatcttaaacaagtttcttcacctctcagggccttagtttaatttgtaaattgtgaattatatattctacgtgcctggttcaaagagcagtaatgaaaatcaaaggaaataatacatatataaccattataccagtatagaactaaaatataaattagggagcataactgaaagaatgattaaattatttctagtactttggaagtgatcttttgctaatttattttatttgaaaacttggcacaaatgcaatatcattaaacaaattttcaatcagaattctaaaaaaaaaaaaaacaccacacacacacacacacacacacacacacacgtacagcacttttagaggccaaggcaagaggactgcttgatcccaggagtttgagacaagcctccaccacctaaccctggatcctgaaagccatccaggggtgtccaagggacagaatacagtcatgggttcttagtttctgtttctggttggaacatagggagacctcgtctctacaaaaaataaaaaatgagccgagcatgatggcgtgcatctgtgatcctggctagttgggaggctgaggtgggaggatcactggggtcccagggttcgaggctgcagggagccatgaatgcgtcactgcactccagcctgggtgacacttagactctgtctcaaaacaaacaaacaaacaaatatctgcttattcctctactgtagattaaaattattaaattttttttttttacctggcaattattcagctcttgaataacttccttgttttctttactgatgtcacatacacagatgaattctgcttctctgtggcctttaaaaaacttctcacggattctttgcacaacagcagttgctgaccggccagagggaacggagcagttttcaatatcccaaaaaactccaatggggggtaagttttctagcacctgtccagctactgcaacttctggtgacccttaagaaatgttaacattttcaattacttgtagtggaaaataaatggcaagttacaataagataataaactacctatcattctcagtggtagaaaaactaaattattaatgaatgccaagttttaaggctaccaacctcactggttgacctaataagcaatcaagctgtcaaaaagtatcactctaagagattatttctgtttttcaggagaagacaaatctaaaagtcaagtaactttaagcccacaataaatccacctccaagcatgagccactctgacattaagcagtgatgcttctctgaacacaagcacactaactgaccggatactgcagctccaggacccgactttcaagcttagcccacacttatctacctacttggtagtaaccaacactgaggagctgacaaagggtgaagctgttactgtcgttgattttgagttaacgctgcattaacatctgatttaatattttaaaaatgttttcaaaacgtcgcattaactactttttagggaaattattttaactgagaactctttggttttcaaatactgtttttaatcagccattagtaaattgttctaagcacttctagggagtataccatcaacaagtgtgatttccaacctaaggtgacaccaagtcttttccagcacttttatttctcctgatatactaccaatttttctatacacagcttctgtgtatagcctcggcccaacataaagggcaaatgacttcctggtccataataataaaaagatttctaccaagatatggaattggagactcacatacacagtagctttagaaccataaggaatccttcaaaggtgattaaatgcaatgttagtatgagatattgaaagctatttaaatatgcacattttatgccatactgtcatttaccaaattttgaagcagctttgcctagactggtcgccaataacaacgtggtctccttccctgttcctttggttccacagccattacacagagggacagcaagaggtgcaggttgagtatttggaggtggtatatttggccagactttagccgcatcgattatgctatttcttgctggctgttttaaattttttttaaaaaggaggaggtgtcagatacatcatttcagaagctggagttatatacaacaactgaaaatacactctaagtgttttacctttccacttgctagcctctaataaaaaggactttcaaataatctttccaagaaccattagctatcagttcataaattcatttccagaagtgacttgacatgatcaagaaagatattcacgtggtcagatctttacattctggggcatgagtctgctgcaacgaagacctcacacatattttacataaagggtagcaaagtctcacttgaacaccaatgtgactgaggccaagcttcaggtttcccacattattgcaaaaagacaacatgcagttatctaccttacatgaatgggcccatgtgtaagctgaatgtaagttataaaaaatccatcgtgctttagcctttaaacatagaacacgaaggctttgccaacctcttgtttgcaacaagaggctctaaaagtataaactacaaaaataatgactctctacttttttgaatgatctcccatcttaccctttgtttctttcagaaccagcaaaaattatgctgatggggagattcccctataccatgggagaatcttcaaccccatgtataatacttttcaagataaatccacttcaaaagtcattcctcaatcctcagctgcacccaacttaagaaataaaaagatacgaaccttgtttagacagtcttcgcagtaaagtgagccctttaaacaaaccggaggtaccacattaaggtgcaaagagttggtgcacaagtgaggcgttagctccgactgtgaaatgtgctcttccaaatgccctggagccccgcttgtgaaatcagaacaggggaaatagccagcggaggtgcagccctgcagactcggaaactgatgcagcttgtgcacattaccatgacatgactggaagtggagttttccacaacagggcaggtgtttgcaggaagacaggttactctctagacacatgctgggaaagtcacttgcaatgcctgccaaattgttcctagctgaggcattctggagtgaagatgcagactggaaagcaaaccctgaccctacctgacacgtgattgtcctggtgctttgcgagtctaacagtgcgcccgggtgaatcaagctactggtacctccgctaccgccaccaccaccaccaaaacgcattggcgaagtggagggttcattagggcaatgagcacagcagcttactttggggacagaagaaagctgtattttaggctgctgaagagaacgaatatcaggaagtgggactgctggaaaaagcttagagccagcatgaaggggtgatggtacatcctttagttccacagcaactttcttgttctccatgtactctttctgagaaaagaaaatcagaacataaattaattttatgaggtccgtggttttttggttactcatatcttactgcatgcacaaacagaaatagtgttcaattctgttacatcactaaatcataactgaacaaaatggaatcacagctagttaaaaccaggaacattcttcagagaggtctgcaggacatgaacactggaacacacaactaaaattaagactacattcttcctgaattgaaacagactggggtgggagggcctgtttacatctttagcagccaccatgcctcagtaacttccttttggtaatttccccttgcctcacagaatcttctgaagacaaaataggtggtatgaaaacaacccctcacaaacagcattcaataaagatggctaacacacacagtggtttgaggacaatacttaatagttctgtggtcaggccataaggggttttagtaagatcccccaaaggaaaagagtaaagtttcaaacacagatgagatcagccatctacccagatggcccatccgtgttgctgatgacatttcataaaccctaagatatcatgacctaaagccataatgacaattatattgcagccagtgaaaagatttagagaattagaaaactatccaagaaaaagatccaagacaaatagtttgccacatgactccaacacagacacaggaagccagtatattacaaaggttctgagcagagcatcagtggcagagacctgggttagaatctgatactcaatagttgtatgaccttgggtaagttacttaacctacactttggtttcctcatccataaactgggaatacaatatacctcctagagttgctaggaggataaaataagatagagcacatagaccacctggcacagtacctagccactgaaaggggactgaattcatcagccttcacaggctgactgcaagagacattaagatgaagagggggccctgctacagtgactgagacgtgctcaccgttcacagcatatgagggtccatctgacgcctaaaattccactccctttgctgtgattctacactcacctgggagcataggctcatctggaagaaatgtgaattttcagctaaactttccctaaaagggagataacagcaacgggctgaccagccaatgaactgccctcttggtaattatagttcagactgaaattaacacactggtattctgatttatacagatcaggctcatacaggcaggcttactatgagttgatcccctgaacctactccattctgcatgccactgacaaaattgagtttcaagatctgtaaagttgaccgtgtaattctgaattgtgtgactccatgaggaccagatctaccaccccatcccaggaagccttgcttttgatgccaaccctcactgtcaactgtctctaaaataaaacactcctaaaatgacccaaattacttgatgtcttgcaacaaagacaactatatagtgaaaacctagagaaaatagagaattaaactggtttttaaaaagttattaatacccggccaggcgcggtggctcacgcctgtaatcctagcacttgggaggccgaggcgggtggatcacctaaggtcagaagttcaagaccagcctggccaacacggtgaaaccccatctctactaaaatacaaaaattagccaggcataatggcgagtgcctgtaaacccagctactagggaggctgagacgggagaatcccttgaactagggacagtggttgcagtgaacccggatcgtgccactgcactccagcctagggggctgagccgagactctgtctcaaaaaataaaatcaaataaaagttgttaatacccttatataaaattatattacagtctcacttgaatcccacatacaatagaaaataagaaatagaaaggtggtaacatgagtgcatgaagtcaggaaatgtcaaaattggctggacgcggtggctcacgcctgtaatcccagcactttgggaggctgaggcgggaggatcacttgaggtcaggaggtcaagaccagcctggccaacatggcgaaacctcgtctccactaaaaatacaaaaattagccaggcatggcagcacaggcctgtaatcccagctactgaggaggctgaggcaggagaactgcttaaacctgggaggcagaggttgcaatgagccgagatcgcaccactgcactccagcctgggccacagagcaagactgcacctcaaaaaaaaaaaagaaaatgtcaaaatcacaatgagtaagcaagaagttagagacataaatgtatactgagaagtaaatattcaagagaaatctcgaaataaaaaacaggcagtggataagctcttcccaacccttcctagattatagactcaaaactcaagagggctacagtaaaatacaacatattttgtattttcctctgattttactccacaatgtggatttttaatctttgttacctgtgactttaatgaggaagaaatctttcccaaattttaacattaaatattcaaggcatctactgttactcaaagtgaaatagaagagttaaaaaattgtgctgtgctctcacattataatgtggtataagaggcaatacaggcaagatctacagaaaaatgtggcacagactctaggatgagagactgtatcccagaccaaatggacctctctcatctatttggatgaggaatctgctacatccttagtcttgcatatagttaccgtttggggactatgtggcagcgtctgctcaggacgagaaaagcaattagagaatttccaaagccatggcttagcatcattatcttgttgaagccatccacgtgttctactgcaggagttctcagttccgtttccttccatcatacagccatgcaaagtgattcaacatcctttcatctttcttttctttcattcttccaccctgttaagaatgagtaagatttcagtgttatttccttgcataagtacaaattttacaacatactaaaatgtgaaaccacagctatatttacagtcctatggctctcaacaattcaaatctttgtttcaagaggaagtctcgctctgtcgcccaggctggcatgcagtggtacgatctcagctcactgcaacctccgtctcccgggttcaagcgatttttctgcctcagcctccagagtagctgggactacaggagcctgtcactatgcctggctaatttttatatttttagtagagatggggtttcaccaagttggccaggctggtcttgaactcctgacctcaagtgatccaccctcctcggcctcccaaagtgctgggattacaggcattagccactgcgcccggccaacaattcaaatcttaacaaacaaaataataataataaaataaagaaagaaaaaaacacaaaatatcagagcatattacgggttaataaaatttggtaaacttggttgactgtttatgcttaaaatctaactgcaacaacctgatttcttaaaaaatctataatctgccattcttcatgtttcatagctcttcaaataaaaaatgaactctccatgagtcttgtttcctttccacatgtaaccatgtttgagagaggtagccatatcttggaaacttgcatattccagagtgagacttcacctcctcacttggctggaatcaattttttctacagtttttctgaattcttttcggctctctctccctaaagatgctgctcaggaaagtcaaaagttaacagaagagagcatctaatctgagtaaaagagccaccaccacatcctcattgacaactatatgtaagattttaaaattgacttaagagcaacttcttgcactggtttcttgatctgagcatgaaaagtccaaactaagtggcctctgtggactttgaatttgatttgctacagaacaaattgaaccaatttcttagtttactaatgatgaaagtgcaatctgatataccaccaaaaatctaactgatagaaaaatctcaagtcgcagatgtgttatatctacgccagagcaacaacactcttacaggtcttaacaataaatgcaagcgaggcaccgtggctcaggcctgcaatcccagcactttgggaggccaaggtgggtggattgcttgagcccaggagttcccaaccagcctgggcaacatggcaaaaccccatggctacaaaaaattagctgagcgtggtggtgcatgcctgtagccccatctactcaggaggctatggtggaagaatcacctaagactgcgtagtcaaggctgcagtgagctgtgattgcaccactgcactgcagcctgggcgacggagtgagaccctgtctcaaaaaccaacaaacaaaattacatgaaattaaaatgtcagtgtccataaataaagtttaattgggacacagacacactcattcacttaaatactgcctatgactgcttttgcattccaattgcagagttgcaaagagagtctctgcaaagagactgtatggcccacaaagcctatatttactacgtggctcttttgtcagcctgggcaatatagcaagatcacagctctaaaataaaataaagttcaaaaaattagcatagtgtggcagcatgcgcctagtcccagctactagagagactgaggtaggaggatctcttgagcccaagaatttgaggctacagtgaactatattgtgccactggcccttcagcgtgggcaacagagtgagattccatctctaaaaaaatttttgttttcaagtttctgtttcctcctatgcaaaatgtggctaatttctccccgccactgcattacagagaaaaaaaaaattagataaatgaaccccactgtctattttcaccactgtatctcttgtgccaaccaaaatgctccctactctgtaaatacaaagtaaacattacctactacacactattgggagtggttaatttggagatggatttaactgctaccactgatagtaaattacgattcttgtctttcctattagatacaggttttatgtcccccaaaaaactcctctcaaaatcgtaagaatctgtgatattcacagtgttcataacttaaacattctctcaaacttcttcaaagccaaatcctgaaagtgagctaacattcacagtataatctagtttataaagtattttcacttaacattacttatgtcttcattcagcaaatatttacttagtatctactatgcagcaggcctgtgcttggcacaaggaatataatgatgaaaaaaacccagacggtgggatcctcttatataatttttgcaataatcctgtgaaatagacaggggagaaattagctacatttttgcagagagagaaaaagaaacttaatgaagttttgtagcgagcctgacacaagattaggcttgttcacccctttccactacatcaaggtgccttcaatactgctcaatacaagcgattaaaagtaaaaactttcaggtgcctgcaccctgaaaacttcccaaataccatccacgaagcaacttaggtagccaaaagcaggttctgtttgacttgagcgacagtctcctttctgtcactctcttcaagtcttttgaccaattcaatgaggagagcataggctctgtcgactgtctgcattttggtctccaatttgactgcggtgcagctttggacaactcacaacctctctgaacctcagatcccatctctaaaatgggtgtgataataatagaaaccaccttacaaggccgttgtttggattacatgaggtaatccacggggaacatttagcaaatgttgtttccttagcacccaatctagtctttgaccccacaccaccccatcccattaccgttttctcccccatagctcttctgtccaaaacggcctttttagcttattttattatctttctcccccattaggctataaactccatgacagcagagactatgttttcttatccactattccaactcctgtccttagtacaatgcctggcatattttaataaataactgttgaacgaataaagcttaataaataggaaaacagtttaggtttcaatacaccgatatgcaaaagagaagaatatttaccgctcagagaagtccaaaagacacaaatgcaattggacagctcttggtaataccggaaaggtgcttgagaaactctaaaaggtgtatcacgaggtcgcgttacaactactagtgagagtggctgaagccctagacattgtcaaccctgagactacaccctatgtgttgctaaaaggccgaggagaatgcaaaacggccggggaggggggagtgtgttgcaaaaacacccgcccctttccttctctcttaaccttccagctgtgcacttcactcctggagggccccaccaggggtcagacaggggcgggcggggagccaaatgccctcgaaggggaacagcggcgccaacagtgacagtagtgaatggacccgaaagggagacaagccaactctttcgtggggggcccaactggcgcgtcccagttagctaacctcccctctccaccaccatcccaccagcaataggcggggaaagaggggacactgtcctccgtcccgccccgctggcctcggagcagagcctgccggggtctggtcgcaggactgtctgcaaactcacctctgccgccggctccacctccgctcacattccggccccgccgccttccccccgccccccccaggccctttgttttgattcccgactccgcagctcccgccgccgccgccaagcgcacccttcacttccgcttccgcaccgcaccgcccctgtcgcaaaaccgacgcccttctctcctcttcgccccgccccttcctcgccccgcctccgccgccgcgtcctgtccgcgcggggcatgctgggaaccccggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacggttagtttcaaacactttgtgttttaggtggccagatatgctgtgtggtttgctttaaaaaaaaaaatagcgccccacaatcttcacgtttccctggaataaaaaaaaatttaagactcagcaaaagggtgatttctgaaactaccagctgattactattttctgttgcaaattaggaaaaaagcaaagcacatattgtgtaagttaaatctagacacgatttaggatgtgctagctgctagctaaatgctaccttaggagtttatttttaaagtttgcccagaaacaagttgactttgcaaaagaatcagtaagtcgaaattgccaaacgagaatattttgcccaaaaaaatccttactgggaggttatttcaataggcaatccccattacgtggggattaacacatccctgtaaacatccctgtagacgggtattgtggagggcaggatcagacatgtagctgaagaatcctttgtgcctgtatttaattttccagaaggcagatgacaagcacacatcctctccctgcgtaggtatttattactgctgactaaatcttgactgtgggctgggcgcagtggctcaggcctgtattcccaatactttgagaggctacggagggaggatctcttgagcctacaaatttgagactagactgggaaacggtgaaaccctatcactatttagaaaagaaagaaaaagaaaaaaatcttcattatgtctgtgtataggtagtattttccaagtggagattagaatagatgaaaaacccgtttctagcgttttggcttttttcaaagtaccaaacaaatacgctactcttcagaggtgttttttccccattttatttcagttgagtatgtttcaacacaagccatattaactaaaaatcttaagaaacaaggtaattgtaggtttctaattgctttttttaaaaaatagtttttagccagaaaacatcaaagaatgcagacacatttcctttttactttttttttttttttttttgagacaaagtcttgcttcattgcccaggctggagtgcagtggcaggatcttggctcactgcagcctccacctcccgggttcaaccgattctcatgcctcagcctcctgagtagctaggattacaggcgcccaccaccatgcctggctaatttttgtgtttttagtagagacgggatattgccatgttggccaggctggtctcgaactcctagcctcaagtgatcctcccgcctcggcctctttaggattacagggctgagccaacgagcttgaccacattttctttatatgtatatttttcttttagattcctttttaccaagcagacacattttgtttgacttagcttggcattctttcaagtccaaagctgtaactagtcacaacaagtaaatgtagtgattgaaaatgggcggggcatggtgactcatgtcgtaatcccagcactttgggaggctgagacaggaggaccccttgaggcttggtgtttaaaaccagcctgagcaacatggtgtgacacttgtctctattaaaaaaatttttaaaaacaaaacagtcgtattaagtggaaggctaataaaagtctgaattacaaatacttttaaaagaaatgtaattttattgctgctttctaaagactaggagcctaagcaaagtataccaggccttaggagacaattatgaatcaaaatacataaattttctcttaagatatattttaagtatgtatcctctattaattgtattcctgtttctttgctgggaaaactttagagagtacaagtaactttcagtttttcccttgtccaaattatagtcttcacatgtatgaaaaccgaaagacttttttgtgtgctatttaagtagctactttacatgcaattcagcttttcaactaaccaagctgttattaaaggagtttctccccagaaaccaatcttctacctgtattaggttcagtggtttgaattaataaatgatcatggaaggacctaaggaagttaaattgagttatctgctcagccatagtccaaagctacaaggaaaacaaattgaatttaaaaagaacaagaaaaacattttaaatgtttttaaggttttacccaatgacaaacctatttccctaaatgttgttcccaaataggactttaaggattattatttcaatgccctctcttttttctttatggaaaatttgggaaattgagaaccaactagtttaaataccttgatcaaagccatttaggcaacaccagtacctcatcagtttgtgcttcggtttctctgtaagctgaggtgattagttcctgtccagaaacgtcacagagtggttagggccaaataaaattccgaggggggccaggcgcagtggctcacgcctgtaatcccagcactttgggaggccgaggcaggtggatcacttgaggtcaggagttcgagaccagcctggccaaaccaacatggtgaaaccctgtgtctactaaaactacaaaattagctggacgtggtggtgcacacctgaaatcccagctactcaggaatctgaggcaggagaatcgcttgaacccaggaggaagaggttgcggtgagccgagatcgtgccactgcactccagcctgggcaacagaacgagactccgtcaaaaaaaagaaaaaaaaaatccaaggggggttaataccagctacttggtaggctgaggcaggagaatcgcttgaactggaaggtggaggttacaatgagccgagatcgcaccactgcactctagcctgggcgacagagtgagattccatcttaatgaataagtaaataagtaataaaattcctaaggggaggcttggtgtggtggctcatgcctgtaatcccagcacttttggaggctgaggcgggtggagcacttgaggtcaggagttcaaaaccagcctggccaacatggtgaaaccctgcctctactaaaatagaaaaattaggtgggcatggtggtgaacacctgtaatcccagctagtcgaaaggctgaggcaggagaatcgcttgaacccgggaggtggaggttgcagtgagccgagattgcagcactgcactctagcctgggcaacagagtgaaactctgtctcgaaataaaataaaattccaagggggaaggcatcagacgtagtaaagtgtgaagcagcatgtaaatgattcattaatgtttgggaagtttcctgaaagacatttggtactttccttaaacctgttgataggtggtggggttcccctttgtgcctctaagcagtttttaggaattagcaaggagttcaaagtagaatttgagaaaggctgttgtaggatagcaggaaggcaagatggggtgggagatcctgtaatagctaagatctctttgcctctagcatagtgctgaagaaggagggtttaggagtcagagccagctctgaagcctgatttgttaattactagttgtaagacctcggacaactcaattaacttcctgcacctttattttcttatctttaacatggatacaatttaatgctttcctgtggttcatcacctgtggttcagttgcatggtctcctctctacagtggccttccctgactatagcatctgaagtgacccctcccagcccgttgtatcaaatgggcttgccttagtcatagcacttatcagtatctgaaatgacgttactttttctgcttatagatttagtatgtttctctcttaacaatataagccctttgaggacaggtactttgtctgactgtattcactgtgctgtaagggtgcattgtacagaagaatgctcataatgccgggtgctgtggttcatgcctataatcccagcactttgggagggaggctgaggcaggaggatcacttgagcccaggagttcaagaccagcctgggcaacatagtgagatccacgtctctacaaaaaaatgtaaaaattagctgggcgtgttggtgcacacctgtggtcctagctactccggaggatgaggtgggaggatcacttgagcctgggaggtccaggatgcagtgagctttgattatgccactgcactccagcctatgtcacagggtgagactctgtctcacaaaaaaaaaaaaaagctggataataatatatatatttttagtttttatgggtacactgtaggtgtttatatttatggggtacatgagatattttgataacaggcatgcaatgcatcataatcacatcagggtaaatgggtgtccatgacctcaagcatttatcctttctttgtgttacaagcactccaattatactcctttagttattttaaaatgtacaatacattgttgtggactgtagtcaccctgctgtgctcccaaatactagatcttattcattctaactctatttttgtacccactaaccagaatgttcggtatttgttaatgaacatgttatgacaggatgttttagaagaaaataaagaaaaaaagaaattccagccaagcatggtggcttgattttatttatttatttattttgagatgaagtctccctctgtctcccaggctggaatgcagtggcgtgatctccactcaccgcaacctctgccttctgagttacatggctcacgcctgtaatcccagcactttgggagactgaggtgtattgcttgaggtcaggagttcgagaccagcctggccaacacagtgaaaccgtgtctctactaaaaatacaaaaaattagctgggcgtaatggtgggcgcctgtaatcccagctactagggagactaagacaagaaaatcgcttgaatctgggaggcagaggttgcagtgagccgagatcgcaccattgcacgccagcctgggcaacaagagggaaactctgtctcgaaaagaaaaaaattattttttaattttaatttgttagtgaacaattagggttgctgtgagaattgtgcctggcacacacagccatttaaaaatcacgatcttcaggcagtgtgtggtggctcacgcctgtaatcccaggactttgggaggccgaggtgggtggatcacctgaggacagggattcgagagcagcctggccaacatggtgaaaccccgtctctactaaaaatataaaaattagccgggtgtggtgatgcgggcctgtgatcccagctactcgggaggctgaagcaggagaattgcttgaactcagaaggcagaggttgcagtgagtggagatcacgccactgcattccagcctgggagacagagggagatttcatctcaaaataaataaataaacaaaatcaagatcatttaacaaatacatatattgtacttactaagttcaaatttctgttctaaacgtttttacaaatgctgttaagtcatttagtcctctgcataatgtcgtttgtttgtttgtctgttctttaagacggagtcttgccctgtcgcctaggctagagtgcagtggtgtgatctcggctcactgcaaccgccacctcccggtttcccgtgattctcctgcctcagcctcctgagtagctgggattacaggtgcgtgccaccacatccggctaattttttgtatctttagtagagacggggtttcaccatgtgccaggctggtcttgaactcctgacctcgtgatccacccgccttggcctcccaaagtgctgggattacaggcgtgaccaccgcgccagacccataatggcgttttatagatggggaaacggagtcatagaggctaaacaactttcccaagaccacacagttagtaaggggcaggactaggactcaaagccaagtttatgaccaaattctggtgcactacgttctcctgcttctggagaagataatgatgctgaagattctacttttggtgtaaaggagtaggaagggcacggggcactgctagcttcagtgggcctgaatctttgtctttccttctgatttggagaaagtgcaagaatgggaaaatgcaatcgaagtgaaggagaggccggcgtattttcctgaaatgcgcggcccgcaagcccaaacccgtttcccgggtgtccaggcagcgttctgcagcatctccaatgcccgccagcccgccgcagcccagcgcccggcagccggcgcctctcaaaccccctccggccaggagccttcgccgcttggccgcgccgcgcccggcctgggaaaaaagtttccaaacgacgctgctctgcgctgattggccgaggcggacgcggtaccgtagagcagcagccaatgggaggcgccgaccgcaggctccggggcgggggcggggtccggagggccggggccgcaccgcccttcgcagccgcctctgccgccgccgccgcgttggcctcgccgcccctgctcgggtaagtgaggcgctgcgcggggctggggtcggggtggctgtccggggacctccaccgcggctgaaaagctcctctgccccgccccaggatcccgggaccccgggccaccgcctggcagggacccctacgcccctcgcttgcgcgtcgcttcccggccgcctggactcccccggtccctgggctccaaaatcccgcctccctggagcctcccgtcctaaaaagttaggcactgagtgccttgccaccggtgcgttcctcgcgctggcccctcgcccttggcaactttgtttctctttctgcgttggtctctctcccaccccgttgccctcttctccttccgggacttcctgggtggttaagccttgccggtccccaaaccccgctgccaggctccatcctctttctcctcttccttcctccccatactcctctcctagatgaccctcgtttcttttctctctctctcctattcctccatcctgccacccgcttctctgcgaccccagacccctcgattgcagcgttgcccctgccctcacacccactgtcccgcccctgcaggcctctttccaaaaacccaccctgctccctccctccgggaacacgtttggggcagtctgctctccgctttgctcccgtctctgccgcaggacggttcaggtttcttctgacagcactttggggagggattgggtaaaggacgaaaatgcttattccgcagcttgagtgatggctgggctcactgaggacctgagtctctgaggtcctgggaaaccccgctgtcaccttgacaccgcttttggggaggcgactttatcttctccgagccatctcaggctttctgcctcctgagggcctgagcttccttgattgctttgtccgtggttactaccaggttgtgcctcttaatttctactttgagcctcaggccccttttaactttctaaagaaaaggcctttgcagcacgacctaggcaggttcatcatttttagttttgttatagtgtattctagcataggatggcattttaggacatgggtcgggtgttttgaagattaattagatcccagctactcctaaagcctcttgttacccgaccaccccagcctccatcacctcgttggtatacaacccgtttttttttttttttttttgtttttgtttttgagacagagtctcactctcgcccaggttggagtgcagtggtgcgattttggctcactgcaacctccgcttcccgggttcaagcgattctcctgcctcagcctccggagtagctgggactacaggtgcgtgccaccacgcctggctaattttttgtatttttagtagagatggggtttcaccgtgttagccaggatggtctcgatttcctgacctcgtgatctgccccctcggcctcccaaagtgctgggattacaggcgtgagccaccgtgccggcctacaacccattttgagcctttcctcttagtgtgtgttttgtgtaggattaaatgcagatgatctgtgccgctgaagtctcaggggcctgtgattcatatattttatcccatgttggataacagtttattaacttgacttatttttgtttccaaagtgtgttatttattatttatttatttatttattttgagacggagtcttgttcttgtccaggctggagtgcagtggcatgatctcgactcactgcaacctcagtcctccgggttcaagtgattcttctgcctcaccctcctgagtagctgggattacaggtgcgtgccaccatgcccggctaattcttagtagagatggggtttcaccatattggccaggctggtctcaaacttctgacctcgtgatctgcccacctcagcctcccaaagtgttgggattacaggcatgagccactgcacccgactctatcattattattattttttatgtagaggcagaatcttgctttgttgcccaggctggtctcaaattcctgggctcaagcagtcctcctgccttggcctcccacagtgctgagattacttgcaggcatgagccactgcatgcagcccaaagtgtgttcttttgccttagaatgtgagccgagaattgacactccttttcctcacaaggtaatttcctaacatgagcattcctgtgtacagaaagtttgtgcctgcagttagtactacacgtgcacctcgtgcaatggatgtgggtgctttttgtctgcctccttcagcagtgcccagcacttagtaggtattcaagaaatgtttgaaaagggttggaggaggcaaaaccacagtaggaaaaattctttccctgtcacttggttcagtagaataaaattatcctggaacaatagctattttactttttgtccaagtttttgtttgtttgttttttgagacgggatctcactctgtcgcccaagctggaacacagtgatgcaatcacagctcactgcagtctcgacctctcaggctcaagcaatcctcttgcctgagcctcccaagtagctgggactaaaagcacatgccaccatgcttggctaatttttaaaattttttgtagagattggggtctcactatgttgcccaggctggtctcgaactcctgggttcaagcgatccttccgcctcagcctcccaacgtgccggggtgggagagagccaccgcgcctggcctaagctttttaaaatctctaaagcgatctatgcttactgtatatatgtgtatgtagtttaccttaaagcaaggtgtcaggtacaaatccacagggcttgctttacccccattctggtgcatcctccagacccttttctattctgtgtacagagagagggaaataaacaaaaatgggcacccatttttaacatatcctgagctttcttccatattagtacttacagttcttaacaactgcatcgttttccattcagtcctctgttgacattgaggtttccagttttccacattcgtgaatgatggtgtgcatctttgaacatgggtccttgcctgcctaagtatttttgtaggttgatcattgtaaacttggaaagcacaaagacagaagccaggcttgctgactcttgactgatgttgccccagtgatgtcactcctgcaaaatgcaaagcctgcgtcctggctgtcggagcatgtgtggacatttggcagcttctttctcttccctcctgctcttctgtttgttttgattgggaaggatatggagtggggatggagaagggtgttgagtaattatcgatggtttctgtatgtttattgctcctgactagcagtgctgggtttcttctctcagaggaaagctgaaagagattgctttgcttttttccagagttttaaaatcagaggtgtgtgtctcgagtgtattttcagacttttttgttagctttaatcatgtaaaacatgcaaaaaaaaaaaaagcatgtggaaacaattttttttttttgagacgggttctcgctctgtcacacaggctggagtgctgtggggcgatctcggctcactgcaaccaccgcctcccatgctcaagtgatcctcccacctcagcctcctgagtagctgggaccacaggtgtgcatcaccacacctggctaatttttttgtgtttttggtagagatggggtttcaccatgttgcccaggctggtctcttatctgctgacctcaggtgatctgcctgcctcaccctcccaaagtgctgggattacaggcatgagccaccacacccggccggaaacaaatttttgaaggaggcatagatctctgttgtgcaaaatagatactttttgtaccactgggtcctagtttgtcattgttccttgcatgatcccatcagatttgtctacagagctgctggggcatgatggtgtggtggcgtattaagaacgcaggttagtggcacacagatgaaataaatgcatgtggggtgcatttttaagatagcaggtgcaaagttgtatatactgagaccaggcattaacacttgcctattacagtgccttttaaaacactatgtgagggccgggtgcaatggctcacacctgtaatcccagcactttgggaggcctaggtgggcagatcacctgaggtcaggagatcgagaccagcctggccaacgtggcgaaaccccgtctctcctaaaaatacaaaaaattagccagtcgtggtggcatgcacctgtaatccgaggtactagggacgctgaggtaggagaatcgcttgaagctgcgaggcagaggttgcagtgagctgagatcacaccactgcactccagcctgggcaacagagaaagagattccgactcaaaaaaaaaaaaaacaaaaaaaaaaaaaacaaaactggaccaaatgaaacaagtgaatctgatctgcagtcagtcagtttgcaacccctgggaagccttggacttgaatgcaaagatcccttgaacttggatctagtttgcctctgctgctcacatgcacatttagagatggccaaggcatacggtgtttctgcttccaagaaacagagtggttgtcctgtttagccatctcttacagtcacacagcttaaagaagataatgtttgcaaacaatttttgaaatgtctagcacacagcaaacagaaggtcaaattcagtacttaatgctgataaaataagagaacccttgcaagtcatgttgcctgctttctgccacagagagtactgcaatagaactttctgacgttttcatgttgtttatttatttattttttgagacagagtcttgctcttgtgcccaggctggagtgcagtggtacaatttctgctcactgcaacctctgcctctgggttcaagcaattcttgggcctcagccacccaagtagctggaattataggtgcgctctaccacacctggctaatttttgtgtttctagtagagacagggtttcaccatgttgcccaggctggtcttgaacccctgggctcaagcaatccacccacctcagcctcccaaagtgctgggactacaggcgtgcatcgtgacgccctgctgatttgtgtatttttagtagagacggggttcaccttgtgctggtctcaaactcctgggctcaagcaatctgcccacctcagtctgccaaagtgctgggattacaggcgtgagccatcgtgcccggcctctctctgacatttttgaatggcaaaggcaaaaatcttatacttttaaggatgtggagaaataggaacacttttacactgttggtgggactgtaaactagttcaaccattgtagaagtcagtgtggtgattcctcagggatctagaactggaaataccatttgacccagccatcgcattactgggtatatacccaaaggactataaatcatgcttctataaagacacatgcacacgtatgtttattgcggcattattcacaatagcaaagacttggaaccaacccaaatgtccagcaatgatagactggattaagaaaacgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaacgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaagaaaaagaaaaaaaaagattgctgttttatgataaagtgaagtgcagctgttacttcttccttctttgcttccagcatctctcttccctaaggattgcttttaaaatgtaagagtttttggttgaaatgctgttcctgtggtttttgtctcttggttggagtgaaagattttgcaggctgtgatacaaatccagttctctgcttattttctcctcagtccttgaaatccaaaaccagatccctcccattggcccgttgtaattagaacctgccccacaatagacgcacctcctaaagcatctcagattcatttctttcctgaggattaagtttttaaaccttcctggccaagataacagtgttttaagaggctcttttcttttattattattattattattattactcttttctttttttgagatggagtcttgctctgtcacccaggctggagtgcagtggcaggatctctgctcactggaacctccacctcccgggttcaagagtttcttctgtttcagcctcctgagtagatgggattacaggcatgtgccaccatgcccagctaatttttgtatttttagcagagatggggttttaccatgttggccaggctggtctcgaactcctggcttcaagtgatctacccgctgtggcctcccaaagtatcaggattacaggcatgagccacagcaccctgccaggcttgggtgttcaaggaagagaaagaaggcagtgtggctgggacataagtgaatgagaggtggtagggtaagaaatgtgtagaaaactatgcaggggcctgatcacattggatcttgcacatctttttccaaacctcaggaggagtcattctgcttttgttgttactggttcctcacttccgcactttattgtatgctgacaaccttccataccatgggactgagactgccctcaatagtatcaccaatgtctttttttgttttttttttttgaggcagagtttcactcttgtcgtccaggttggagtgcaatggcgtgatcttggctcactgcaacctccgcctcctgggttcaagcgattttcctgcctcagtcttccgagtagctggggttacaggagcctgccaccacacctggctaatttcttgtatttttagtggaaatggagtttcaccatgttggccaggctggtcttgaactcctgacctcaggtgaaccacccgccttggcttcccaaagtgttgggattacaggcatgagccaacgcacccagccaccaatatcttaatggccacacagtgctcattgatagatgccttggccctgggctattgttgctatagaattggtttgatgagtacatattacatgagatctgggctcattagagcttatggcttgagcagggactccttggcctaggtttatgctgctcctggccttgttaatgactgctattaacactctaccccctttttatttttttgagatggggtcttgttctgtcgcccaggctgggaggctggaatgcagtgatcttggctcactgcagcctccgcttctcaggcttaagtgatttttcctgcttcatccttctgagtagctgggactacaggcacgcaccgccgtgcccgtttgatttttgtttttgtttttttagtagacacggggtttcaccatgttgcccaggctggtctcaaactcctgacctcaagtgatctgtctgcctcggcctcacaaagggctgggattacaggcatgagccattgcgccaggcaccactctacccttttgactttgagcaagtaaggtcgttgattccatacattcattaagattcctgcgtggcagaaatctaaccccaactggtataaccaagacaaggaattgattatctcataaccttaaatcaggtgtggctgcatctaggtgttcaaatgatattgtcaggacccaggctctccatcccttggcccagctttcctctgttttggcttcactctgaggcaggctctcccttgtgatagcaagatgaccaccggcagtttcaggcttacctccggcttcaggcttacctccagcttcaggcttaccttaccaaccctagtggaaagagagtttcatttttgacagctatgcaaaaggtctggacctgggccctcactggcttagtatgggttaggcccatccttaagccaatcattggctcagcatgggttagatccgtgactgtcactggctgagcatgggggttaggctcaccctatcattggctctgcgtgaattaggcccacctctgtcactggctcatcgtgggttaggcccacccatgagctgatcactaaggtcgtgaataggcatatgcctcttcccaggtgtggaggatgatgtcagatccctctgaactcatgaaatgagtagggtattctcccaagggaatattgtgctgtcacagaagatggaaaaatgaatgcatgtctggaaaaaacaagcaaaactacaaatcattagctttatatgacatttatttattttttgtttatatgtttttgaaatggagtcttgctctgttgcccaggctggagtgcagtggtgtgatcgtggttcactgcaacctctggctcccgggttcaagcgattctcatgccttagcctcccgagtagttgggatcataggtgcctgccaccacacccagctaatttttgtgcttttagtgtagacaggattttaccatgttggccaagcttgtcttgaactcttgacctcaagtcatctgcctgcctcagcttcccaaagtgttgagattacaggcatgagccaccacgtctggccagctttgtatgacatttcgcctttctgccttgatcaaactttcagagaatctgctttccagagggatgagtgggtcgggaaatagcatgttttctctgaatgagggaaaggattgaaaaagtaggagggagaaaggatgtgaatatgagtcccaacaaatgcagagttatcggtaagttttgtgcttgaatctaggtacaattgtgcatttcctggttctgcatgaattaggcccacctctgtcattggctcaacatgggtgaggctcactaacttccaccagaagttagtggtggtgtctgtgttgacacttacatgtttagcctaatgatttcatgttttaaccaaaactatatagcttgttggttatatcttagaaagtgatggtttttgctcattcttttgtccccagggatacacaccagcctctaagttctcttgagggaaggaagggaccttgcacacaatctttttttttttttttttttttttttttttgagaggaagtctcactctgtcacccaggctggagtgcagtggtgcgatctcggctcactacaacctctgccttctgggttcaagtgattctcccgcctcagcctcccgagtagtggggattacaggcgcacaccaccatgcccggctaatttttatatttttagtagagatggggtttcagtgtgttggccaggctggtttcagactcctgagctcaggtgattcacctgccctggcctcccaaagtactgggattacaggtgtgagccactgcgcccggccttggacacaatcttttttttttttttttttgagacggagtctcgctctgtcactcaggctggagtgcagtggcacgatctcagctcattgcaacctccacctcctgggttcaagcaattctcctgccttagccgcctgagtagctgggactacaggtacctgccactgcgcccgcctaatttttgtatttttagtagagatggggtttcaccatattggccaggctggtctcaaactcctgaccttgtgatctgcccgcctcggcctcccaaagtgctgggattacagatgcgagccactgagtctggcctggacacaatcttacttggattcctcatgcccttttgacaagctcagagcctcaaataaattcagaaaataggtgattacatcaaacagcctctatcaacagggagtatacaaaccgttagcccaactgttaatagaagtctgctttcttgctgggtgtggtggctcacacctagaatcctagtgctttgggagtacaaggcaggaggatcgcttgagcccaggaatttgagaccagcctaggcaacatagtaagaccccatctcttaaaaaaaaaattagcttggcgtagtggcctatacctgtagtcccagctagtcaggaggctgaggcaggaggatcagtgccgcctaggagttcaaagatgcagtgagctatgattgtgtcactgcactccagctgggttgacagattgagaccctatctcttaaaaaaaaaattgcttccctcacctctgctgtgaaacagctcaaagtcctgagagccaaggcccctaccgcccacatcctctagctgttggctaatttatttcatcgtcttttaggtaattctccagaattccatcgctttcctctttttcacctcccagttactcctgcactcagttcttcgtctttcctcctccactgtgtagaaactgttcttgctcacaccgccagtgaccgactttcgctcagccttgtggatattttccagcccttatcttccctgcttctctgttgcatccttgtgacactggaatgtttcccttttttcccttgaaaccgcccactcccaggacagcacagtcttcctgattctcatctctctcactctgtttcttctctgcctccttcggttaccatttcttaaactgcccacctttccaatattggcattcttcactgttccatacacagtccctaggcgattcttccatggtcacgaggaaaagagaaaaaccagctatagacgcatgactttcaaatggatattgttgacccaatttcaaccctgagtttcagctgcgatattgcatcttggtgtgtcatggacatgtcaagctgtgaatgtctgagactgggtttgttatctctccttaacccacccacctacccaagagttttacttgttttttttttttttttgagtctcgctctgtcacccaggctggagtgcagtggcgccatctcggctcactgcaagctccgcctcccgggttcaagccattctcctgcctcagcctcctgactagctgggactacaggcacccgctgccaggcctggataattttttgtatttttaatagagacagtgtttcaccatgttagccagaatggtcttgatctcctaacctcgtgatccacctgcctcggcctcccaaagtgctgggattacaggtgtgagccaccgcgcccggccgagttttccttttgattgtcctttttttttgagacgggatcttgctgtgttgcccaggctggagtacagtggcatggtcatgggtcactgcagcctcgacctctccttgcccctcatcctctcgagtagctggaactacagacacaccaccatgaccagctagtttttgtattttttgtagagatagggtctcaccaggttgcccaggctggtctggaactcctgggctcaagcattccacctgctttggcctaccaatgtgctgggattacaggtgcgaggcactgcacccagccaccttctggaagtctttatctctggtgatggggatggtggcggcacccaattgcctaaggtagagccccagaagatgtcctcacctcctttttctctctcccctgccccgaaaagtcataattcatcaagttctggtaagtttgccttctaaatatttttggagtccatttctgttccctccatcttcattcctactttctttttttttagacaaggtctcactctcttgcccaggctggagtgcagtaccgtgatcatagcttactgcagcctcaaattcctggactcatgtgatcctccttcctcagcctccagagtagctaggactacagatgtgttgcaccacaccagtctaattttttaaaaagtttttttgtcaaggtagggtcttgctgtgtttcccaggctggtcttgaactcctggtcccaagtggtcctcttgccttggcctcccatagtgctgggattatacgtgtgagccactgtacctggcctattctcactttctaattcaggccacgttcctttctcttttcttttttttttttttttttttgagatggagtcttgatctgtcgcccaggcttgagtgcagtggcgtgatctcggctcactgcaagctctgcttcccaggttcacgctattctcctgcctcagcctcccgagtagctgggactacaggcacctgccaccacgcccagctaatttttttgtatttttagtagggacagggtttcaccgtgttagacaggatggtctcaatctcctgacctcatgatccgcctgcctcggcctcccaaagtgctgggattacaggcatgagccaccgtgcctggtctcttttcttttttaaataggatctcacttcatcacccaggctttagtgcagtggcactatcttggctcaccgcaacctctgcctcctgtgctcaggtgatcctcccatctcagcctcctgagtagctgggaacacaggcatgtgccaccacagctggctgatatttttctatttttagtagagacggagtttctccatgttacccaggctggtctcaaactcccaggctcaagcgatctgcctaccttggcctgtcaaagtgctgggattataggcgtgagccactgcacctggcctccaccttcctttctttcttgcattgctgcaggagctccccatcttaggccttgtccttcctctgcctgtccatggccaccaggaccagctttttaagcaggagagcccatcatatcacatcactctcttccctaactttctccaatggtttcccattgccactaagtttcttaacatcttgcaaaagccgtctgtgacttagcccctttatttcagtctgtccaggtaggttcccttccactcgtcacctttcaacccaggcttaccagactccctctagctcccctacaagtgcctggctgtttctcctcattccttcttcccctgctcaattaccattgccttccagttctttcatattcttttttttttttttttgagacggagtctcattctgtcgcccagtctggagtgcagcggcacgatctcagctcactgcaacttccacctcccaggttcaagtgattctaccgcctcagtctcctgagtagctgggagtatgggtgcccgccaccacgcccagctaatttttgtatttttttttagtagagacggagtttcaccatattggccaggctggtctcgaactcctgccctcgtgatctgcctgcctcagcctcccagtgtgctgggattacaggcgtgagccactgcacctggctttttcatattctttcacatgctcctcatgtgtcgcctcttctaggaagccttccttgactttcgggttgagttttgaacttcttaaatatcctgggcactgatagaaatgtattttcaggtgcatacatatttcagaacacaccaatgtgtatactcaaatatatgcaatttattgcatgtcaaaatcctgtgcacatttctgtggctatactaggcacatagttttatcataatttacatggggttgggtgcggtggttcacgcctgtaataccagcactttgggaggctgaggtgggtggttcacttgaggtcaggagtttgagaccagcctggccaacatggtgaaaccctgtctctactaaaaatagaaaaattagccaggcgtggtggcgcatgcctgtaaaatcgcagttgctcgggaggctgaggcacaagaatcatttgaacccaggaggcagaggttgcagtgagctgagatcacgccactgcactccagcctgggtgatagagcaagagtctgtctcaaataataattataattattattttatgcgtaatttccattccagcccccactcccccactccctccaccagactgtgaggcccctttagggaaggcaggcatcttggagacgttttatgtggctccctaggtcctttagtaggtgctcaataaatatttgcatagggatatccatgagccttgatgttaacccagggaatataacaggtgagtggattgtgttttgtttgggtttagcttcagatttttggcagtatttaatcatttaacccagcataaagtttatttatttatttatttattttgacacagagtctcggtctgtcactcaagctggagtgcagtggcgccatctcggctcactgcaagctccacctcctgagttcacaccattctcctgcctcagcctcctgagtagctgggactacaggcacccgccaccacacccagctaatttttcgtattttagtagagacggggtttcaccatgttagctagggtggtctcgatctcctgacctcgtgatccgcccgcctcagcctcccaaagtgctgggattataggcgtgagccaccgcgcctggccaagtttttttttttttttctgttaaaggggatcagctgtttaaccagatgtgggtaatcattttgaaaccttctctcctagacaccatgccacaaggagagtgatctcttcccctgttttcacaatggaggactccggaaagactttcagctccgaggaggaagaagctaactattggaaagatctggcgatgacctacaaacagaggtcagtccgagttcacctgcttttccttttttttttttttttgagatggggtcctgctatgttacctaggctgagtgcggtggctgttcctaggcgtgatcatagtgcacagccgccttaaactcctgggcttaagcgatcatcctggctcagcctcccaagtagatgggactataggtgtgcttcatcaggccaggcttttttttttttggcggaaacaggggtctcgctatgttgcccaggctggtcttgaactcctggactcaagtgatgcacctctgcctcccacagtgttgggactacaggtgtgagctctcttttttctataaaaagaacagcaaccatttattgcaggcctatatgtgccaggcagtgtgaaaggcttaacttacactatctcaaaactgcctgtgaaaaaactattagcaccccattatatagatgaagaaactgagcctcagtgaaggcagataacttgctcacagtcacacagccaataagtagcagagctggaatttgaactccagacctatggtcctgattatcctactatgctactttacattttgttttcttattttctttttcttcttttttttttgagacagagtctcactctgttgcccaggctggagtgcagtggtgccatcttggctcactgcagcctccacctctgggttgaagcaattctcgtgcctcagcttctcgagtagctggaattacaggcacccaccaccacgcctggctaattttttgtgtttttagcagagacggggttttgccatgctggtcaggctggtcttgaactcctggcttcacgtgatctgcccgtctcaccctcccaaagttctggaattacaggcatgagccaccatgcctggccttccatcttattttcttttttttttttttgagatggagtttcgctcttcttgcccaggctgtagtgcaatggcatgatctcggctcaccacaagctccacctcctgggttcaatcgattctcttgcctcagcctcccgagtagctaggattacaggcatgcaccaccatgcccagctaattttgtatttttagtagagacggggtttctccatgttggtcaggcagctctcgaactcccaacctcaggtgatccacttgcctcggcttccctaagtgctgggattacaggcgtgagccaccacgcccggtgtccatcttattttctagaagggtttttatcagttcctagatgccatatctggtaagttctttgtgcacagggaaagagcttttccctatgcctagcaaaatatattgctaaagattttaagatttgaaactcgtgttttggtcagggctcatatctgggaggtgtgtgtgtgtgcgtttggtttggcactgtttttatttataatgggtctttataatttgtacatagaggccttattccagtccccttagtttctttcatttattgaaaaattattttaggtccaggcacagtggctcacatctgtaatcccagcactttgggtaggcagatcacttgagctcaggagtttgagaccagctctagcaacatggcaaaaccctgtctgtacaaaaaatacagaaattagcaggcatggtggcatgttcttatagtctcagctacttgggagcctgaggtgggagaattgcttgagcctgggaggtcgaggctgcagtgacgcatgatcacacctctgcattccagtctgggtgacagagcaagactctatctcaaataaataaataaaaattattttagagtcagggtctcactctgtcacccaggctgaattgcactggctcttcacaagtgtgacctatctcactgcaacccctgggaccccaggtgatccttctgcctcagcctcccaggtagctgggactacaggcgtgtgccaccatgtctggctgatttttaaacacatttctgtagagatgaggtcttactatgttgccctggctggtctggaactcctggcctcaagtaattcttaatgagccactgtacccagcccttcctactttctttattctagtttgacttaaaggtaattcaggcttgatatttttaaaatattccttgaatttggccaggtacaatggctaacgcctgtaatcccagcactttgagaggccgaggcaggcagatcacctccagtcaggagatcgagaccagcctggccaacatggtgaaaccccgtcactactaaaaatacaaaaattagctgggtgtggtgccgcatgcctgtagtcccagctactcgggagactgaggcaggagaatcgcttgaacctggaaagcagaggttgcagtgagacgagattgcagcactgcattgcagcctgggtgatagagcgagactctgtcttcaaaaatattactacgtgatgattaacaattttgctgtagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggtgaggggctgagaggaagtgtgctcaggtgtagacaggcgtccaacacaggcatggcatgcttggctggaagaaggaaccctgcaatgagggactccagaccccaggcccatgctcatctctggaagggcctgtgcggcagacgtgatctttgaactctttgtgcctctagtgggtggtgctttttgttttgttttttttttttttttgagatggagtttcactcttgttgcccaggctggagggcagtggcgcgatcttggctcactgcaacctccacctcccaggttcaagtaattctcctgcctcagcctcctgagtagctgggattataggcgcctgctaccacgcctggctaattttttttgtatttgtagtagagacggggttttatgttggccaggctggtctcgaactcctgacctcgggatccatgatgggtggagctttgagaagcaagtcacacacatgttcccgtggactttcttggttgtgtacactgattttatagggcacatggcagggagacttttttttttttttgaaacagggtcttgctctgttgcccagactggagtacagtggctggattacagctcactgcaccctggacgtctcaggtttaagcagtcctctcacctgggccgggcgaggtggtgcatacctgtaatcccagcactttgggaggctgaggtgggcagatcacgaggtcaagagattgagaccatcctggccaacatgatgaaaccctgtctctactaaaattacaaatattagctgggcgtggtggtacacgcctatagtcccagcttacttgggaggctgaggcaggagaatcacttgatggttggaggctgtagtgagctgagattgtgccactgcactccagcctggcaacagagcgagactccgtctcaaaaaaaaccaaagtccttccacctgaacctcgggagtagctgagactacaggcatgcggcaccatgcctggttagtttttgtattttttatagagacagggtttcgctgtgttgcccaggctggtcttgaactcctggacgcgagcagtcctcctgccttggcctcccaaattgctgggattataggcatgagccaccacctggccagggagacatttttagggtatggaggtgttgctagagtaatatcatcaggtccaatattgtagcccttagctacatttggctgttgaaatttaatgaattaaaataaaaacttaattcctcagtcacagtagccacatttcaagtgcttaggagccacgtgtggccagtgagtttccttagtggacagaggggctgcagaccatttccttcattaccaaaaggtgtgttgcactctgccagttcagagcaggtttctcgacctggctgctgttgacattggagcccggatcatcctccgttgggagggactgaggtttgctttgtgggttttttgtttgtttgttttgtatttttgagatggagtcttgctctgttgcccaggctggagtgcagtagcgcgatctcggctcactgcaagctccgcctcccaggttcacaccattctcctgcctcagcctcccgagtagctaggactacaggcgcctgccaccacgcctggctaaattttttgtatttttagtagaaacggggtttcaccgtgttagctaggatggtcttgatctcctgacctcaggatccgcctgcctcagcctcccaaagtgctgggaatacaggcgtgagccactgtgcccagcctgttttttttttgagatggagtcttgctctgttgcccaggctggagtgcagtggcacaatctcacctcactgcaacctccgcctcccaggttcaagtgattgtcccgcctcagcctcttgagtagctgggattacaggcaccctccaccacgcctggctaattttttttttttttttttttgagacgcagtctcactctgttgccaggctggagtgcagtggcgtaatcccggctcactgcaacctccacctcctgggttcaagtgattctcctgcctcagcctcctgagtagctgagattacaggcacacaccgccatgcctggctaatttttgtatttttagtagagatggggtttcaccatgttttccaggatggtcttgatctcttgacagtgtgatctacccgccttagcctcccaaagtgctgggattacaggtgtgagccaccacgcccggctaatttttgtatttttagcaaggacgaggtttcaccatgttggccaggctggtctcgaactcctgagctcaggtgatccgcccgcctcagcctcccaaagtgctgggattacaagcatgagtcaccccgcctgaccacactgtgggatgtttggcagcatccctggcctccaccctctagatgccagtagcattccccgcacctccaaggtggtgaaaaccaaaagcacctctagacatagccaggtatctggagacccagtgctctgcaaggtaaaaaccatcccttctgtacatgctgtagggctcagcaagggatcactaagtcaacaccgtgccccagagactggctctcagccttagctgccagccagcatcactaggccagcttcataaacatccgacaggcctgaaccctctctccccatccccatctccccgccttgctctgagattccatttctcagtaagtctgggtggggccctggcatgtctgtgtggttttctttttctcattaaactcccaatgtacattttgatgagctgcttcatggaagagtcaaaactgtgtgtgcccagggctaggtatgatggacggtgaaaggggaagtgctggttgccttctttgggaagacaaacctaatgccatgaagcagttggggacgtgaagctcagtcacagaactctgatgtgggggcctttcaagagaaaaaggactggctgggtgcggtggctcatgcctgttatcccagcacttcaggaggccgaggtgggcagatcacctgaggttgggagtttgagaccagcctcaccaacatgacaaaaccctgtctctactaaaactacaaaattagctgggtgttgttgtatgtgcctgtaatcccagctacttgggaggctgaggcaggagaatcacttgaacccgggaggcggaggttgcagtgagccgagattgcaccattgcactctagcttgggcaacaagagcgaaactctgtctcaaaaaaaaaaaaaaagaaagaaaaagaaaggactgcatgggttgagggaggctgtgtggagggtgtttgtaggtgtatgtgttgctgacacttggtgcttggggagatggggctgaaggagagttgatctgtacccatcacagacgtggacaagaatgggtgtcgggtggaccttggcaagcccagctttactaatgtataggaaagggtgtgggaccaacaaatggattgggggtttggggcagggcggaggagaggtcccagacacgttgaaggtggtcattgaagctgaagctttctgttggagaccacagagtgcagctggccgtctgcagatccatctgccccataggtgttgtttgatcgccttcaggggtttttgttcagcatttccccatgaacgttttccagcatataaggctgaaagaatttccagtgaatacctgtgtatccaccaccacctaggctctaccaataatatttcccctacttacttgccttttattatatatattcccccatccatcaaaatttgtaaagcttcctgtaaaaagatggatttctggccaggcatggtggttcatacttgtaatcccagccctttgagaggctgaggagggagaattgcttgagaccaggagttcaaggccagcctgggcaacatagcgagactctgtctctacaaaaaaataaaaataaaaaattcattggacatggtagtgcacacctgtagtctaagctactcaagaggctgaggcaggagcattgcttgagcccaggaggttgaggctgcagtgagctatgattgtaccattgcactccatcctgggtgacagagcaaaagttaaaaaataaaaaacctgagtagtggttgtttagaacacacattgttgagtttcccccaatccccatatccgtgacacggagaccttagtgtcatctgcctctccctgtacttggcccacttcacccatttgttaacagctgaacacctgctacacacaatgagcaatgattatcgttctttttgttgttgttgtttttgctgttggagacagagtctccccctgtcacccaggctggagtgcagtggtgtgatctcagctcactgcaacctctgacttccaggcttaagtgatcctcccacctcagcctcccaagtagctgagattacaggcacctgccacaccacgcctggctaatttttgttattttttgtagagacgggttcatgtgcccatgctagtctgggactcctgagctcaagtgatccgcctgcctcggcctctcaaagtgctgggattacaggtgtgagccactgcgcctggctgattatagttcctaaattgaaggggactctgggttgaaaagctgggtaggaggaagattagtggtatgaactgcagtttggagaggataacaggccctccatggatcctgagtaaaatatcaagagaattactcagtaattctctgcttcaagactgagctcttgggcctggcgtggtggctgatgcctgtaatgccagcactttgggagaccgaggcgggcggatcatgaggtcaagagattgagactgtcctcgctaacatggtgaaaccccgtctctactaaaaataaaaaaattagctgggcatggtggcgcacacctgtagtcccagctactcgggggctgaggcaggagaattgcttgaacctaggaggtggaggttgcagtgagctgagattgcgccactgtactgcagccacatgtcagatgcaggagactcagagcacacagcacagtgaagaaacagggtaccttggaataacgaggaccctgccaccagcaagtatttgtcagtcacctaagagaaatatattcagctgggccggacttcttaacaactggcttattcatcacgggttgaatgaaaaagcctttaagggaccaaacagagcatctattgatgcccccatcagctgacagcttattcgaattagccccaaatggcagcacaacatttcagcaacaggttttcatgtccacaggttccgaggagatctctcaatcgccagtgcagtcggtggagcccactcgctgcgtcctcctggagcctgcgtttgaatttaggttaatgacttaagatcctgttttatttggagatgttcccaaataaagggtgtgaggcgatgagagccacgcctgggaacagggcctggtctgcctctacttgctgggtgcagatacttctctgcttacagccaggaaatggggagggtgctgcgggcggcagcagggatgtggtccgccctcctcatccttccaacgctgtaaatcatctgtttgttctttctttggagtcttcttgcacaatggctctcgccacgcctctctggcctaggcaccattacatcaccctgggtgcatccggactttctagcaacggctttgtttacttgattgagtaaagagaagttggccttttttaacttttaaattagaccttgcgcctttcttgtgggaagtgttttctcttatgtttgtagaatctaggatgggtgttttgtgttttcggttttgatttttttttgagatggggtctctgtcacccaagctggagtgcaggggcacaatcttggctcactgcaacctccgcctcccgggctcaagcgattcccctgcctcccgggtagctgggaccataggcacttgccaccacacccagctattttttgtatttttggtagagacgggggtttcaccgtgttggccaggctgttctcaaactcctgacctcaagtgatctgcccgccttggcctcccaagtagctggaactacagccgtgcaccactatgccgggctaatttttgtattttggtttcgccatgttgccccaggctggtgattttttttttttttttaagcgttggcctgggctagagtgcagtggcatgatcatagtttactggagcctcaacctcctggcctcaagcagtcctcccacctcagcctcccccatagctaggactgcaggtgcatgccaccacgcctggctgttcttaaattttctgtagagatggagtcttcctatgttgcctaggctaatatgcctctgccacctgaggtgctgggattgcggcatgaggcaccgcacctggctctgggtgtttggtgaaggaaagtaatttggaagcagagcaggaatagaatcgagagagcacgggaacgggcaggtgatctggattgagatggtttagggctggttagcataattgcttaaggacacctgctcaggaggctggggtttggtcttggcccagtcatttgctactggttgattctgggctagttaagtaattgagtctcagtgttcatgtctctgaagtggaattaaacgagacaacataggaagtgtacttagcctggaggccagcacagaataagtatgtaatggatgttattgctgcagctggcaacagggaatcattgagaagtgcgctggactgtttctttggtaattaacaagatctccctctctgtctctctcctctccttttctctccctttcccttcctccatcttctccctcccttctgtcttagtttttgtttgtttgttttgagatggagtcttgttcgtcgcccagactagagaacagtggcacaatctctgctcactgcaacctccgcctcctgggttcaagcgattctcctgcctcagcctcccgagtggctgggattatagacaacgcaccaccacactcggctaatttttttttgcatttttggtagagacggggtttcaccatgttgtccaggctggtcttgaactcctgacctcaggtgatccacctgcctcagcctcccaaattgctgggattacaggtgtgggtcactgctcccggcctgtctttgtttttaaacccagagattggaatgttctttctgtctccatgctacaacggagagtcctggatcaaaaattcagaataattgactgttgtgtaaaccaagtacatgctgctctcccattgttgtgggcacaaacaacagaagtcattgagattcctttttttttgctttttgagatagctgggtctcactctgttgcccaggttggagtgcagtgatgcaatcacggctcactgcagcttcaacctcccaggctcaaatggtgttcccatctcagcctcctaactgggactacaggcgacgccaccatgccctgctaatttttattttttgtagagactgagtctggctctgtgggccacgctggtgactctttgtaatacggtgataatgtgtgaaagcaggcttgcgttgcccctgtggatgaggcttggagaggtccatgtggctttctttggttgtggacaccttgggcagaatgatttgtctgaagattgctgggggcttcagacaatgatttgtctgaagattgtgggaaccaggtttgggagtgggcaggattcaaggtgctcaaggggcaggaggtgggaggcacttaggacataattgaaacagttattcagtgtgcctgcctgcccgccccctcccagtcccccaccactgccagagagttttgctcttgttgcccaggctggagtgcaatggcacgatctgggctcactgcaacctccgcctcccgggttcaagagattggcctgcctcagcttcccaagtagctgggattatagacgcccgccaccaggcccagctaattttttgtatttttagtagatacggggtttcgccatgttgccaggctggtgattttgggtttttttttttttttgcttgttttttttaagtgtcgtggtctcactctgtggcctgggcgggagtgcagcggcgtgatcatagctcactgcagcctcaacctcctggtctcaggcagtcttcttgcctcaccctcccaagtagctaggactacaggtgcatgccaccacgcctggctgttttcacattttttgtagaggcagagtcttgcccaggctggtcgagaactcctgggctcaagcaatcctgcctctgccacctgaaagtgctgggattacaggcatgaggcaccacacctggctctgggtgtttggtgaaggaaagtaatttggaagcagagccggaacagaatcaagagagctcgggagtgggcaggtgatctggattgaaatggtttggggctggttagcataattgcttaaggacacctgctcaggaggctggggtttgatcttggctcagtcatttgctaccagttgattctgggctagtcaggtcactgagcttcagtgttcatgtctccaaagtgggattaatgagacaacataggtggtgtacttagcctggaggtggcacagaataagtatgtaatggatgttattgctgcagctggcaacagggaatcattgagaagtcagctggactgttcctttggtaattaacatagatctctctccctttccttccctctccctcccttcctctctcctctgtctcccttcctctctcctctctctccctcccccattttatcccctccttttctccctccttctttttctttctttctttgtttttctggtttttttttttttttttgagacagagtctcgctgttattgcccaggctggagtgcagtggtgcaacctccgcctcccgtgttcaagcgattctcccgcgtcagccttctgagtagctgggattataggcatgcaccaccacgcctggctaatttttttgtatttttagtagagtccagatttcaccatgttttcgaggcaggtctcaaacttctgacctcaggtgatccgcccacctcagccctccaaagtgctgggattacaggtgtgagccactgcgcctggcctgtctttatgtttttaaataacctagagatcaaactgttccttttttctccatgtcacaacggggagtcctggatcaaaaattcagaatggcggactgttttaaaaccaagttcatgctgccctcccattgttgtgggcacaaacaacggacgtcattatgatttctttccttttgaggcagcagggagttgcccaggccggagtgcagtggtgccttcacagcccactgcagcttcgacctctcaggctcgaatggtcctcccacctcagcctcgcgagtagctaggactacaggcaagagccaccatgccctgctagtttttattttttgtagaggccaggtctcactctgtgagccgggctggtgactctctttgtaatacactgatgatatgtgtgaaggaggcccatgttgccgtgtggatgaggcttggagaggtttacgtggcttgctttggctgtggacaccttgggtagaatgatttgtctgaagaatgatggaggctataggaatctcaaccctgttgagagtaggcaagattcaaggtgctcagggggcagaggcactcaggacataattaaaacagttggtccgttgtgcctgctttgaatgacacctgcctgttcccaccacgttacatcacttgcctaagagtcagctctggagagaaggttctgttgactgagcctggcttgtctcccgattgtggtgggagggtgggacagaaagcctggagccccacccagggagtgtggtgggaggagtagtttcataaagagagagggtcaggccaggtgcagtggctcacacctgtaatcccagcactttgggaggccgaggcgtgcagatcacttgaggtgtcaggagttcaagaccagcctggccaacgtggtaaaacccggtctctactaaaaatacaaaaattagccactattgttggtgggtggctgtattcccagccacttgggaggctgaggcaggagcattgcttgaacctgggaggcagaggttgcagtgagccaggatcttgccgctgcactcaagcctgggcaacagagtgagactcggcctcaaaagaaaaaaaaaaaaacacggagtcttgctgtgttgcccaggctggagtggagtgttacagtcatagctcactgcagcctctaactcctgggctcaggcagtcctcccagtttagcctcccgagtagctgtgactccaggtggatgtgtgctactgtgtctagccttctcagaagtcttaagtcattcactcagtgtctgtgttgtccttcaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcggtatgggtggaagggaaaagcacgagtgggagactctcctctctgctttttgtccccagcagctgggtactgggccctgtgctgagtatagggaactaagcagtgagcagaacaaagccagtgcccttctggattttagtgcccggggggaaatggacaatagtcgaagaagtgcaatttcattacagcagcaaggctggcagcccagggtgctgtgggggtgtgtaataggatgtattaatttggctgttggcctgggagcgtcaggcgagccttaccaggggaaatgctatttaggctaagaccagaggaatgagtagccatgatgccaggaggggtgtgagacaagaacattccagacagaacaccaagcctgtgctaagcccctaaggtgggaaggaagctttttcaaagaacagttttttgtttttttttggagacggagagtctctgtcgccaggttggtgtacagtggcgtgatttcggctcactacaatccctgcctcctggattcaagcaattctcatgcctcaggctcctgagtagctggaattacaggcacgtgccaccacaccattctaatttttgtatctttagtagggatgggctcttgccatgttggccaggctggtctcaaactccttagcctccaaagtgctgtgattacaggtgtgagccactgcgcccagcccagtgattcctaaactgatgttctgtggtttagcagaatgataatgactaacatttacagaagaattactctcagccaagcagtttttttggataagaacacttgtttttaaaaaatttatatatgaattatatacagtgaaatgcgcagatgtggccaggcacggtggctcacgcctgtaatcccagcacttttggaggccgaggtgggcggatcacgaggtcaggagatcgagaccatcctggctaacatggtgaaaacccgtctctactaaaaatacaaaaaattagccgggcgtggtggcgggtgcctgtagtcccagctagtcgggaggctgaggcaggagaatgatgtgaactgggaagggcggagcgtgtagtgagccgagattgcgccactgcactccagcctgggtgacagagctagactctgtctcaaaaacaaaacaaaacaaaaaacaacaaaaaaacaaaaaaagcacagatgttttttcttttatttatttttggaaacagggtcttgctctgttacccaggctggagggcagtggtgccaccatagtgcattgcagcctgaaacttctgggagcaagtgatcctcctgcctcaacctcccaaagttctggaattactggcatgagccactgcacccggcctcctcagagagttttttttctgcctcattctttttctcctgtccgtctcggacgccatctatacacataacctttttatattgtcaggcaggttcctaaggctctcttcatttttcttttccctaattatttttttgtctttgttcttcaaattgaataatttctgtttatccagtttcaagttgatagacgccctcttctctctccaatctgccattatagcagatgaaatattgaattttcaatatattgtatttttagatgtaggatttgtgtttgttcttttataatttctgttctattgaggtttcttgacatccttgagcatagttgtaagagctgctttgaggtccttttgtgcagttttcaacatctgggtcacattttctttatactccacgcattcaataactttggggttgtattgtaggcagtgtgagtggtgtttcccacgtggtgtttcccacagactattagttgttttttgtttttgtttttgttttaagacagtcttgctctgtcgcccaggctggagtgcagtggtgcgatctctgctcactgcaacttccacctcccagattcaagtgattctcctgcctcaacctccggagtagctgggattacaggtgtgtgttaccacacccggctaatttttgtatttttagtagagatgggatttcaccatgttggccaatctggtctcatactcctgacctgaggtgatctgcctgcctcggtctccgaaagtgctgggattacgggcttgagccaccatacccagccagagatgatgaattcttttatgttcttgatttatttggttttcttaggtggtttacttggctgagcttacagcccaaattctgtctcccctttgatgggcagtagctgaaatctctttgctttttttagccgtaactgggctgctttgtgtctgctctgtgcacgtgtggtttgggggaggccagagatgtgggaagatactatattcagaatgtgggggggcccacggtgatagatttctatccctggagctttaggcaaaaatcttgtaaagatgcagacttcacccagtcttgttctgtttttctaagcgttgttttccagttcctgccagtgcactcagattattgttgtaaacattttacttagaatttatacgaggtttgatctgatacaggtttcctggtcattaccagaagtggaaattcctttcttgtcaatctgtaggagttctttgcatatatatattttttgagatggagtctcgctctgtctcccaggctggagctggagttcagtggtgtgatctcaggtcactgcaaccactgccttcctgcttcaagtgattctcctgcctcagcctcccaagtagctgggattacaggcgccccccaccacgcctggctaatttttgtatttttagcagagacggagttttgcgatgttggagaggctggtcttgaactcctgacctcaagtgatccacctgcctcagattcccaaagctggaattacaggcatgaaccactgtgcctggccctttgtatatttttactactaatcttttctcctgcattgaaaataattttttccgtggtaatcttttgtttgttgactttgtctattgtatcattttccatacaaatatttccttttttctcttttgaaaaaaaattttttatacatgtatttttcatttttaggtcatcagttacatctttttttaaataccttctaggtttgcagatttcactagggaagtctccttggttcttgattgttcatgtgttttgtgttttttttgcaatattttttaattgtttaatttttttgtatccttattccttagtctgcaatgaatttatttttgtatctagtataagatacaagttcaattttatttttattttctttaggtggatagcccagttgtgccagcactgttaaacactgccttttttttttttttttttttttttttttttgagactgggcctcgctccattgcccagagtagagtgccatggtgcaattacagctcactggagccttgacctcctggggcaagtgattctcccacctcagcctcctgagtgtctgggactataggcatgtgccactatacctggctaatttttgtattttttgtagatacagggtttttccatgttgcctaggctggtctcaaagtcctggactcggtctgtccaccttggcctcccaaagtgctgggattataggcatgagccaccatacccggcctttggcatattttaaaattgggttgttcgttgttttttttcccatgatttctaggagatttttatatatttgtctgtgacatgaatggacagtattgggagtttgtcatttgtttccagctttgtctgatgtatattttattgtacagagttactgatttgttttgttttgagtcagagtcttgccctatggcccaggctggagtgcaggtgcaggatctcggctaactgcaacctccaccctcccaggttcaagctattctcctgcctcagcctcccaagtagctgggattacaggcgcccactgccacgcctggctaatttttgtatttttagcggagatggggtttcaccatgttggccaggctggtatttgatttttttgtagtcagatttcttagtcatagttagaagggccttgtgcactccaaggtttataaagcaattagccaagtgttttcttgtagtatttttgttttttctttcttttctatttttatttttgtactaaacgtgcattgtttttgttaatacaatttggccaaatgctgaatagtttagtgttaaaaatcggatgaggtagaagcccagttcaccattatagaatcaataaagttctaggtcaccaaagttttatgtatttatgttttgagacaaggtctctctctgtcgcccctgctggagtgcagtggcacgatcacttcagcctccccagtagctgggactacagtcatgtgccaccatgactcactaatttgtgtattctttgtaaagaccgggtttctccatgttgcctaggctccaaagctttattttaaagacttgaaaatgttacaattttgtgcaagtttaatagttatatttagaacgtttgacagtcttctccaagaacaagagtttctcagcaccatcagctgtttgattgctctcatggtccttcttctatacgtccctcaaacgaaactactcacttttaactgaggacaggcactttgtataagaataaccttgaaaagtgtgcaggacctaattggaagtaactaaaaattaaatacatttcctaaaggttactttgtttcatatgagtactaagatgccaaaaagttttacaaaaattcaaatagatttaatctagttttactcttttcataagtttttcattttattttatttatttatttttgagacagagtcttgctctgtagcccaggctggagtgcagtggtgcgatcttagctcactgcagcctctgcctcccaggttcaaatgattttcctgcctcagcctctcgagtagctgggactacattgcatgtgccattatgcccagctaatttttctatttttagtagaaatggggtctcaccatggtcctgacctcaagcgatccaccacctcggcctcccaaagtgctgggattatagccgttagctctcacacccagtccaacttacacattttttttttttaaagagatggggtcacacagtgtttcccaggctggtctcaaactcctggattcaaacaatcttcccatctcggcttgccaaagtgttgggattacaagcatgagccactgtgcccagccaattccatggacttttaaagcattttttggctcaaaaaggatatgttcttagttatctaaccagtatatctctttatatttactgaaaatctgttttcctatttaagtattttcaggttctcaataactgcacatgaaattaacagctttcatagtcacaaattattgcaatattttgctgttatactaaatatgggttttttttgtttgtttttaagacagagtctagctctgttacccaggctggagtgcattggcacaatcttggctcactgcaagctccgcctcccaggttcatgccattctcctggcctcagcctcccgagtacctgggacaacaggcacccgctaccacgaaccggctaatttttttgtatttttagtagagatggggtttcgccatgttagccaagatggtctcgatctcctgactttgtgatccacccgcctcagcctcccaaagtgctgggattacaggcactaaatatgcttttatacattagttgacagaatttcaacatataaaatacataaagcaattttcactccagttacaactagcatgctgacctttatttcaaagtaaatacgctaggtgagatagctcatgcctgtaatctgtcatcttagtacttggggaggctgaggcttgagtattgcttgagcccaggagtttgaggacatcctgggcaacatagtgagactcccgtctctagaaacaaatataaaaactagccggctatggtagcttgtgcctgtggtcacaactactcgggaggttgaggtaagaaggtgaaagaatcgctgggcgcattggctcacgcctgtaatcccagcactttgggaggctgaggtgggcggatcacctgaggttaggagttggagaccagcctgacaaagatggtgaaaccctgtctctactaaaaatgcaaaaattagccaggcatggtggcaggcgcctgtaatcccagttacttgacagactgaggcaggagaatcgcttgtacccgagaggcggaggttgcagtgagctgagattgtgctgttgcgctccagcctgggcaacagagtgagacttcatctcaaaaaagaaaaaaaaaggtgaaaggatgacttaaacccagggtgtcgaggttgcagggaaattcagaaatgccactgaagggccaggcatggtgtccaacacctacaatcccagcactttgggaggcagaagcaggtgcatcacctgaagtcgggagttcgagaccagcgtggccaacatggtggaatgctgtctctactaaaaatacaaaaattagcaggatgtggtggtgcgtgcctgtaatcccagctacttgggaggctgagacagaagaatcatttgaaccccggaggcagaggttgcactccgcctgggtgacaagagtggaactccatcttaaaaaaaaaaaaaaaaaaggcactgaagctggtccccagttccctagcattccagaagcaaaatagattttgaccaaataaggagtttgttaaaatttccgattcagtcggagtttgtgttagggtacagtatgaggtacgaatctaataattttttcctggtgggtacccagtggtccctaaaactagaactgaacctgccatctttttaccaatgatctgtgatgccacctttattataaattaaactcttgtctatttctggacctttggttcctttgttcttacaaccagtagcatactattcttcattgttgaggctttatagtagtgcgttctgactctctggtagagctagttccctgatctcttttacagagttcctctgatcattcttgtttcattgtcacaggatctttcaaatcagtccagtttattcccccagtagaaacgtattaagacagtgttaaatttatcagtttaacttgtggagaattaatttctgcatgataatgggtcttcctctttatatactcagtatgtctgcatttctgcaagcattctgtactactctacatattattatgtgaatattttatctttgatatgtcaaccttagggctgttttaactgtttctggtattgtactccgaagtattatccctttgttgttggtagtagtgtgttttttgtttttgtttttcgagacagggtctggcattgttacccaggctggagtgcagtggcatagtcatggcttactgtacccttgaattcctgggctcaagcagtcctcctacctcagcctccgagtagctgggactacaggcacgcatcatgcacggctaatttttttactttttgtagagacagggtctctctatattacccaggctggtcttgaaccctgggcctcaagcggtcctcacaccttggcctcccaaagtgctgggattataggcatgaaccactgtgcttgtccctttgttgtttttaatcggtactgtggtaactttatcctatccactacttctaaagaccctgtgagggtaggtacttgtatgactccatctagacatagtaggatatgttgaataaatgaactgatgcagccattaatcagtgcagttattaatttggtgattgaaggaactgaggatgaaggagatcaagttccgcaatgatactcagtgagttctaggtggaggaggagctgggtgttaactcctgggttcctctccaaacacgtgcttctgaccactgtgggatacagttagcaggttgtgtaaggtctggggacagacacagggtcaataataaaaattgctgaaaatttatagatgtgtgcttatgtgtaaaacatctgttgtgtgcttcctgtaggattttttttttttttttgggaaacattcttactctgttgcccaagctggagtgcagtggcatgatcttggctcactgcaacattcaccttctgggttcaagcgattctcctgtctcaccctcccgagcagctgggactacatgtgtgcaccatcatgcccggctaatttttgtatttttagtagagatgaggtttcaccatgtcggccaggctggtctcgaactcctgacctcaagtgatccgcccgcctcggcctcccaaagtgctgggattacaggcgtgagccaccgtgtccgggcctgtatgacttcttgccaccccttccccaccacaatcctgcatgaaggttactattactatccttgttttgcatgagagaaaactgaggtgcagagaaggtggttttcccagaattataacagattgttttcttacagcacttggcagtgcctttaccacagtgtttatgcccttcacaagaaggggttgtgagcagggcagctgggctggtactgggcattttgaacttccactgagaggttaaatatgatctcttccacctgcttaagtgcatcttatgcctggcacaatgcctcatgcctgtaatctcagtaactcaggaggctgaggcgggaggatctcttgagcccaagagtttgagattgcagtgagctgtgattgtaccactgcacttcggcctgagagacacagcaaaaacctgtgtcttaaaaaatcatgttgttatatgtgtttattaggttattattattttgagatggagtctcactttgttgtctaggctggagtgcagtggtataatctgggctcactacaacctctgcttcctggcagttctcccacctcagcctcccaagtagctgggattacactacaactggctaatttttgtatttctagtagagacaggattttgccatttgcccaagcttgccaggctggtcttgaactcctgatctcaggtcttccacctgcctcggcctcccaaagggctgggattacaggcatgagccaccttgcccagtcatattaggttatttttaatgctggttggcattgtgagcttgcaagagaagatggagcatagtggtcttctcaaaccaccaaatgccacatgcagtcctgatagggctttggcttattgctgagtgctgtgtgggcagcatcttatttaatcctcatgacagcctcgtgcaccccatgagctatgatgagtcccattctgcaggtaaagagcccatgccccagaaggttaagggacttggcccactctgtggcatctaggaagtttggggctgggacttgtgcccaggtgtgtctgacccttcgcacctcctggatccgcggtgctggagggatgctgcggtttgtcctcttggataactctgcttttctcttcgccagcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagaggtcaggaggccttggtgtcttcaccagcatggtcccctctccctacctgagcaacatcttgtcccacaagctctcccagcattatctttacagggaccccacaccctgctctgcacccaggttgtctaatcagagggtgtcggactgcactgggcagactcttgccttgggccctggctggagctgagaacagtcagacatccagccctgtaagggccccttatgggtatttagagaaatagctttggggttcacagatgaagtccttgtattgggattctgcctctgggcagcagaatttatttccagaaagatgcttcctggtctgtaattcacaaacacagcaaactaccctgatgctcagtaggaacagagagttttgtggggagatctggcacagtggctcacacctgtaatcccagcactttgggaggccgaggatctcttgagcccaggagtttgagaccagcctgggcagcatagtgggactccatctttacaaaaacatttaaagattagctgggtgtgatggcatgtgcctgtagtcccagctactcaggaagccaaggtgggatgattgcttcagcccaggaggtggagtatgcagtgagctatgatggcaccagtgcactccagcctgggtgacagagtgagaccctgtctcttaagaagcaaagatgttgtggggagaaatttctggtggaattgccagctagcctattatttttgtgacttgatggcaaccaatatatttggctaaaactttgaaacctcatcagcatttgctctttttcagttggcacttccagaggtagaatgttgaaactgtaatgaggcatttggccaggcacagtggttcacacctgtaatcccagcactttgggaggctgaggcaggtggatcacctgagctcaggagtttgagaccagcctggacaacatagagaaaccccatctctactaaaaatagaaaacatgagggtatggtggtgggtgcctgcaatcccagctgctcaggaggctgaggcacgagaattgcttgaacctgggaggtggaggttgtagtgagccaaaattacaccattgcactccagcctgggtgacagagtgagactcttgtctcaaaaaaaaaaaaaaaaaaaagacattcattagtggattgtccaagttgtttttacctttttttttttttttttttttttttttgagatggcgtcttgctctgttgtccaggctggagtgcagtggtgctatctctgctcactgcaacctctgcctcccaggttcagcgattcccctgcttcagcctcctgagtagctgggactgcaggtgtgcaccaccatgcctggctaatttttatatttttaatagagatggggtttcaccatgttggccaggctggtcttgaactcctgaccccaggcgatctgcctgcctcggcctcccaaagtgctgggattataggggtgggtcactgttgctggcccaattaattatttataacgtcgatttgctttctaatgtgtaaccagtaggtgggggataaaaagtaaaaattcttaagtttaataaagtagttgttcctagatgtccatcagtaatgaagtggttaaatgaagtacatagatgtattttgtgaaatgttaatggttaaaatgaacagtagatagaaatgttgtggtagaaagattgccaaggctaggcacagtggctgatgcctgtaatctcagtgctttgagagacggacgcaagaggattgcttgagcctaggagttcaagatgagcctggacaacatagtgataccccatctctacaaaaatgaaaattgtaaaaattaggcctggtggcatatgtctgtagttccagctacttaggaggctgaagtgggaggatgacttgagcccaggagttcaaggttacattgagctatgattgtgccaccgcaccccagcctgggtgactgagtcagaccctgtctctaaaacaaaaatcattgccaagacataccactgaagtggggagagtaagtcatacacaggacaacatattgtatgtttccagtaatgcttaataaaaaattttcttgttttatgctcagtagatacatacatatgtataaagtttatgtttgaaaatggagagaacagctgggcgcagtggctcacgcctgtattcccagcactttgggaggccaaggtgggtggatcacctgaggtcaggagttagagtccagcctggacaacatggtgaaaccctgtgtctactaaaaatacaaaaattagccaggtgtggtggtgcgtgcctgtaatcccagctacttgggaggctgaggcaggagaatcacttgaacccgggaggcagatttacagtgagccgagactgtgccactgcacttaagcccgggcaagagagtgaaactccatctcaaaaaaaaaaaaaaaaaaaaattcagagaacaatggttgaaaagctctcccacatgttatggtgatgatgagtgaggaggagcatttggggatagtctggaaagcatactttatttatttttgagacagtcttgctctgtcacacaggctggagtgcagtggcgtgatctcagctcactgcactcactgcttgtcccccaggctcaagcgattgtcttgcctcagcctcccaagcagctgggactacaggcgctcaccaccacgcatggctaattttttgtatttttaatagagacggggttttgccatgttggcctgaaaattcctgacctcaagcaatcctcccatctcgacctctcagagtgctgggattataggcttgagccagtgcaactggcctttttttttttttttcttttttttttttttttttttttttttttgagccagaggtctcactctcgcccaggctgaagtggtatgatcatggcttactgcagcctcgacttactggattaatgtgattcttacacctcagcctcccaaagtgctgggattacaggcatgagtcactgctcccgggcatattttcatttagtgttctaaatacactgctatgttggaattgttttttcaataataaaagcattagtgtgtcactgtcatagctttttaaaaatctgaaaccattttgttagtcaagagaaacatcctgtagagttccaagtctgctaggcaaggtcctgtgggtttccctttatttggggtttctacctggagtgtttcaccccagtaggtcttttttctgactggtatctactgttgaacctctctccctgcaccccaccaaccctaagcaaggacttaaattccctttttgttttttgagacgtagtcttgctcttgtcacccagactggagtgcgctggagcaatctcagctcactgccaccctggcctcccaggttcaaatgattctcatgcctcatcctcctgagtagctgagattacaggtgcctactaccatgctgggctaatttttgtattttcaatagagatgaggtttcaccatgttggtcaggctggtctcgaactcctgacctcaggcgatccacctgccttggcctcccaaagtgctggcattataaacatgagccactgcgcctggctgaggacttgaattcctgaatcctttttctggcacagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggtaaggggagtgggaattgcaggattttctcggttcacaaagtgtttctgggtaagaatctggggtgggtcctgggggtgtgatgatttgcatcaggctcagagcctgatttgctctcaggctttgagcagagagtagactgggatgttcttggggatgggcattgagatcagtgaggactgggtaagaggcagtagtggagtctgatgaaatggaaaccccacccagagcgggtggctgccactctgcagctacgaggattggcccttcatctgcagctttttccattcttcaaagccagaaatcctctttttttttgttgggtttttttttttgagacaggatctcactctgttgcccaggctggagtgtagtgacgtgatcttggctcactgcaacctcttcatcgtgggctcaagtgattctcccacctcatcctccggagtagctgggactaaaggcacctggctaacttttgtattttaggtggagacacagtcttgccatgtcgcccaggctggtatcaaattcctggactcaagtgatccgcccacctcggctgatcccaaagtgctgggattacaggtgtgagccaccgcgcctggtcaaaaatcctcttgttgaatataaaacctcccaaatttgaaatgtcactgaccaaatacaaaaaagtaaaaagcgttctgtgggtttagtaatacatccaccgagagctagactcagcgtaacgtgtgctgcatgggcagaaaaaaagaatctcagttctcaccccagcccctctgctgacagcttccgatcaggccttttacagcagatattaataacagacagttaaggagtgctcagtgtgtgctggccagcctgcagccttcgccgcaggcccaggatgcaggtgctgtccccgtttgatgaaagtgaggctctgagttaagcagagtcatgaagcaattgaatggcagatggtttgggattcagacccaggcaggcaggctccagggcttaccctaccatctactaccttatcccttagcttgtcccctgggcatgaagagaccagtgagacttctagaattccggtgcagagcccttctgtttagttttgttgagatggagttttgctctgttgcccaggctggagtgcaatggtgcgatattggctcgctgtaaccccctcctcccaggttcaagtgattctcctgcctcagcctcctgagtaagcttgaattacaggtgcccaccaccatgcctggctaatcttgtatttttagtagagatggggtttcaccatgttggccgggctggtctcaaactactgacctcaggtgatctgcctgcctcagcccctgaaagtggtggtattacatgtatgagtcactgtgcctagccccagtctagagccattttgcatactttatttcattgttgtttttagagacacagtcttggtctgtggcccaggctggagtgcagtggtgcaatcatagctcactgcagcctccaactcctgggctccagtgatcctcctgcctcagcctcctgagtagctgggactagaggcatgcaactccatgcctggctatgtttccacacttcaatatgcatgtagcttacctggggatcttggtagaatgtacctcagatcaagtgggtcttgggtggggcctgaaatttctttctctctttttttttttttttgagacaaagtcttgctctgtcggccaggctggagtgcagcggcattgatcttggctcactgcagcctctgcctcctggattcaagcgattctcatgcctcagcctcccgagtagctgggattacaggcaggcacctgttaccatgcccagctaattttgtatttttagtagaaacaagattttgccatgttggccaggctggtcttgaactcctgacctcaactgatcgaactgcctcggcctctgaaagcactgggattacaggtgtgagctactgtgcctggccgagagattctgcatttctaacagttctcatgtgctgctggtgcatggaccccacttggagaagagaggctctgcagagcgggacccttgtaaagctggatcatcctgtctatagttcttgtatctatcacagatgccattatgttaattaactatatggattttctacaatttcaaaaggatttgttttgggtttgtttaaaaagactaatgtggctgggcacggtggctcatgcctgtaaataccagccctttgggcggccaaggtgggaggatcgcttgaaactaggagttcatgatcagcctgggcaacatagtgagaccctgtctctattaaaaaaaaaatttgttaaaggccaggcatggtggctcacgcccgtaatcccagcacttttggaggccaaggcgggcagatcatttgaggtcaagagttcgagaccagcctggacaacgtgatggaactctgtctctactaaaaatacaaaaattagccgggtgtggtggcacatggctataatcccagctactcaagaggccaaggcaggagaatcgcttgaacctgggaggcggaggttgcagtgagctgagatcacatcaccgcactccagtccgggtgacagagcaagactaacatgtaaaaataagtatttgttgcagtcatcacaaggacttgaaaaattggttgtcatacgggccttgggtgtgtgatgcggttaactacggaaagaaatagggtagcttttgggatccgaggaaaggcgtcagtgtccctcctgtcccgtggttttggatctagcgatgttaacgcacagacatgactataggttggtgagttacatgctcttccctttgcacacccaggcctggacgactccaccggggggacccccctcacacctgcggcccggatatcagccctcaacattgtgggagacctactgcggaaagtcggggtaagaccacactttcctggcgtttggtgccttcctgcctgtctttcaggatgtgtgaagggggttgatctagttccttccctctcttctttttttctttttttttagagacagggtcttgctctgttgctcaggctggagtgtagtggtatgatcacaactcactgcagcctcaaaatcctgggttcaagcgatcctctcaccttagcttcccgaggagcttggaccacaggtgtgcgccactatgcctggctgatactttcatttttttgtagtaatgtgggtatcgctgtgttgcccaggctggtcttaaactcctggcctcaagtgatcctcccaggttggcctcccaaagttctgggattacaggcatgagccaatgcgtccagcccctttcatagcagtgtggtgagttttaggtgtggctgctcctttagcatccctgggaatcattagagcttcctgtgggagttactgccagacactcagagctctgactcgaagccctgctctgaaccctatgtatgtctctttccttttaccgtttttcctctaggaaatttgggaaattagggtgatatgtgtgttttttccttaactcgaaaaattaaggagcacttggaaactgccttctcttttggccgggtgctcatacctgtaatcccagtgctttgggaggccaaggtgggagattacttgagctcaggagtctgacaccagcccgggcaacatggtgaaaccccctgccccgacttggcctctacaagaatgcaaaaattagccaggcctgatggtgtacactggtggtcccagctactcaggaggctgagaggtgggaggattgcttcagcctgggaggttgaggctgagtgagctgagattccaacactgcactccatcctgggtgacagcacgacgttgtctcagaagagaaaaaaactgccaccttttttttttttttttttttttttggtttgtttcttggggtttaagtgaattttgacactttgggagaccgagatgggtggatcacctgaagtcaggaattcaagaccagcctggccaacatggtgaaaccccatctctactaaaaatacaaaaattagccaggaatggtggtgggcacctgcgatcccagctacttgagaggcttatgcaggaaaattgtttgaatccgggaggcggaggttgcagtgagctgagatcgcaccgctgggtgacaaagtgagacttggtctcaaaaaaaaaaaaaaaaaaaatcttgaaagcctagggcaaagaatttggcctttcagcttttatgttaattacagggagggatccttttgtgcttaagtaaaaacataggtattctttgtagtttatttttaaaaatgatgcctagaaggccacataatttaactcctaccaagttgtcactgtacacagtgtatttgtagctacaacttaatagaagcttgcaactcatttcttttgtttttacttctggtttttggctgtctggtttgctattctagaagcaggtctgcatttcagtatttagcctagttggagtatagagaagcctggggtgctgtcagtgtccttttggtttcctcagggtctgttgtagccagaccaagtccttaccaaacttcttgccattctgcagaggtttaacaaggtaaaccaaagggtgaaggattccagaagtggatttcctacttcctacaagcggagttggataattggtaggttagtgatttttccagaaagctcccattttaaaaaattttttgtaattaaaaaagaattttttttttttttttaagccaagcatgattgtgcatagtcctagctattcaggaggctgaggtggaaggattggttgaggctgcagtgagccgtgatctttttccaggcagctcccaaacattttaaaaaatttttcgtaattaaaaaaaattttttgcattaaaaattttttttattaactgggcatgattgcggatgcctataattccagctgctcaggaggctgaggtgggagggattggttgagcctgggaggttgaggctgcagtgagctgtgatctcaccagtgcactccagcctgggtgacacagcgtctaaaaaagtaaaaaacaaaacaaaaaaaaaaactgagatgggatcttactttgtggcccaggctggtctcaaactcctgatgtcaagccatcctcctgccttggcctcccagagtgctgggattataggtgtgagccattgtgcccagccagctcccaaatacttaaggtgcttggttctgagactggcatatacgttggattcctcttggggtcccaccttggaattccagtgcacaacagtttgagaaccactgtctggggttcgttcttctgtacaggctctggtaagacagaatagtccttgcctataacttgagagataaaagtgtatttctgtccaggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggtcagtaccttctaataaacctctcgctggcggggagaacccgcctgccccaggcaagagacactcacccccagcccacagccatgtgtctttttaaattataggattatttcagcaaaccttatcctctcctctgctccctgcaggcagcattaggtggtgtcttgtggcttgaacaaagggctagagagagggtcttgttttgtgagacagggtctcactctgtcacctaggctagaatacgatggcaggatcatggctcaccctctgcctcccagctcaaacgatcctcccacctcagtcccccgagtagctgggagtacaggtgcgtgtcaccgtgctcggctaattttttgtattttttctagagacaggttttgccatgttgccgagtttggtctcaaactctgagcttcaagtgatcctcacccttcatcctcccaaagtgctgcgacgacaggtgtgggctaccatgcctggccaagaaggtcatttttatcatttgattctacagctgctactcacggttacactgtgagaatgtcctgtataaaagcccttatttgggccaggtgtggtgacgctcgcctgtaatcccagcagtctgggaggccaaggcaggtggatcacttgaggtcaggagttcaaaaccagtctgggcaacattggtaaaaccccatctccaccaaaaaaaatagaaaaatgagccaggcatggtagcatgtgcctatagtcccagctactcaggaggctgaggaaggagaatcacttgaaccctggaggcagagattgcagtgagccaaaattgtgcctctgcacagcagcctgggtgacagagcaagactccatatcaaaaagttaattaattagttaaataaaaataaagcccttatttggggaattgagcatcagtcatggctctgcttcccctgaagtttttttttttgttttgttttgttttttttttgagacgtcttgctctgtcgcctaggctggagtgtagtggcatgatctcagctcactgcaacctctgcctcccaagtccaagcaattctcctgcctcagcctcctgagtagctgggattacaggcgtgtgccaccatgcccagctaattttttgtatttttagtcgagacggggtttcactgtgttaggatggtcttgatctcgtgacattgtgatccacccacctcggcctctcaaagtgctgggattacaggcgtgagccactgcaaccagcccttttttttctttttaaatctgtagaacctttgagaaactggcactaacttctagcccagactatgttcctgaaaccagccacccgatgggacagtgcagatctgatctctaacagtgtcattaattttcttgcctaaagaaaatcagggccaggctcagtggctcacacttgtaatcccagcactttgggaggctgagggcagcggatcaattgagctctggaggttgaggccgcagtgagccgtgttcccagccactgcactccagcctgggtgatgaagcgagaccttgtctcagaaaaaaaaggggcagctttcagattcaggaattctgcaaggtgtgtgactaccatctctctgggccccaagccgtaggaatttgatgggtttgtagcagacacgtgacaggaaattaagaatattttccatggcatgcacataactttgagacctttacacgtggatttttaggccaggtgcagtgaagtggctcacacctgtaatcccagcactttgggaggcagaagtgggtggatcacttgaggccaggagttcacaagaccaaactgggcaacatggtgaaaccctatctatactaaaaatacgaaaattagccgggcatggtcgcggatgcctgtagtcccagctgcttgggtggctgaggcacaagaatcacttgaacccaggaagtggaggttgcagtgagccaagattgcaccactgaactccactctgggcaacagagtgagactctttctcaagaaaaaaaaaaaaattaatttttgtttgttttctttctacgagacagggttttgctgtgtcacccaggctggagtgcagtggtgcgaccatagctcactgcagcctcgtcctcctgggctcaagccatcttcctgcctcagcctcccaagtagctggggctacaggtgcacaccaccacccctggctaattttttttatattttatagaaacagtcttgctatgttgcccagactggtctcaaacctcctggctttgagtttgagaatacacctctgagactgtagtctgcttctcattgagatttctagaggtgagttttcagattaattttccaggcgatcttcccaccttgacctcccaagtgctgggggttacaagcgttagcaatcatgcctggcctttttttttttttggagacagggtctcactctgtcacccaggctagactgcggtggtgtgatctcggctcactgcaacctccgcctcctgggctccagcgatccttccacctcagcctaccaagtagctgggactacacatgcaggccaccacacccagctaatttttgtttgcatttttcatagagacagggtctcactatgttgcgtaggctgtaaaacaaacaaacaataggtaagagatggatttttctagtgggtctgagactgggcgttttgtgtgaccttggaatctgagagccaggtagccagtgtcctcttcttcatttcacaggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttgagacagagtcatgctcttgccctgtcttgtccaggctggagtgtagtggtgcaatttcggctcaccgcagcctccgcctcctaggttcaagcgattctcttatctcagcttcccaagtagctgggactacaggagtgtgccactacacccactaattttgtatttttagtgagaaacggggtttcaccatgttggccatgctggtcttgaactcccggcctcaagtgatcctcccgcctcagcctcccagagtgctggaattacaggcctgagccaccgtgcctggcccctgattggtcttgacaggtgtttttaatgtcccaagtctccgtaaatgtgggatggagcttctctcagaggctcttccccccaactcccaaccaggtggaatcgtcttccagaacaaaatctcccagtgctttgtggtgtactgaaatcatgtctaagaacagagaacttaacagtcacatgcctttttaaaaactggaataggctgggcgcggtggctcaggccggtaatcctaagactttggaaggccgaggcgggtggattacctgaggtcaggagttcaagaccagcctggccaacatggtgaaaccccatctctactaaaaatacaaaaaattagctgggtgcagtggtgcgtgcctataattccagctactccagatgttgaggcaggagagttgcttggacccgggaggtggagggtgcagtgagccaagattgcgctactgtactccagcctgggcaacagagtgagactccgtctccaaaaaaaaaaaaaaaggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccatggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaatgttgaacttgttgggcttctggtcaaagaggctttgtatgtttatactttaatgttttcccacagagtggtgaaaaactttttttaaccaagttaaaaaatatgaaaaaatctttttgaaaatttctattcaagccaggtttttagaaatgtatccgggatgtgtttgtgcgtcattcaaggcatattagcatctggtcacaagatggagtcctttgtttccatgtttcctgtctcccaaatctgtctgatcccatggagttggtggtatacggcatcgtttgtgttgaacagagcctttgcaggcatgtctgtctaaaacactcaagctgaaagaaggacagggcctacagcttgtttttatggcccttactctaagaatgatttattatgtttttaagggttgttttaaagaagatgaatattcggcaagaccatatgtagcctgtaaaggctaaaatactatctggctgggtgggtggtggtggtggtgtgagagacaaggtgttactgttacctaggctgcagtgcagtggcgtgatcatagctcactgcagcctggaactcctggctcacatgatcctcctgccttagccttccaagaggttgggagtacaggtgtgcactatcctgcctggcttactaacaacaacaacaaaaaaacaccttttttttatagagacgggggtctctctcggctaggctggcctccaactcctggcctcaagtgattttcccatctcagcctcccaaagtgctgggattccaggtgtgagccactgtacccagccaccatctgacgttttgtggaaagtgtttgctgactcattggacaagaccttgtgttttaactcaaaaaatcaaggaaatcctgtatttttcttaagatactggttttgatgagtcaagatgttcttcccagtcatgttcgagggcagggggcagtggcccttagaccacacatcaccttatttctctcccctgccctccctgctgagcggcccagtaacccccttagacagtctcactttgcatctctgctctgctctctggctggctgtggggttgtaggcaattgatttcacctctctaggcctcagtttctgcattcatgacgttaaccctgacttcagagaatctttgggacgatgaagcaaaacccagccttccccaactccttttcctctatagaaaacagctcaacagaaaagccaacgacattgtgatttataaccatttattagtgaaagtgtttttaagcacagtcagggtgtaaacagtgcagcattcctgctcccctccgtgggagcagcgtctccttttcaattcatgtgactacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggcacccatttcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaacttcaatttttaccttgaatacaggggtagtaggggtggtggtggtggtggtggttgagacagggtctctgttgcccaggctggagtgcaatgatgcaattatagctcattgcagcctcgaagtcctgggctggagcgttcttcctggctcagcctccctagtagctgggaccacaggtgtgtaccaccacgcccagcttatttttaaattcttgtatagatgaggttttactacgttgcccaggctggagggtggtggtttttatattccttgtgtgaggggtgtctgtgatatttggaatttgagaatggatttagacaatgctaagtacagtctgctgggttttgctttgttctgggttgttgttgggttttttttgtttgtttgttttggtttttggttttcttgccgtggtgcaaaactgtagaaagttgcttattcactggccttggttccattgaagtctgcgtctcgagtgtccgtttcctcctcagaaccatctgcattttcaataactctacgtcctccagaccttctagaaggaacgaaagaggtctcgtttcctcgcctgtgggttgtaagaaaacacattatttagcaaagaaatcttcatggttgggatagattttttataaatctattttaaacttgtagctatagtcctattgcaatataaattttttttatggcagaaaacacacacggcacaaataagatgcagatattcaagttgaagtcaacaaatcattgccagtcttaaggcatgagtgattgaatttaatcagctgaaattggttgcgggggtgggtggagaaggtttttcaaagcaagacgatctgcttttcaatatgtcaggcttggtcatttgagaagccacaggattctggtctgctgtggtctttgatttagaataggaaaaaaacgccaaaaaccaagcaggggattttgtcttctgactttattcatagcccatggggcagagttgaagagagaacatactgtttttcttctgtatctcctcacccccattcgccttagaggtgagttttcaagatttgaattggaagaaggtgaaatggacaagggcagccttgagaaggacacagaggggctccctggttaaaaggcgagacagcaccccctgctggtgtgaatgttcatggactgagttttccccactgcagggactgctgcatctgttttgctgatcgtggaacataccgcacatggcgtaaaacaggtgcccagtgaatattagaaaaggaaattatacgtgttaatccaaggtggattattttattaaattgagatgaggtcttgatattgttgcccaggctggtctggaactcctgagctcaagcagttctcctaccttggcctcccaaagcgctggcattacaggcgtgggccaccacacctggccttcaaggtggatttaaaaaagaaatttaagagtctctctcacccaggctggagtgcagtggcatgatcttggctcactgcaacctctgcctcctgagttccagcagtccttgagcctcagtattgagtagctgggactacatgcacgtgcacactgccacgcctggctaatttttgtatttttagcagagatgggattttgccatgtgacccaggctggtcttgaactcctggcctcaaacgatccacctgtcttagcctctcaaagtgttgggattacaggtgtgtgccagtgcacctggcctctgaggtggattttagctccagccagtaggacacccctgtctctccttaatgctgccatctcctctctgcgctggttctctcttgagtttatcacctcgacttcacaggaagggctggtcacgtgaggggagactttgggtaggaggaagagagtgggcagaagaaggaaaaatcagatctgcctgctgccagccttcaccgttcagaagaaacacttaactcttttcagcaaccgcaacaaataattatgttgggctctggccatctggccctgtttgacctgaatcggaagacaggtcttattttaggacatcaaagaagagagcagacttttgctccccacgcaagggttggataagaagccataaggatgaacacaactcagtgaccaattctttagtcaaaaggaacaactcggctgggcatggtggctcacacctgtaatctcagcactttgggaggctgaggcgggcggatcatgaggtcaggagatcgagaccatcctggctaacatggtgaaaccgtgtctctactaaaaatacaaaaaattagccgggcgtgctggcgggtgcctgtagtcccagctactcgggagggaggctgaggcaggagaatgacatgaacccaggaggcggagcttgcagtgagccgagatgtggccactgcactccagcctaggcgacagggtgagactccgtctcaaaaaaaaaaaaaaaaaaaaatcaaggcccagagattcatgatcactgagaagaggaattcgcaaatgacccttttgttgacagaggatgggagagaccccggctgggaaagcccacctggctataaaggatgggacttcccgcagtgcagcgatcaggaataaatacttaaagctgcagccacttcaaagtaaacactcctagcccagcttcacagagaagcttctggacttgcagccctactagagaactctccatccttctctctctagatgtgacccttaagtctttttcttttttagcactgttttccaagcgcttgactcagaaggatgctcaaattcagcgcagaggagcagcagtttgactgttccctgtacgctccccacacagctctcttcgtcacagttttaactccaggttcaaaccctgatgggttggccagttgctgcgactcatgcctgtaatcccagcacttggggaggccgaggtgggcagatcactcgtgaggtcagttgttcgaggccatcctggccaatatggtgaaaccccgtctctactaaatatactaaattagccgtgcgtggtggcaggcgcctggaatcccagtcactcaggaggctgaggcaggagaattgcttgaacccaggaggtgaaggctgcagtgagccaacgttgtgccactgcactccagcctgggaaacagcaagactgtctccaaaaaaaaaaacaaaaaaaaatctgatgagctgggaagtagtccctaacctccacatcagtgctctaggcactctctttttggctcttggaagagtctatttgctaactggaaaagcttaatggataaatttgctcccttgacctaagaaatacattgtgccctgggccgttgaagctccttgcttggctgtcagcctgcaagatactctgttttggctgaagtgcttttcttggaactggtttcaaatcctagaccaaggttgacaccaactatacctgttacaggaactaagggacccccctaaaggttttcttaaagggtctgatcctggagaatctggaatttttttttgaaatagagtctcgctgtgttgcccaggctggagtgcagtggcgtgatcttggctcactgcagcctctgcctcccaggttcaagcgattctcctgcctcagccttccaagtaactgggactacagacatgccaccactcctggctaatttttgtatttttaggagagacggggttttaccatgttggccaggctggtcctgacctcaagttatctgcccgcctcggcctcccaaagtgctgggattataggcatgacccactgtgcctggcctagcatttggattctattcgtggactcagcttatccaaggcctcgggaatcatcttgagtgtaagcacctgctagtttgcaaggactcagtttcccactgaccagtgggttctgcacttcagcccaccctggaatttggcttatcctatgatcccaatcagctggtaggagagctgcttgaagtgtcctagaaactcatctgctcccccacaaaactggctcttaacaagacctcaccctgcgctttaagtattttggtagtgacagcaaagctgagattctccaaaaatgaagatggacacaaatgagggttggtttggcctctccatgaggtgaagtcagatccacatggcctaacttcacctgtgaaaagttggtcatgcttgtaatcccagcatttggggaggccaaggcgcgcggatcacctgaagtcaggagtttgagaccagcctggccaacatggtgatatcctgtctctaataaaaatacaaaaattagctgggcgaggtggcgggagcctgtaatcccagctactcagaaggctgaggtaggagaatcgcttgaacccaggaggcaaaggttgcggtgagccaagattgcgccattgcactccagagcgagactccgtctcaaaaaaaaaaaaaaaaaaaagcaaaatcccagagcagcagagacctcttcatgctttcttgggaagggccctgtgtgcatccttgagtcttgggtatccactccccagtccctgaacatgtacatgcccgtgaagcctccagaaaaggctctgccaggactgtgcttggctttgcggtggtcagcttccaccccgtgtgctgaaaatgcagtttgtagctagacatcactcaagccacgtgcagcccccggcatttgtcagacatcgcagtgagctcatttccttcgcagacaagcctgtgaaagctgaatcatgggaggactggttgccgcgccgcagttaccgtgaactttgtgatctctgacttgtgacccagaccagccaactagaagccaagtacgttctccaggaatgtgcccagatagtggaactgtcatattcattcagtgcagtgtcttcactggacaagggaggacagcactgctgagtgccctaaccacgtaagagtggcttttggcatgaaaggaagaaaaatccaagctacacacacagcctctgccatctcgtcaagatgcagtgataagggcgcacactgttgggtgtcatgtcacatgtgctgcccagaggcaggaaggacagtgggtcaagagatgaggtctatttgtcatcctgatcttggtttcaatgaaagctttgcacaaagatatccaagcctccagattttgcaagaatctcgtggaaatgtgcaagggtttaaaaattggggtgggcagaggggcgcattgggcagaaaagaaatggatactgagacaacacacagctgcgaagctgaaggcatgatacctggtgcatcactgcgaagtttcctgtggggggggccctctgaaacagagagagaatccccggaggttaccatcagcaaacaagaaggagcccggttaagtatattcttaattgttaaagacatttgcttcgatttaataattaaaggcactcttttttattttgagatagtctctgtcacccaggctggagtgcaggggtgcgatcttggctcactgcaacctctacgtcctggattcaagtgatccccttgtctcagcctcccgagtagctgggattacaggcaggccccacgtgcttggctaatttttgtatttttagtacagatggggttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggcatgatctatctctgctcactgcaacctccacctcccgggttcaagcgattctcctgcctcagcctcccgagtagctgggattacaggcatgcaccaccgtggctggctaattttcatatttttagtagagacggagtttcaccatgttggccatgctggtctcgaactcctgacctcaagtgatccacccacctcggcctcccaaagagctgggattacaggtgtgagccactgcacccggctcagttttttaaatggaaaggaaaatgtctgtcctttagagctacttttaagaacctcctataaatcccatgattgcatactggttcagggaagtaaaagcatttgagcaagctagtttgagaaatcagtgttggaacagaagccaagaagtcccaggcaaggaacctgcagccgcctgtcccttggtttatgattacttgctcttcattagctttcgggcctctagcaagagaggagaggtggaggccttgtacagctcttgccggaggtaactggcagtgtagccagtggtaggtaagtgggtctggctttagagagggcttgtgtcgagatgcgtctggctgatagaacttggtgaaactcgcactacagttccttcttggctgaggagccaggcatgcttaccaacctccctcagggctctagtgcctgattttatgtttttgtgcacccaaaagatgcagaaggcaggacagaccttccacctgcattatgtgtgtattcgtgtcggaactggcaaaaatggtctttttgttccactttgcccttggctgcccaagaaggctcaagtgtctggggcagaacccacaggaggtgtccagtgtgtgctaaagaatcactgggccggccgggcatggtggctcacgcctgtaaccccagcactttgggagaccgaggcaggtggatcacgaggtcaggagatcgagaccatcccagccagtatggtgaaaccttgccactactaaaaatacaaaaattagccaggtgtggtggcacgcacctgtaatctcagctacttgggaggctgaggcaggagaatcgcttgaacctgggaggcaaaggttgcagtgagccgagatcgcgccactgcactccagcctggcaacagagctagactccgtctaaaaataaataataaaaagaaaagaaatcactgggcctgagaaagggaagcagagacagcagtggggtagggagtcagagtggctgtatccccatcgctcagcccagccactcaggagaggcagggggactggttgccagcagagcacatctgagggtttttgttttttgttttttttttggagacagagtcttgctctgaaggctggagtatagaggcttgatcttggctcactgcaggctcctcctcctgggttgcaaaggagtgtcctgtctcagcctcacgagtagctgggattacaggcatctgccaccacgcctagctgatttttgtgtttttagtagagatgaagtttcaccatgttggccaggctggtctcgaactcctgacctcaggtgatcagcccacctcagcctcccaaagtgctgggattacaggcgtgagccaccgcgctttgccccaggagtcttcacagtgagaacagctctcctccactgacccctcaaccctgggagatgcttccaggcccctgctgtactttgggagcctaggcctggtttctctcctatccatgggggaccaacaagcgctcaccatgcagcgagtggggcttttccctgaaggcttggtgccctgcgccagctgctctcttccccttctcagaggggtttggacttttccctgtctcacgcagtggtccccaaactctagaggtgatttcagatggcttccgggcatgccatccgctaactgaactgggccctgagaaagtcatttcctttccaactctttttaaacaagtctaattatgatgtcagagagagtctatttggtgctaatggctgttgtcactccctttttagtggagaagtaggcttcaggtcttggtgatcaagttgtggccacaatagctagatattgaacttgatactatttttatcatattactttcatcgtaaccagttgatagaggtgatgctggtttaaaaatatagaggaggtatgtttatttgccgttatattcatgtatgattaaaactgttaaaagatcaagtcattggtattaaaggtagtaagaggctcagcacatggctgtggtggtatgagaatgaagcggggaaaatatctaggacccgagggataaaggttcactctgcctggtgctgtcctagacactggagattttttttttgagaccgagttttggtctgtcacccaggctgaagtgcagtggtgcgatctcagctcactgtaacctgtgtctcccaggttcaagcgattctcctgcctcagcctccctagtagctgggattacaggcacgccccaccatacccggctaatttttgtgtttttagtagagacggggtttcaccatgttggtcaggctggccttgaactcctgacctcaggtgatcagcctgcgttggcctcccaaagtgctgggattaaggggtgagccactgcacccagcctgggcaggattctttagggaaagttgaccagattctcccatagatgggatgtggggtataaaggagaccaaaacgttaagaaggaccacgaggtttgtgatgtgaattgttggcaacttcatcattttagctgctgagctggagagaggagccagtttgggggtgaagagtttcagtcaggacttggggtgcagcatgtttggtgtgagctgcctattagacatccatgtgggaacgggagggtggtctgaggttctaggaagaagctagggcttctcagagatgaactgaggagtcattagatatacatggaattctaaagcgccaagattagttgagacctctcacctagcgctggggagagatgaaaacaactaaggccgtgcagtggtccatgcctgtaatcccagcacgtggggaggctgaggcgggtggatcacaagatcaggagttcaagaccagcctgggcaacatggtgcaaccccatctctactaaaaatataaaaataggccaaaaatagcttgaactgggaggcagaggttgcagtgagctgagatagtgctactgcactccagcctgggcaacagagcaagactctgcccaaaagagaactaagttgataccctggggcggtctagtggcaagcaggtttcgaggtgagggatcagcagaggagaggaagagggacaaccccacaggtcgggggacaagcaggtgtggatggtgtcggggaagtccagggaagcaagtgaattaggccagaggcatgatggactgcgtcacgtgctgctgccctgtcaggggacctctggccattagtgtcacccatgggaggcttctgggagagtgatgggtgggggcgaggggaaccagcaactcttcacatacagtttttttttttttgagaccgagtctcactctgtcacccaggctggactgcaacctctctctcccggttttaagccattcttgtgcctcagcctcctgagtagctggaactataggcatgcaccaccacacctggctaatttttatattttttggtagagacagggtttcggcattcacatccagttttgtagtaagggtagcaaggtagacatggggctaagaggttattccatttgctgatggagcaaatgaaagagaaaaccttgcaaaataaggatttttggagctatgtgcttgagtgaacaagagggtcgggtccaatggaggtgttggcctcggttggtgccagagggttcagcatagaaatggaaaaaaaatagaagtgtacagaggtgcacggaggtaggatgatgaggcagtgggagcttgtgcacgtttcatgatcatttctgcttttgagttaagtaggaagtaaggtccccagctgagagagaatggggaggagcgatcataagttcaaagaaaaagtgaaaagcagcagagagtgagaagatgagggaggggtgtgggaggacccctgagcaaggcctgctctgtgggaaaaggtggagagtgggttttgggttttttgagacagggtctcactctgtccatccagggtaagtgcattggctagatcatggctcactgcagccttgacctctggggctccactgatcgtcccacctcagcctcctgagtagctgggattttaggtttgcgccatcccacctggctgatttttgtttgtttgttgtagagatggggtcttgctgctcttgaactcctgagctcaaagcgattcacctgccttggcctcccaaagtgctgggattataggtgtgagtcccgtgcccagccaagcttgagtttcatttgggttgtgctttcaccaaatgattgcagcaatgcaagagggggaaccggatgttgaggatgcgcgacgggggttactagacagctggtttggagctgggtcagaggctgatggcattaatggagtgaagaccccgttggggacagagccaaagaaaggtggcaccaggcagacaatgggatgcctgagggtcaaattgtgagggctcctaggagtactggttggcccggtagaagcagcaggatcacccagagggtcaaggaaccgagaggctgcgtcgcccacctggatgttgaaatcatggagaactgtgaggagtggtgtgggagacaggaagcccggagctaaaacctcctgggagccaatcgggatggatggacagggtggtggaagcagcccttgggagcaggggggacccccaaggtaccagaggcatgggagagaaaacagcccccactccagtgacagcaggaattctcagcggggtggcagtcgtaccctcccatctctagaggacttctggcaacatctagagacatttttggttgtcacattgcagggtggtgggggactactgcagccggtgggtagaggccagaaatgtaagcacctgctacttttcagggatctttttccttctgatggggaatgtcggacagcccccatacccgagaataatgcagcccagatggcagcagtgctgagggggagaaaggaggagcagagcatgtcaggaaggaggtgaagtggcggggggtggtgttgcagcttcaatggatgtcgtgaagactcagtgatgcaatgaaggaggggctggaggagacagtggggatagcctcttcctcctcctcagccggaggaccggatgggagacggtcgatcgttaaaggatctagaaggttagctgctaccaggcaaggcagggcccgggtctgatctcagtgcctggcccacactaagcttagtgattaaggagaagcaggaataaaccacagaagggagtggcggctgtgggcacaaggggcatttgcaggccgaaaggagcccgagcccccagtgcttttctctggcctgagagacggggtcctcccgggccacgggctcctcacctgagcttgctcttgagtgcgttcacctcgcggcccatggcctcgttgctctccgtggcctcatccagctcccgctgcagcttcctgcggttggcgttgatgcgctgggactcctcctctgcctcctccagctgcctcttgagctgcttgaccctggcattgcctttctctgcctgtcgcggagagttggaggggtggttaggggaggccggctgggggctgggggctcgagggaggctgggtggcaggggctacctgctccttgtactgctcggccatcttgcgctcgtcctccacctgcagcaagatttccttcagcttcttgtctttctgcttcagcgacttggtggccgcctgtttctctctgcaaacagcaaggaaaacaggtggtttcagcggagggtggcaccccttgtagctggtgtgtcacctggaggtggcatcttgagtgctttcctgagccccgtatctggactcctctcaagaatcagtcagatggtggaatagtattcagccatgaaaaggaataaagtatcaatgcatgccacagcatggatgagcctggaattcttgccaagtgaaagaagacacatagcagacaacatagtgtgtgattccgttgatatcaagtgtccagaatagataaattcatagagacagaaagtagattatggttgccagggactgaagggagtggttacagggcatggggtttctattttttttgcggggaggaggcaaggtcttgctgtgtgacccaggttggagtgcagtggtgctccaatgcctgctcttcaccctagttcatagttcactgcagccttgaactcctggctcaagcaatcctcccacctcagcctcccaagtagctgggactacaggcgtacaccagcatgctcagacttttaaaagtttttcatagaaacggagtctctggccaggcgtggtggctcatgcctgtaatcccagtactctgggaggccgaggtgggcagatcacctgtggtcaggagttcgagaccagcctggccaacatggtgaaaccccatccctactaaaaaatacaattacaagctgggtacagtggtgtgcacctgtagtcccagctacttgggagggtgaggcggaggttgcagtgagctgagatcgcaccactgcacaccagcctgggaaacagagtgagactatgtctcaaaaaaataaaaataaaaaagtcttgctatgctgcccagactggtctcgaactcctggactcaagtgctgctcccacctacctcagcctcccaaagtgccgggattatgggcatgaaataccacatatggcctggggtttctgtttgagccgatgaaaatgttctcaaaatgactgtggtgatcgtttttacatgtttgtgaatatatgaatagcccttgaattatacactttaaatgggtgcattgcagggcgtgcgaattactgaaaaagctactagaagagaatgggtgagaatccttagaatccaatggtaagaaatgtgctgtgatcatatgcctcattcgacccataattaagaaggcttccagtgtgtgtaccaaatgggctgccggttggacttttgttttttggggttttttttgtgtgtgtgtatgtgtgtggaagggtcccactgtgtcacccaggctgcagtgcagtggcacaatctcggctcactgcaacctccacgtgtcacgttggagtgattctcctgcctcagtctcctgagtagctgagataataggcatgtgccaccacactcggctaatttttggtacagacagggtttcaccatgttggccaggccggtctcaaactcctgacctcaagtgatccacctgcctcagcctcccaaattgctgggattacaggcgtgagccaccacgtccagcctggttggatttttgatctgtcagcatgctatccctgcagaggctgggaaaagtcatatgtactgctgggaaggcaggttaatgtcaggaggaccatggagatgctaagagcagctcacactttaggtgcttgccctaggccaggaaccagcagggcactttgctgtgtttacgttcagttctcacaacatacctgcactgtaggcatcacagagcttgcttcttacaagccagaactgatgctggaagaggttccctgacttcactatgactcctgctgtccatcacccccctgcaaactgggttcggaactccacacccgcatacctggcctcctgctcgacctgctcctccagctgtgcaatcttggcctccagcgccgcgatggtggacttgaacttggacttgacggccccctccatctcgtggagcttgctccggagctccttgttctgccgctcgagctgctgccgggcactctcattcttctgggccgtgctgcgctctgtggccagctcgttgctgagctgctcggcctggggaggagagtgaaggccatgaggcggactcagggaagcccaagagagcgcactgagaccatgcctcttcctgccttgtttggcctctgcacgagtcccttgatcccgggcaccctgtcctctccttcatcctgtaaaactccactcaagagcttcttccaggccgggcgtggtggcgcacgcctgtaatcccagcacttttggaagcagaggcaggtaaatcacttgagctcaggagttcgagacctgcctggccaacatggtgaaaccccgtctctattaaaaatacaaaaattagccgggcagtggtggcacgtgcctgtagtcccagctacttgggaggttgaagcaggagaatcccttgaacttgggaggcagaggttgcagtgagccaagattgcgccactgcactccagcctgggccacagagagaccctgtctccaaaaaaaagaggtgcttccacaagtgtcagtgccacccaggctgagcgagtgacttgtcccttgctttctctgtcctggagtcgcctggagaatgatgcctgttcaccctacaccacaaggggctgcaggttactggatggtccctagtgcccaccatggaactagtgctcagtgacatcaccaagggctcactggataaggtcagagcttcagctaggggaaaacgcaatgaaagagcatcccaaggcccggactccagggatggccgtgaggtacggggagccagccacgccgtggctggaaaatgagacactgcagcgtggagaggagtattctgaagacagcagcctgggcactggtgtaagggccctggatctctactctcaggccccaccaccctcttgtccctcaatccagggcctgcacacaggaagccgccacgcgtgtgttgactggtgcaggatcctgctgcaggagagacagtaggcagcgtgactgtggtgtccaggcggccctcacctgctgtgtggctttgcggacccggtcgctcatggcctccatgttgccctgctcctcctccagctcctcctccagctgggcgatccgggcctccaggcggcgcttctcgtcctggagtgcgttcctgggggaagggcggccatggtgggggcctctaccctcccccgccttaaaagatgccccctccttggagtcatgcctcaggggtattgccctcatcatctaatgggtgaaactgaggcttggagaagattagaagactcatctgtagttacacagccaggaagtggacagccgggactcaggccgggtccgtgtcagcaaagctgggattgggatggggaccagcacactcctccctgactcttcctggcctccccttctccccacacagctacttattgggaatgaatgaaagcagccacacccccaaacaggcatgaaagcgctgacggaaaacctaaccaccatgggtctgtccccaatctcagaggacgcttcgtcagcagcagcattgaaatgggggtccagggccaggcacggtggctcacacctgtaatcacagcactttgggaggccaaggtaggaggatcacctaaggtcaggagttcaagactagcctggccaacatggtgaaaccccacctctactaaaaatataaaaattagccaggcatggtggtacacacctgtagtctcagctactcagaaggctgaggcaggagaattgcttgaacctgggaggtggaggttgcagtgagccaagattgtgccactgccctccagcctgggtgacagaatgaaactctgtctcgaaaaaatttaaaaaataaaatgggggtcgaggatgctgcctgtccccccatcctctgcttcagagccctcttcctccattcagtttcctaccttcccgacaggctactggccagctcctctgccagttcctccttctcgaggtccgcttgtttgcgagccctctcagcggcggcgaggtcctaggtgggagggaggaaggctgttgtctgccagggaaaggccaagccccaccaagagtccaccctgacaactcagccacccttgaaagtacatgttcttcctctgagctcaggggaggccccgtgaatacatagaggagggaagcgtgtgtctttctagacaggtggaccccagaggaggacgaaatgaaatctgggaatgcacagactggagctgccaaggggtgctaccgtgacacccgcatctgaggctctcctagcaaggcgaggctttacctcttgtagctgcatgaggtctgcttccaagctcttggctttcttctcattctctttggctgtggcaaagatctcatctctggaggcacgggcatcttccagctctctttgaaagtccttcatctgagcctgcatgagtcaacagggaggacaagctcagatgtccttactcccccaagttctgctgcccagttcagctttgcacacccaccccttggattttctgcagttgaccacaaagaagttcccattgcacgagcatggctctcagttccaggtggctggtggtgcgctgggagcaccattctgggtgggctccacagacctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgctctgctgacttcggtggcctgaggggaactgtgccctccctccacccatgccccaagctcctagtgtcacccacctgcagtttgcgtagctgcttgatggcttcctccctccccttgatggcagagtcggcctgaagctccaggtctttcaggtccccttccagcttcttctttgctgcagctgccagggcacgttgctttcgctcgtcttccagttccgtctcatactcgtgaagctgggcgaggaatagagatgtgtgctgccccacttgcccctgggaggtcctttggctcacctaggcagcacatcactgcaccccttccccagcacagcccccttgtgaggtgggcatctcatccccagttgcagatgagaaaacggaatcacgccgggcgtgggtggctcatgtctgtaatcccagcactttgggaggccaacaggagaatggatcacttgaggccaggagttcaagaccagcctggccaacatggtgaaaccttgtctccactgaaaaaaaaaaaaaaattagctaggtatggtggcatgcgcctgtaatccaagctactcgggaggctgaggcaggaggtggaggttgcagtgagctgagattacgccactgcactccagcctgggcgacagagcgagactctgtttcaaaaaaaaataaagaaaacgaagtttccacaccaaccatgagagtggtgataggaatgaaaaaggccacccgacctccctctgctggcctccccggcagcacgcacctgtctctgcagttgcctcctcttctcctcattctgctcgtcccgggcttggagatccctttcgaactggcccttgagcgcctgcatgttgacttccagccgcagtttggcgtcctccgtggcttgcagctcgtcctccagctcttccagctgcgtcttcatctcctccatctgggtctccagggcccgcttggacttctccagctcatggacctgccggcagagcgggcagccccattctatgaggctcaacttcatgaagacgattgagaaacccaccgtgagcggcacctcaggagatcagggaggtggctttggcctcccacaggatgcatggccgggactcaagatgacccctgagagttcagaccccagccttatcctcggaccccccaactcagacccatcctcgactgccattctcagcccctcccagcccctgcaccagtccaaaaacctccttccatttccgatgatagttcgctatgaaaaaggccaggagctagcctcgcatggactggtgaatagcacagagggtgggcaggcgaaacatggacgagaaaaaccacccagagccacttacgttcttgcccacgtcatccttggagctgaccaggtcttccatttcggctttgagcattttgttggtccgctcgagttcctctttggcttccaaggcctcttcaagggcccgagccagggacagggccttggtttccttctccctggcttctgcctcagctctgtccctctcatccgcgtatttggaagagatgtttttctcctcggctaacaactacaacacaagacccagaggtgacttctaggcatatccggggtcagcgtcactgaattgtaaataccgggggaagccctgtgtcctgctgaatgtattgaggtgcaggtgtaagcagtgtaggttagctatgggagtaatttatataatcatctggcgttctgacttctacatcaaccttatgcagagccagaaatcagctgacttgtttttttttgttggtttgtgtgtttgtttgttttagatggagtctcactttgtcacccaggctggagtgcaatggtgcagtcttggttcactgcaacctccgcctcgtgggttcaagcgattctcctgcctcagcctccagagtagttgggattacaggtgcccaccaccacacctggctaatttttgtattttaagtagagatgtggttttgccatgttgaccaggctggtctcgaactcctgaccctcaagtgagcctcctgcctcggcctcccaaagcacggagattacaggtgtgagccaccacacctggccaaatccttgtgcttcgaaaccactagacctgcccacgttgcttagagcacactgaggtcaaagtgagatttaaagctgccagaagctagttattagtttgtttcatggccacaagtagctattaatatcttacaaaagtatcctaagagcctcagtagggaaatggtaagcatgggtggccctgcacacatatctctctgcttggagaagcaactcagagaacattccatgctcacgttaatctcatcttcagagagaacagagcagattataaattgtaacatccaaaagccaaacttccagtattcagcaaagacagggacctctaaatggcacagtcaacacaaaaatcccacactatgtgtgccactgcactacactctatgtgacaggaaaataaaagcaacctcaggccttcaaccagataacgaagcattgaagatgagctgacagcccagaggagaggtagctgatgggaagaggagaaactgggatgttatctagaatcctgacactaggaggtcagtcagggaggggtagggaacctgcaggcatctggcatttagcctcactgtacaatcctcattttatttatttttgagacagggttttcactccatcactcaggctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcgtgagccaccgtgcctggcctctcaaactgatttttagaataaccctgagtcacttgtaaactaaatcatatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataaggcatgatagatagaattagtctttataaataaatatgtgggccgggcatagtggctcatacctataatcccagcactttgggaggccaaggcaggcagatcatgtgaggccaggagttggagaccagcctggacaacatggcaaaaccccatctctactaaaaatacaaaaattagccagacatagtggtgtgctcctataatcccggctacatgaaaggctgaagcaggagaatcgcttgaacccagtggtggaggttgcggggagctgagatcacaccactgcactccagcctgggtgacagagctagatcctgtctcaaaataagtatctgataaagttcatataatacagtgtcaatgactgaatccaggtggtggccttaaaggtgttcaccgtacaattctgtcaactttgctgtgtacttggaattttacagaatgaaatcttagggaagagtggtattaaaagtatagaaactgaattacttggaatactactcaataggtattcagtaaatacatttagtgaataaataagcacctcattccttcttcaggctagaaactaaggcatcaccatgtgtgcaggtgaccctcatggtgctggtacccagaaaagtcacagtcatcaaggcttctttgccatccttactgtgacctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtgggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaaggaagggttttttttctttttttttttttttcctgagacagagttttgcccttttagcccaggctggagtacaatggtgcggtctccgcacactgcaacctctgcctcctgggttcaagctattctcctgcctcagcctcccgagtagatgggactacaggtgcccacgaccacgcctggctaatttttgtatttttagtagagacttttcaccatgttggccagactggtctcaaacccctgacctcaggtgatccacccacctctgtctcccaaagtgctgggattacaggcatgagccaccgtgcctggccagaaggtttttttaatatttaattgaacagggagatcatcgcctctcctccaggaacgcaactagaggaaaggacttgccttgcagcaagagagacctcagcgagccgggaagaggctcctccccacagaactgggcaccacccagcactgcccaccacaccaccgcgccacctcctcacctgcagcttgtggactttgtcattgagctccgcccgggcccgctccccatcgctgcacttggactgcagctcctgcacctgcgcctccagcttcttcttcttatgttccacctcctgcttggcctggcccaggacccgcagctccccggccaggtctgcgttctctttctccagcgtctgcttattcttgtctaggttcgccttggcctggcgaaggaagcagaggggagggataacagggaggctgtggccgggagaacgtttcaggccctgccctttcctccctcagagaggtccaggaaggcacacaacagggggcacacaatcaccagtaagagatttggggtttttttgttgttattttttttttgagatggagtcttaactctgttacccaggctggagtgccgtggcacaatcttggctcactgcaacctccgcctcccaggttcaaactattctcctgcctcagctgcccaagtagctgggattacaggcgcccgccaccatgcccgactaatttttgtatttttagtagagacgaggtttcaccatgttagccaggctgctctcgaactcctgacctcaagtgatccacccatcttggcctccctaagtgctgggattacaggcgtgagctgccgcacccagctgatattttggattctattttcctaaagctcatgggttgcaatctggaatcccacaagcggtatccaacctgctgacatgtcccctttgaccctttcactacttttaaaaaaatgagttgccgacattttaataaatgtcacataaaaatctggattcccagcttctttttcaaaaaactttaatgtttgaaggcatgccatggcagctcatacttgtcatccccagcactttgggaagcaggcagaaggatcgcttaaggccaggagtacaagaccagcctgggcaatgtagtgagacccccatctctactaaaataaaacattagctgggtgtggggggcacacaccagcaatcccagctactcaggaggcggatggcaggcttgcttgagcccaggaattggaggctgcagtgagctatgatcacaccactgcactccagcctgggcaacaaagtgagaccctgtttcagaaataagtagctttgggaggccaaggcaggtggatcacttgaggtgaggagttcgagaccagcctggccaacatggcgaaactgcatctctactaaaaatggaaaaattagccgggcatggtggcgcacgcctgtagtcccagctactggggtggctaaggcacaagtattgcttgaacctgggaggtggaggttgcagtgaaccaagatcatgccactgcattccagcctgggtaacagagtgagactccatctcaatcaatcaatcaataactaacattctatgtggtgactgtggtggtggtagttacacaatacacatttgttaaaattaatggagcagtaaaatggataaattttactacatatgcctcagtaatcctaaacttaaaaacaaaaacaaaaaaccaacaacaacgaaagatctggaaacagagggtcttgctttccttcaaggcaacaatctgccacatctaagtagcggctggctctgcaggtggggcagtcacctttcaccgcccccgtccttcacaggtgtcgtgtgattgacactgctacttctgtcctagttaagggaaacttattttatggaaccagctcctgtaggcatgtgagttgccctacaggaaaaaaaaagtgtgttggggccaggcgcggtggctcaggcctagaatcccagcactttgggaggcctatgcaggcaggtcacttgaggtcaggagtttgagaccagcctggccaacatggtgaaaccccgtctctactaaaaatataaaaattagccgggcatggtggcagtcacctgtaatcccagctgctgaggaggctgaagcaggagaattgcctgaacccaggaggcgggggttgcagtgagccgagatcccgccagtgcactccagcctgggcgacagagtgagactttgtctcaaaaaaaaaagcgtgttgggcaaaagtaggacgcggtgaggggcttctttccaggttgtagagaaggggaaagagaagcgcaagtatcccgagaggacgagacccaccactcagtcttcccatagtccctgggaggtgctggacgttgaccggtcagccctggatgcccgtcctccctccaagacatgactaagagctgccagacctcagatggggacagggagtctcttggtggtaacaaagcagtgaagcggggaccctaggggacatgggctcccagaaaccttagcccagcctaagaccccagaactggggccaaaccgcacgagggcctggggagcccaggtaggagctgatgttaaacgtttcccccacaagcagatggaaccaggtctctacatcagaattcaagttgttagaggcaaaggcctctgtttccctgcacctgagatgggcagaggtttgcacctctacctgctttgtgcgggtcagtaatggacatgccgtctgctggtggtcttaataactgcgtcttcccaaagaggcctggctgggaatgggcttggcttctagctcctgttcacgtctaatgaaccccaagcatggggagggtcagtgattctgtctggggcctcactcttccaaccataattttttttttttttttttgaaactgagtctcactctgttgcccaggctggggtgcagtggcacaatcttggctcactgcaacctttacctcctgggttcaagtgattttcatgtctcagcctcccaagtagctgggattacaggcgaccgccaccacgtccagctaatttttgtatttttagtagagacggggttttgccatgttggccagactggtctcaaactcctgacctcaggtgatctgcctgcctcgggctcccaaagtgctgggattacaggcgtgagccactgcacccagcctaattttatgtatttttagtagagatggggtttcactatgttggtcaggctagtcttgaactcctgacttggtgatccgcctatctcagcctcccaaagtgctgggattataagcatgagccaccgcgcccggcctttgggggcagtttctaatggtttagcactatccctttggtgctgccctcatgagatctggttgtttaaaagtgtctggcagctccccattctctctcttctgcctgctctggtcatgtaaaacatgcctgcctccccgttgccttccaccatgatggtaagtttcctgaggcctccccagaagcagaagctgctatgctttctgtacagcctgcagaaccgtgagccaattaaacctctcttctttagaaattacccaatctcagggtggtgcagtggctcacacctgtcatctcagcactttgggaggccaaggcaggtggatcacctgaggtcaggagttcgagatcagcctggccaacatggcaaaaccccatctctactaaaaaaaaaaaaaaaaaaaaaaattagccgggcatggtggtgtgtgcctgtagtcccagctacttgggaggctgaggcaggagaatcatttgaacccaggaggtggaggttgcagtgagccaagatcacgccactgaactccagcctgagtgacagagtaagactccactgctcaaaaaataaacaaataatccaatcttgggtatttctgtagagcagtgcaacaacggaccaatacactagtgatagaaccaaatgcaaattccccaaaatttttaggcaatgctgcacccacttaatctagcagaaccaaaagcttccactgaaggggatgtggaggagctgcaacgctgagggtaatgtaactcaggctttcaggaaaacaatctggccgaaggtcgcaagctaaaaaacttaccctggggaatgaagcacaggcactaccccaaaggagagaagagcacccaagattcagcattcggtactgctatttaccagctcccactcccatacaccgcaaagagttccaacaacgggagagtgatttgacctagtcattctcaaattatgccggagagagctgttctgccattgaaatcaaataatgacaagtttcctccagtcttttttttttttacaaaagaaaaatcgctatgttgcccaggcgatctgaaagtcctgggctcaagcaatcctccctccttggcctcccaaagtgttaggattacgggaggcatgagccgccatgcctggccttcctccagtctgcagagaaattaaagtggatagaatgatcccagttttaagtttcatttaaatctccccgaaagtgttgttacacctttgcttatccctgaagggcagtatattgataggccccacccatcctataggccttcagtcctgtagaggccagaaagtggggtctaggaccagactgtttgggtgcaaatcatggctctgtcacttaccagcagtgtgaccttgggtaagtctcttcacctctaggcacctaggacctcagtttctttgcttgtaaaatgagtttaatagtacacgtctcacagggtggttgtgaagattaattgacatactgtatgagaagcatttctattcattcttttttttttttctttttttgagatggcggctcactctgtcgcccagactggagtgcagtagcacgatctgagctcactgcaacctcttcctcctgggtccaagtgattgtcctgcctcagcctcccgagtagctaagattacaggcacatgccaccacacccagctaattctttatatttttggtagagatggggtttcaccatgttggccaggctggtctcgaactcctgagctcaagtgatttgcccgccttgcctcccaaattgctgggattacagacatggtgagccaccgtgcccagcctatttttattgtttgattaaggtctcactgtgtcgtccaggctagagtgcagtggcatgacagggctcactgcagcctcaacctcccaggctcaaacgatcctcccacctcagcctcccaaatagctgggaccacaggaatgcactaccaggcctggccaatattttattttattttatttttttgagatggaatcctgctctgttgctcaggctggagtgcaatggcatgatctctgctcactgcaacctctgcctcctgggttcaagtgattctcctgcctcagcctcccgagtagctgggattacaggcatgcaccaccgcgcccggctaattttttgtatttgtagtagagatagggtttcgccatgttggccaggctggtctcgaactcctgacctcaggtgatccacccagtttggcctcccaaagtgctgggattacaggcttgagccaccacgcctggcctacttttttaaaattttagtagaaacaaggtctcactatgttgcccaggctggtctccaactcctgagctcaagcgatcctcccgcctcagcctccccaagtactgggattacaggcgtgagccacctcacccagcctgtatgggaagcattttgtaaataaatataagctgctatcatcatcattagaatcttatgtaacttgttttttgtctttatgcagaccctgacctgtagtaatttgaggctgctgatgtcactcttatgtgtcatcaccaaaaagcatcaccaaaaagcattaccctcttgaactgctcaagctgctctgtgagctcctccaccgcctgtgcgtgtttctgcctcatctcctggacctgagcctcatgggaccgcgtctcttcatccagggccttcttcagcaccgtcacctcctgctccctcttggcccttggtgggaggaacacagtgaatggcagttgggtggagacagagggtcatctcagtgccgtgcaaaagaatgagagctcttccaggacccagagctgcagtcctcatcaccacccctctctagctgtgtgaccttgggtcattcacctaacatctctggacctaaaatttcctcagctgcaaaatgtggagcatatcacctgcctaggacatctgtaatgactggcaaacaaatacacaaagtaatagaattgaaaggatgtctgtgaactgcaaaattttgcttaaatattaatgttggctcttatttaatgagcagttactatatgccaggccctgagctaagttttttatatacatcatctaatcctcagagcaacccaaagaggcaggtgtgttattatttccattttacaaatgaggaaactaaggctaagagagggtaagcagttttacccatggtgtcacagccattgtgtgatggagccagaattagaagctaaaccttgaccttgagtccatggttttgtttgtttgtttttgagatggagtttcactcctgttgcccaggctggagtgcgacagcgcaatcttggccccctgcaacctccacctcccgggttcaagcgattctcctgcctcggcctcctaagtagctgggattacaggtgcccaccaccacgcccggctaattttatatttttagtagagatggggtttcaacatgttggtcaggctggtttcgaactcctgacctcaggtgatccacccgcctcagcctcccaaagtgctgggattacaggtgtgagccaccgcactcagcctggttttttgttttgtttgtttgtttttcttatcgagtcttgctccgtcgtccagactggagtacagtggaatgatgtcagctcactgcaacctctgcctcccaggttcaagggattctcctgcctcagtctcccaagtagctgggattaccgacgcccaccaccacgcccggctaatttttgtctttttagtagagacaggttttcatgatgttggccaggctggtctcgaactcctgacctcaggtgatctgtctgcttcagcctcccaaagtgctgggattacaggcatgagccaccatacctggcccatgcactgggctcttctgtatcaaaggccaagcggcaagggagcagaacgctgtgctctatgtgcatgtgacactgcacaaaacccaaagtgggggaagtaaaccccagggtatatggtgttggcacagctagcatagctatatgctatgatacatgctatgccaacaccacagattgcatcaaaatacatttatgtgtttactgaatgaatcaatgacctagtttcactagagtcaggattcgtgatctggcaggcagtttgttattgtttgttcatttgaagtgaatcttcaattgaaaaccaatctgatcaattttatttttaaaatttaacacaaaagtgatacacacacatacttgggaattggagcttggggactgactgatacacacacagacaggaaggaatttctcaagaatgttaactggtgtgactaagggtgatttttttgttttttgtttttttttgagatggagtctcactcactgtgtcacccaggctggagtgcgatggtgcgatctcagctcactgcaacctctgcctcccagattcaagtgactctactgcctcagcctcctgagtagctgggatttacaggcatgcgccaccacgcccaggtaatttttggatttatagtagagacagggtttcaccatgttggccaggctggtcttgaactcctgacctcaagtgatccacctgtctttggcctcccaaagtgctgagattataggcgtgagcccgaccctaaaggtgatttttttttatgtctgcttttctatagttttcaaattgttctctgagtatatccaagcttaccaatgaggatggttttgaatgcagcctgacacagagtcataaactttcttaaaacagtatgagatgttttttccaatttgtaaaatttttttagttgatcagctattattagtgttagtgtatcttatgtgtggcccaagacaaatctttttcttccaatgtggccaagggaagccaaaagattgtacatccctggtatatactactcttctgatgagaaataagatgatgagggtcgggtgcagtggctcacacatgtaataccagcagtttgggaggcggaagtgggtggatcacttgaggccaggagttcaagtccagcctgggcaacatggcaaaactccatctctactaaaaacaaaaaattagccgggtgtggtggcacatacctgtaatcccagctactcaggaggctgaggcatgagaatcgcttaaatctcagaggtggaggttgcagtgagccaagatggcacaactgcactccagcctaggcaacaaagccagactgcctcaaaaaaaaaaaaaaaagaaagaaaaaaaagaaacagccaaccatgcttctataagttaaagcaaaccgcggccaggaaggtaaatgcacaggggctgatgcacgatttgctttgggtttgtcccctcttctgcccccatcccattggtgcagtgggatagcaggatggtgggattgatgggcccctcacctgagctcctgctgagtggctgtgctgtccagtgtgtcttccagctctgtctttagggcctccagctcctcgccgaggtctcgcttctgcttttcagccttgttcctggcggcccgctctgagtccaggtcctcctggaggtctgagatgtggccctccagctcccggatcttcttcagggcattgttcttctgagcgatttcatcgtcaagccttccagggagagacccagcagaatgaacccccaggtcccttggtttcctctcttacaatgtggccaaaaacttttctgggaccagacagttatgttgcagagacatcaaacaccttctatccatgtccccaggtctgcttcttgacatgccagactatatgagattaacataggatgtgagtgccaaggtctgacatcaaaacaggttgtacatgtgcatgggtgtgtgtacgtgtgtatgcacgtgtgtgcatgtgtgtgcaagaatgcaaagcattgaccccagactggcaaggtacctggtcacagtagggactgtgtagatgctttctgaatgttggacagttcttcttccctggcaactgtctgttctttctgcatttgctcagtgactgagtacccgccccatgcacagcatttggccagccactgcttgcgggggatattcagactggggctctgcatctggtggaggtggtgaccagagatcaaggtgggctgcaagaagccctgttaaatggcagaatgctgcaggagaggcaagcactttgattttactgtacttgtgaaagggcagcaacaagagagaaagtgaaatagttgggttggggtgagactgcagagggtggatgggctctgagggtgaggctaaggaaactggattttccctagtaagccagtgaagttaggtttttgttttgttgttattattgttttgagacagggtcttgctctgttgcccaggctggagtgcagtggcatgatcatagctcactttagcctcaacctcctgggctcaagtgatcctcccatctcagcctcctgagtagctgggactacaggcacacaccaccatgcctggctcattttttaactttttgtagggacagggtcttgctatgttgcccatgttggtctcaaactgctggcctcaagcaatccccccacctcggcttcccaaagtgctgagattacaggcgtgagccactgcatccagccagcaaagttttgtgagcaggttcctgccccagagagatgctttcccttcatcaccgtagcactgtcaacatagcacaaattggccgacaaaagagccaggccaggggatcaatcagaaagctttgaggcttaaatcccagctctgcctcttagaagcaatgacattgctcctgttgcgttacccctaggaggctcagcttcctcctcaaagacaccggcagtacacctggccaggtgtctgcaaaggtattgcttgaaaagaacttagcaccgagtgagcaggtaaataatcattcatagtggctgctgcagtattagcattagtgtaaatccagctaagagccaggaagagggaaaaaccagaggaaatgggtgggggacatttagaaggactggcagaatctgaaggttgctgcttgctgtgggtcggcagaaacaaaggaggagattggtgttcacaaaaaagagggcccttagagggaggggctggggaaaggaaggtcattcccgccttagacaggggtgtttgagatgacggtggaaattgactcattgggcaatcggaaattcagaagggggtctagatgagaaaagcctggatgtcgaagaggcagcagcaacaccatgggagtaggtgagatcaactgcaaagacatgatgtgtttgcagggaagagaagaaagtcgaaggtgaggatctgggggagtgaacagggtcgagaaggcttgtgggaggcctggcctgggaaacgaagttcatgccaagggcctggggccgccttgaccaagacagccactgcgaatgagcgaatgagcaggggcccaggggatacatggacacacagcaaatgccccttgccagccccgctacctggccagggccgcctgcagctcctcctccttcttggccagctgcatcttgagctctgcgatctgcgcctggaggtcagcgatctgctcgtggaagtcgctggcatcaccctccagcttccgtttcagcttctccagctcctgtcggctcttctcttccttctttagccgcactgcaaaaaccaaggtgctcttcaggaaggggaggccccagagagatgcccggaaatgagccttcctgcccaggcattttacccggaggagatgaacacatcccccaatcagtaaccatcatagtcacggtctggaccattatctcccgatgaacagcaccttatattgtcataatattattattagttgagatggagttttgctcttgttgcccaggctggagtgcagtggcgcaatctcagctcactgcaacctccgcctcccgggttcaagcaattctcctgcctcagcctcccgagtagctgggattacaggcgcccgccaccacgcctggctaatttttgtattttgagacagggtttcaccatgttggccaggctggtctccaactcttgacctcgtgatccgcccacctcggcctcccaaagtgctgggattacaggcgagagccaccgcacccagcccttttatcatattattagtgcatgtgatgactaagggtgatttcgagaggtggcatagagttagttgtcactcatgggatgatctgccatcctcaaatttcctttctgattttcctgcttttaaaaatacccattcaagcccaggaatagtggctcatgcctataatcccagcactttgggaggccaaggtgggaggactgcttgggcccaggagtttgagactagactgagcatcatagtgaaaccccatctctacaaaataaaaaataaaaaaaaattagctgggtgtggtgatgcacgcctgtagtctcagctgctcaggaggctgaggcaggaggatcactggagcttaggagtttcgggctgcagtgagccatgatcgcaccactgcactgcagcctgggcaacagagcaagacctcatctctaaaaaaaataataaaataaaataaaaataaatctcttggtagctggtttaccttccagttctgaaatcatagattcatgcttgtttttcagcttggtaagattcttggccttttcttcctcttctgcaagatttgtcgttaagtcactaatcctctcctcaaggagttttcgttcctttttggggaaagagaaagagatagctttaggatttttcttttctctagaatctatgtttcacttttagtgatttccatgtaaacagttgaaagaaaaacccacattataacaaaatacaactagagttttaaatggtaaagagaagtcccataacaatttccaaaaactggccatttctcatctcgtgccagtttgtccctcatattgtatggtcagctaaaggtaccctccttccattcctgccactggccagctcttccctgccccagggcctttgcacagtgggccaaccagctgagatgctcttctactcccctctaactgctccttcatctttaagtttctgcttaaatgtcacctcctccaggaagtcttctatgaatacccttcctctatcccccactgctgtattctttttttttttttgagacagagtctcactctgtcgcccagggtggagtgcagtgttgctatctcagctcactgcaacctctgcctcccacgttcaagtgattctcctgcctcagcctcccgagtagctgggactacaggcgcccgccaacacacccaactaattttttgtatttttagtagagatggggttttaccgtgttggccaggctggtctccaactcctgacctcaggtaatccacttgcctcagcctcccaaagtgctgggattgcaggcatgagccaccgcacccggcctgccgcactcttaaaatatggtgaacgtttccttcagagccctgatcaccatggtaaatgacgattatttgccatctcactacagtataaaccccacaagggaagggtcctccttcaccatgcatacctgcatctaacacagagcctggctcacagtaggggccaagctgacatccagctcaaagaactaaaagcaggtggggctggttagtgactactgactacggtgaccagcttgtcctggttttctaagggcttttctgctttgagaactgaaagtcccaaatccccaaaatctccctgatcctggtaagcctgttgtttttaatgcagaaacttgattccacttttttttttttttgaaacagagtcactctgtcacccaggctgcagtgcagtggcacgatctcagctcactgcaacctctacctcccaggttcaagtgattctcctgcctcagcctcccaagtggctgggattacagacactggccaccacacctggctaatctttgtatttttagtagagatggagttttaccctgttggccaggctagtctcaaactcctggcctcaagtgatccacataccttggcctcccaaagtgctcggattataggcgtgagccactgcacccggcccctactcacttttgatagtttattgttctgatcatccatgaccaggatctcatcctccagtttcttgatcttggcctcagccgtgaccttctcaagttgcagcttctgcctggcagcttcctcctcctccagctgttcttcaaggtcctttgttgtggagggaaaagagtaacagctttggttataacagatttactctcgtggtgatctggggactaatgaatacaggggctaggcctgaagatgcccagaactctgtagcctcctaaaaggaagaaataaaggcctgagcgtggtggctcacacctgtaatcccagcacttttggaggccgaggtgggtggatcacttgaggtcaggaattcaagaccagcctggccaacatggtgaaaccccgtctctactaaaaatacaaaaaaaattagccaggcatggtggtgggctcctgtaatcccagctactcgggaggctgaggcaggagaatcgcttgaacccgagaggcagaggttgcagtgagctgagatcgcaccatcgcaccccagcctaggcaagagagtgagactctgtctcaaaaaaaaaaaaaaaataaagacctgggtaagctgctctgcttcatggaacctcaacctcctcatctataaaatgagcacagtaggtaccatggtggttttaaaatctatccacaagttctttgcgactccaaaaaggtggagcctaattctcctccccttgagtgggggttagatttgcttctaacaacaacaacaaaaatcaggaagaagtgatggaatgtaacttcagagattaggctataaaaggcattgcggcttcctttctcctctctcagatcactccttctgggggaactctgctgccatattggaaggacactcaagcagccctgaggggagaggccttcatgataaggaactgaggcctcctccaacagctgtgtgaataagccaagtagaagtgggtcctccagccccagatgagccttcagatgactgcagcctcagccaacaccttgactgcaacctcaggccggaccctcagccagaaccactcacctaagccactctcaaattcctgactatgcaatactttttatttttagctgctgagtttggcatgttttgttatgtagcaatagctaacaaatacaattatcctccattcaggcttgctgttaggagaaaaggggttagcacatgcaaggcagggcaatagaacagagtgggctcactgtgttccagtcccaatcccagctgtgtggccttgatcagatgaccaaccctctccaagcccccgtctcatcatctgtcccagcagggacacatatccctggatgcacctccacaggcctgtggtgagggtcaagtgatttgctacccaccacgggctgcccctgtgacaccttaccagcatctgctgggccatcttcttcctttcagcctgtagctgctggcccctgtcttcctcctcctccaggcgggcctccatctcatgcagtatctcctccagctcctgcttcttggccgccagccgcacccgcatctcctcagcctctgcatacagctctgtctctgcctgcagctgttcctgtagcaggttcttctcctcggtcagctgcacgcaggtggtggggaggaggcgggtgagccccacggggccaagtcctgttccccagcaaccccagccatgcatccatacaggtacctgcgagtgcttctgttccagctccttaagctcattctctgccttctgctgccgctccttggtcttctgcagttcatcctccttggcctgcatctcctcctcctgccgtgtcacctgcagcagtggcttcacctgcacacacacggttagcccatcatttgtttttgtggcaaagggatatgttgtcataataaattcgatcagtggttccgagccagggacaatgttgcccccaccgatccccactaggggatattgtctggagacactgctgattgtcacagctggggtggggggtgcctctggcatccagtgggtagaggccagggatactgctaaacaccctacagtgcacaggacagcccccacaacagaattagtcaccccaaaatatcaacagtggcaagactgaggagctctaaatcagagcaccagaaaaggtacaaagtgaaaggaaaaagtctcatcttccccactttagaaccatcccaacagagaactactgctgaaaagtgatatttccttccaaggacaaaagggagaaaaaaaatctttcatatcccacccacctccctatcaaagtcattattaacattgtttacatttccttcctggctctttttctatgtttaaaaaatagacttaagaccatgctgcctagttgtagaggctgcttttattatttaaaattatatgatacagacaggaacagtgatgcatgcctgtaatcccagcattttgggaggccgaggcaagcgcttgagcccaggagtttgggaccagcctgggcaacatcatgagaccccatctctacaaaaacaagtaaccaggcatggtggtgtgtgcctgtagtcccagctagtgaggggtctgaggcaggaagatcgcttgaaccctgcaggctgaggctgcagtgagccacgattgtgccactgcactccagcctgggtgacacagtgagaccctgtctccacaaataaaatttttttaaaaattataagatatgtattaccccatgctgttacatcattcttacaactttacatagccatcttttaagttaatttatttatttagcgatggtcttgttttgtcacccaggctggagtgcagtgacacaatcatagctcactgcagccttgaactcctggcctcaagcgatcctcccaccccagctccagagtagctgggactacaggcacatgccacagtgtccaactagacagctaggtagaagtcttttttttttttttttttagcagacctattcagtagccaaagccatcattttaatagctgaaaacattccattgatagatgaaccattattgaactcatcattcagctaggactggacactgaaattctgctattgtaaataaggccataatgaatgcccttaactcttgattttcttttctctttttcaggtggagtctcgccctgtcacccaggctggagtgcagtggcacgatctcagctcactgaaacctctgcctcctcggttcaagtgattctcctgcctcaatctcctgagtagctgggattacaggtgcccaccaccacacctggctaatttttgtattttcagtagagatagggtttcgccatgttggccaggctggtttcgaactcgtgaacccaggtgatcctcctgccttggccacccaaagtgctgggattacaggcatgagccaccacacctggctaagacgattttcttaggatagtttttcagaagttggttcagtggggacgaacatttccaaaaagcagcatctgctgtccttccctgggctgcctcctaactctttgttttcaagcccctgcctggcacaaggaagcccctgctatgtactccagcagcttgcttcatgcacttatcacagtttgccattatgtatctgtctctgtgattatctgtttattgtttactccccaccaattcggctagaatattcatggaggtcagggaccatggtgtgtgttcacagctgcacccccagcacctagcatgtgcctgggatacagcaggcactcaatgtctgtttgcttggtgaaaaagccttgcaccagtggatacactcaagggcatataaggagaagcctagtctattgcaacagagcatgtctttgtgccatggggacaatgcaaccagtgccactacaggaaccagttgagtcctctggaggccctgactctgccagaaataaaaaataatatgctatggccagatgaggtggctcatgcctgtaatcccagcactttgggagcctgaagcaggagggttgcttgaggtcaggagttcaagaccagcctgggtaacagagtgagactccatttcaaaaaatgcaaaaagtaaaaaaaaaaaaacctgcagtattgatacatgcaacagtctggatgctctctaattccatgtatagaatatttgttttatttttttttgagacggagtctcgctctgtcaccaggctggagtgcagtacagtggcgcgatctcagctctctgcaacctctgcctcccaggttcaagtgattctcttgcctcagcctcctgagtagctgtgactacaggcgtttgccaccacgcccagctaatttttgtacatttagtagagacagggtttcaccatcttggccaggatggtcttgatttcttgactttgtgatccacccgcctcggcctcccaaagtgctgggattacagccgtgagccaccgtgcctggccttttttttaaataaaaaaaaaaagaaagaagagacagagtctcaatctttcacccaggctggagtgcaggcatgatcttggctcactgcaacctctgtctcctgagttcaagagattctcctgccttagcctcctgagtatctgggattacaggtgcctgccaccatacccagctaatttttgtattttaagtagagacagggttttgccatgttggccaggctggttttgaactcctgaccgcaagtgatccgcctgcctcggcctcccaaagtgctgggattacaggcgtgagccgccgcccccggcagcattcttgaaccatcaaaattacagaactggagaacagagtggtttccatggctacggaggaagtgggtgtggctataaatgggccacacgagggattccagtgcggatggaaatattaatactttgtgttaaggtcctggctatagcctatgtgccaaaggacagggcctcctcgggccagagaaccgccaatgctcaaggtctgagttcgagccctccattccacacccacttgcgaccacctcctgtcccaaatgtgaaggctccagagtgaagaagcagggctgggggcccctgggaagggggctggggcagagcactcactttggtgaaaagcctccaccactgccagttccgcagcttgaggtaggcggcgcagttcctctgaatcaccttcatggcggtcagctgctgctgcctcttggcaaaagccctagggaggggggaagagaaggtgcgggggtcatgaagccacaccctgctgtcaacagagccctgccctgcagcatcctgaacctgcacagggacatgccccaatctccccaactcaggttcttccagaaaccctgtgtgacacatgtgttgtctggctgcaaacaacttaaatcatctacaggacagagcctttttcagtggacaaggaagacccagggctcacaacatgccctggacttagctgagatccaaacaccactcagaaaacacaactatgtgcatcattcctaagggggctcccgtactccccagctgcactagctgtttcttttttctttctttcttttttttttttttttttttttgagatagagtttcgctcttgttgcccaggctggagtgcggtggcacgatctcagctcactgcaaactccacctccggggttcaagtgattctcctgcttcagcctcctgagtagcttggattacaggtgcccacaaccatgcctggctaatttttgtatttttagtagagatggggtttcccatgttggccaggtgggtctcaaactcctgacctcaggtgatccacccaccttggcctcccaaagtgctgggattacaggtaggagccaccatgcccagcctacaccagctgtttctgactaacttatttatttatttgtttattttcagagacagggtctggctctgcggcccaggctggagtgcagtggtgtgatgatggctcactgcagcctcaaattcctgggcttaaatgatcctcctgcctcagcctcccaagtagttgggactacgggcacatgctaccatgcccagctaatttttaaagttttttttttttggtagagataggggtctcgccatgttgcccaggctggtctcaaactcctgggctcaagcaatcctcctgcctcggcctcccaaagtgcctgggattacaggtgtcagctaccacacccagccctgtcaaacctattctctcctgggttgttttaggaatttcacactgtgaccctgaaccagcactcttcccgtttaagggctatcgatagattgagaaacgatagaacagtgaacgtaattctgtcttccctgcttggctgccatcttggacacaggaaaactttaagaataaaattgccccagttatccaggaaggacagcaacagggaacttagtaacgaaacttgacaagttaggtctgttgcgggagggccaagagctcccaaagctggccttgaccatcttgggtccatgtgtcaatgaatgaacctgacacatcagggtcctactggtgagggtgtggtctctgcccaatgacaacacacaccccagacagagagcgaccccacctgtccctgcagtccctggggtatgactttcattaaggaacccgaacccttccccggctcccagtcttcacagaacagctgggacatcacaccctccaaaaccctgccttataaatcccactgggacacggggatctagacaccgtcaagtcctctttcctcaatggtttatccaattctaacatgtctaggctgggcgcagtgggtcatgcctataatcccagcactttgggaggccaaggcaggtggatcacttgagaccaggaatttgagaccagcctggccaacatggtgaaactttgtctctactaaaaatacaaaaattaggccagtgtggtggtgggcgcctctaattccagccactcgggaggctcagacacgagaattgcttgagtccaagaggcagaggttgcagtgagttgagactgcgccactgcactccagcctgggcgacagagagagagagagagactctgtctcaaaaaggaagaagaaaggaaggaaggaagggagggagggaaggaaggagtgagggagggaggtaaaaacaacaacaatcatttctgacctgagaaccacgcactgttctaagctctcgtcatgcgttatcttagtgacacctcatgaacagctctctgaggtcaaaatgattatgctcagtttccagctaaaaaactggaagctcagagaggtagagtaacttgcccaaggttcatcagcaaaaactggggcatccacgatgagaacccaggtctaaaactcgttcccttcctgcactcgtaacttggtacatttatttaaagtagaagcatttcttccccttcaagaaaaggctgtcattcagtcaatgatgcatcttaaacaggtggcctcttagaatcagggaatcagaacagaaaggcccctgtttgtgattcgcgtttgaggtattaggatgcaggaaagcatctttactttctggccaagtagccacgacacatcgcctggaaggccatgatgacatcggtgatcttcaaatctcgctcctcctctaggtgggccaggacgccagttcggaagaagattttgctctgccctatcctgtataagttggggtcaagttccagggctttgatctgcaaaaggaaggaaaggaagagctcctgatttccactgtgccatttggccagtgatgacatgggtaagaacggtcccaccaagagcagcaggtggcttgcggccagaggttgggaggtctctggtggacttctgggctcaccatgagaatgcaggcctgcttcccgtccatgaagcctttggggatggcattcgccgccaggatctcgtagcttgaaacacagagcagaagtcaccccgggtacctccagcatccattcctccacccagtcccgctcaccccctgccctacctgggccagaccttgggacttaccgttggcggaactcctggaagacgatccggttggggaagccctgccggcagatgcgaatgccttccagcaccccattgcaccgcagctgctccagcaccaggaacgcatccagcttgccggactgcaaaggtcaaagagggcagtggatccctggggccagaaaccatggcgcagcaaagccccaaacctcctacctggatgacccacctggccaggccatgagggtaccaacagaagcacccaaggagggcttagctgagggccgaggggcaaagcagtgcccccctctgggttttcatctctttgcttcggcaatggctgcctcatgatctctctggttcttggtgacactagcatcgcctggctggaacctggggcttcctcctcatcacctcgtctccctcacttcctgtccatcagcagtttgattgcttctagctcccaaatatctcccaacccccccacttctcttcaccaccattgtctccactatcttctcctgcctggacaaccacagaaaccacccacctggtctctctctctggtcttgcctctcccctcaatccctttgtcctttttattttttgagatagggtcccattctgtcagccaggctggagtccagtggtgcgatcatggctcactgcagcctcaaactcctgggctcaagtgatcctcccaaatcagcctcccaagtatttgggaccacaggtatgtgctaccatgcctggaaaatttttaaaaatgtttttgtagatatagggtcttgctatgttgcccaggctagccttgaacacctggtctcaagtgatcctcccacctcaacctcccaaagtgttgggattataggcatgagctagcatatgcccagccccctcattcacttcctaaaatgtaaatctgaccatgatatagccctgctttaacacccccaatggcatgcctagagagagaaggccaagctccagaaagaacacaaggagcaccacgatctagcccctgcctacccattcagcctcaatcctacctcacaccatctgattcctacctcatgccatcacacatttgcaacatgaaatgacctatttagcattttctttccttttttttttttttttttaagatggagtctcgctctgctgcccaggctggaatgctgtggtgcaatctcagctcactgcaacctccgcctcctgggttcaacagatttttgtttctcagcctcctgagtagctgggattacaggcgtgagcaacacgcctggacactatctagcattttcttacctagttccttcacttctcacctccacactcttgcttagcctgggccctctgcttatcctaggccccctgcttatcctaggccccaccctgccttccatgtcaccaagttgatggccacacattcttaacgttcaagttcaccagaagctttctctgagtcctgaggctgtgggaggagccctggctctttggtgttctcctaactgaccacattccatcaccatcatcagctgtatgtttacctctccccgtgtctcccataacctcagcactactggcatcttgtagggattctgtgctgggggttgagggaccatcctgtgcattgtacaatgcttagggcatccctggcccctacccactagatgctgactaacagccccctcctggttgtgacaaccaaaaatgtctgtagcatgtccatatagaggacacaatcgccccaagctgaagatgcctgcaccagattatgagaaacccacagggaagggctacaatttttctaacactgctccccagcacccaggacagggcagagcccagtgaatacttcctgggataatgaatgaatgagtggctggatgacctgcacagcaactccacaactgaaaagtctctggatgcatcctcccttcctccttttcctccagggatggggaatgggtctgagattcagatagccttccccacatggaaaatggggtcctcggggtaggtgggggcagagggcgccctggggacgctgtgaccgcttgggacagccctggcttctgggagccccagggtctgggcggcgggcctcaccctcttctcgtggttggggatgatgcagcgcacgaagttgggcgtggtgttgcgtagcgtggtcatcagcttgcccagctgctccttgtacagctgccccactgtgcggaacatgcccttcttggtcttggaggcgctgggcagcgagctctccgtcatcttggccatctggtccaggcccacgatgcggtccactatggggcacagccagggtggcatcagcctctggcccacccacccctaaataggccagaggctcagccccagccccacccaccaacctgcccactccaatctttccttccatcaccaacgcctccttcggcagtcagggtttccaagtattgtctattggggaaatcctgagagcacctgagtggcagaaagaacaaattccctgtgatggagtcacgctgacctaggagtcaagcctgctctcgctgtccactcactgactagccttggcttggcactatcctgtgcctcagtctccctttctacaaaagggaggtaataataccgtctaccttctagggcaggggtaaaaaaaaataaggcacagaaggcacttattccctgccagcctccaatctttcatccaccaacaaatagttattgaggaccttctgtgctccaggccctggggacactgctgtgaacaaaaaaagacccggccccctcaccccgcttatatcacagggaaggagacagacagagatcacagatgttaagtatggaatatcttgagtagtgaggtgtgcgtagaaaaataaaaatagggtaaagcggagagagagtgaagagggtgctctcttagacaaggaggtggtgggctctgctaagttgatatttgagcagaaaccagcaagaaatgagtgggtaaccatgtaggtatccacggaagaaatattctgaggcagaagatacagcacacactccgagatagcctggcacatcagtaagtgctcaacaaaaagtaggtattattattattattattattattattattattattattatcattattttattttattgagacggagtttcactcttgttggccaggctggagtgcaatggcgtgatctcggctcaccacaacgtccgcctcccgggttccagcaattctcccgcctcagcctcccagtagctgggattacaggcatgcgccaccacgcccggctcattttttttatatttttagtagagacagagtttctccatgttggtcaggctggtctcgaactcctgacctcaggtgattcccctgccttggcctcccaatgtgctgggattacaggcgtgagctaccgcgcccggccatcatcatcatcatcatcatcatcatcatcatcacctccaaggttctttttctaccagcccagcaggtcctgcacatgccaagcccaacccacaggccatggatggcaccatttcttcaccttctactcagattctgtgtaacaatcttttttttttttttttttttttgagacaagctctcactctgtcgcccagctggagagcagtggcacgatcttggctcactgcaaccttcaccacccaggttcaggtgattctcctgccttagcctcctgagtagctgggattacaggcacccaccagcacacccggctaattttgtttttattttttatttttagttttattttttcaagacagagtcttgctcttttgcccaggctggagtccaatggcacaatctcagctcactgcaacctgcgcctcccaggttcaagcagttctcctgcctcagcctcccgagtagctgggattaccaccaccacgcccagttagtttttgtatttttagtagagatggggtttcgccacgttggccagactggtctcgaactcttgacctcaactgatcctcctgcctcagcctcccaaagtgctgagattacaggtgtgagccaccatgcgcagcctcatgcttgtctctctgcttgtctttgagagtctcatctctcccacaagactgtgggtcccgcagaggagggactacaggcttcatcatgtgtcctgggatgacacagacccagggtgcgatgttgttccctaggcccagagcctggcatatggttagggcacagctggcccctcctggagccctttttttagcatgcttaaaacaaggggagaccagtcctgtaagccccaggcccatgggccctgtgccaagaataaaacctgctgtggacactgatggccagggacaaacagcaaaccccctcccctcatcatcactccagcagctcttcacagggatcatctattcactggttctcaaagggagccggagtgtggtccctagaccagcagcatcacctgggatgaatgttttcaggcccgccccatccctggccccagacctgcagaattagatcttagggtaggcccagccatctgggttttaaaaagccctccaaagagggccaggtgcagtggctcacacctgtaatcccagcactttttgaggctgaggtgggcggatcacctgaggtcaggagtttgagaccagcctggccaacatgggggaaccccgtctctactaaaaatacaaaaattagccaggtatggtggtgtgtgcctgtaatgctagctacttgggaggctgaggcaggaaaatcactggaacccagaaggtggaggctgcagtgagccaagattgcaccaccgccctccagcctgggtgacaaagcaagactctgtccctaaataaataaacaaagccttccagggggtcatgatgcctgcttgagtttgagcatcactggtctaatttaaccctcataatacctctagtagagacggcaactattattgcatctcctgttttactaatgaggacaatgaagcttaatgacatcaagtgactcatccaagaccacagagctaggaggtggcagagacaagatacagtgaagtccttctgactctggacagggcagtctaactccccgtgcctggcatgctgtttctcctctattgcctgagccctgacctcaggacctcaatcccctcgggacatgtaggattgaggggctcagggacccccactcaggaagaaattgtttcaacgagacatcaccagcccatgccaatgctcttccttcccctgcccccatgtaaaggcctcccctcctggggcaggtgtgagagtcgggggacttgggtgttcaattctccagctcaaagcagaacatggacccgagcagagaaggccttaccgtccttccacaggtcggccacaaacttgtcggaggaggcattgagcagggaagtcacgttgtcattcagcgggtccatattcttggtcagccaggcactcgcattatagtccacctgccaaggacaccctgctggtcagaacccctgggaaactagaaacttagaaaccaaggccaggaccccagccctcccattgtccttccagatcttctgaggtcagagaggaaatgacgtttatgaccaccatgatgggactccacaaacaccagtgaagagaccaacagcccagggacctgtgcccacgtagtaggacatcagccagtgatagccattgctgggaaagcctagtttccattccatattctcctactaacgctgctgtggtagcctccctcctcctaagccagcacagtacctgtgagttatacactattaagagatttcatgacggcagatgccctcctgccgacatgcaaaactcccccctcatcatcttcccaatcatcctggtttagaaattaagcatggcagccaagcgtggtggttcacactggtaatcccagcactgtggaaggccaaggtgggtggatcatttgaggtcaggcgttcaagaccaacctgaccaacatggtgaaaccccatgtctactaaaaatacaaaaaaaaaaaaaaaattagccaggcatggtggtgcacacctgtaatgccagctactcgggaggctgaggcaggagaatcgcttcagcctgggaggcggagattgcagtgagctgagattgcgccactgaactccagcctgggtgacagagtgagactctgtctcaaaataattaaataaataaattaattaagcatggcatcctattttccactctctaatgagcataatttgtaactcagagatcctgatatatggatatacagaaaaaggacatataggctttttacattcctgactcaaacaatgacaatgcccaaagccgtaatttttactatggtgaatattaaatgaaaggaactgataatacagctttgctgggttatcatgggatgtgggttatcaggataataggtaggcttgatctgagagaagactgaaaataataataaaaaaaatccactgatgaagtagggaaaagaaaagtgttgtctctatatgcttaaaggaacatatacccccttgaatataggctaggagttgggaaacttttggtgaaggcccagatagtagatatttttggcttggcaagtcatacaatgttttgtttgtttgtttgttttggtttttgagacagagtggttctctgttgcccagtctggagtgcagtggtgcagtctcagctcactgcaacctccaacttcctgggtcaagcagttctcttgcctcagcctcctgagtagctgaggttacagttgtgtgcctgtaatctcacagctggctaatttttaaattttttttattttttatttttagcagagacgggctttcgccatgttggccaggctggtctcaaactgctgacctcaagtaatccacctgccttggtgctggggttacaggcgtgagccaccacacccagccaagtcatacagtctttgtcgcagctactcaactctagcactgtagtatacaaaagcagccagccatagacattatgcatacaaatgggcatggctgtgttccaataaaactttatttacaataacaagctgtgggccagatcggactctgttgccaggccctggtagagagcattgtttgtgcccatgatgcagtggaggtactgaggagtcaatagaatactacaattctgcaagccagactaagctatgtcctttgtacattatccaggactcttgagagccacagggcaagggcctatacaataacagccaaggcatgttgatgatgatgatgatgatgatgaatacaactatcatagatttccctggccagagcaggctggcaatagcaaactcaagaccgtgacatgggagatttttgttgaagccaggtgtggatgtattagtcaccccattccagttggccccgcctgttgggtataacttgtagcaggaaggatttagagtctatacaagaaaagcaggctgaggccaggtacagtggctcgtgctcataatcccagcacttcaggaagccgaggcagggagatctcttgagcccaggaattcaagaccagcctgggcaacacagcaagaccccatatctatacataatttaaaaatttagctgggcggccaggcacggtggctcatgcctgtaatcctagcaccttgggaggccgaggcgggtggatcacctgaggtcaggagtttgagaccagcctggccaacatggcgaaacccttctctactaaaaatacaaaaattagctgggtgtggtggcaggtgcctgtaatcccagctatttgggaggctgaggcaggagaatctcttgaacccggagggagaggttgcagttagcagagatcacgccattgcactccagcctggatgacaagagcaaaattccatctcaaaaaggaaaaaagattttagctgggcatggtggtgtacacctgtagtcccagctacttgggaagctgaggcaggaggatcgtgtgagcccaggaggttgaggctgtagtgagctatgatcgcaccactgcactccagcctgggcgacaaagcgagaccctgtctccaacaaaaacagaaagaaataactgtctggacgtcacggttggaaaacatgagagtggctacagctgatgccttacagatgcgtagacaaattacgaataggacttggttgggattcgcttagcagcagatggctttgcagtttccaggcagcccaaggttctgccactctcagactgtctctgcgctgagcagccactgggggtcccctgagacagagtcccctgggccctgtggctggtaccttcccagcataatggatgatggagaactcagtcttgtccttgagctgcttgggcttctggaacttggggtggctgccctgctccgtgcacagcttctccacgaaagacttgtccgtggctttggggaaccagcattcctcgtccagcagggccagcacacctggagggttgttctgtgggagacaagtagggcttgaatcagagagaacacccaacctcaggcattccatgaagagctggccaactatacacaacgcatgggcatccgccgagatctgatactgtatttgcccacatataaagatgagtttatgacccccatgcttccaaatctaccttcaaattaccctgtgcccaatggaccagtaacagggatggaaggcagaacataatgtttgctgccgccccctagtgggcaacacgcaggcaacatcatgaagagttcataactcttttttttttttttttttttttgagacagagttttgccttgtcgcccaggcagacggtgcagtggcgcgatctcgactcactgcaagctccgcttcctgggttcacgccattctcctgcctcagcctcccgagtagctgggactacaggcgcctgccacggcgcccggctgattttttctatttttagtagaggcggggtttcaccgtgttagccaggatggtctccatctcctgacctcgtgatccgcccgcctcggcctcccaaagtgctgggattacaggcatgagccaccgcgcccggccgagttcataattcttgcaaatgaatttgttgcttgacttgaattcacctagggttcctgttagaaaagttttttttggagacagggtctcactctgttatccaggctggaatgcagtggcgcaatctcggcttacagcaacctctgcctccagggctcaagcaatcctcccacctcagcctcccaaatagctgggaccacaggcgtgcaccaccaggcccggctaattagtagaaaccctgtctctactgaaaatacaaaagttaggtgggcgtggtggtgcacgcctgtagtctcagccacttgggaggctgaggcgggaggatcacttgaggcagggaggtggaggttgcagtgaggcaagattgtgccactgcactccagcctgggcaacagagtcagaccatgtcataaaaaaaaaaaaaaaaaaaaaaaaagcaatggcagagaaggaaagggaagggaaagagggtagggaagaaaaaaaggaagaaaaaagaggatggaaggaaggcagaaattaaagaaaatacctttgatatgaaaatgtgggttaatggaaattgtaagagttcacaaggattcagcttacagcctttcaggactgggtgatggattgggtgggggaatgctatgtgcatggggagagtgtggggtccacgtcggctccacagaggccacacacgtgtacaaggtgtgacggagccccgcacgcccacgtgcccctcaccggtcgctcgatgagctcgatgcagggctgtaggtccagcccaaagtcgatgaagttccactcgatgccctcgcgctggtactcctcctgctccaggatgaacatggtgtggttgaagagctgctgcagcttctcgttggtgtagttgatgcacagctgctcgaaggagttcacctgagcacatggcgtgggggcggggcgtgagcatcttggtatgaagtcagaagacaaggagccccacagaagctccacccgacagcgcccccatggcccgcccacatcctgttctgccatcccagcacccagacagggctgaggccccaaaacatgctgcctagagtccaccagggctggtgaagttgatatcacatggccctcacacaccttaaagatgcttatctcctccatctgcacaaccatctatggatggacaaacctcgtaaggcacgctactgcatgtacagatgtggaaacattttacagatgtgaaaacagaggcgcagagagaaagtgactcggtagtacacttctttcgggacatctatcaatcttaaaacctcctggctgggtgtagtgctcatgattgtaatcccagcacttagggaggccaaggcgggaggatcacttgaggtcaggagtttgcgaccagcctggcaagcatagcgaaacctctctccactaaaaatacaaaaattggccaagcacagtggctcatacctgtaatcccagcactttgggaggccgaggctggtggatcatttgagatcaggagtttgagactagcctggccaacagggtgaaactctgtctctaccaaaaaaaaaaaaaaaagtagccaggcatggtggcactaatcccagctactcgagaggctgaggcaggagaatcacttgaacctgggaggcggaggttgcggtgagccaagattgcactactgcactccggcctgggcaacagagcgagactctgtctaaaaaaaaaaaaaaaattagctgggcacagtggtacactcctgtagtcccagctactcaggaggctgagacaagagaattgcttgaacccaggaggcggaggcagcagtgagacaaaattgtgacactgcattccagtctgggcgacagagcaagactctgtctcaaaaaaaaaaaaacaagacaagacaaaaaaaaaaccttccctttctctgagaactttcttcaaacccatgggtaaaggatccaatatccatgtttctactacatgaggtattgcaagctcctgcaaacagttcttggcttggaggtgaccatgtagcccaattcaggtgagtaagagtcagtgagacttaattccaagattttggttggaactgttagaaaagagatatgtgctttttttttttttttttttttaccaggattactgagaggcagtctggagctgtggcagccatcttgcccccgtgaggggagagcctgcttgagaatggagccaatatggaggaaggcagagagagagagagaacgatggcgggagatcagaccctgcctacgggatccagctacatgtctggccttctcagttccagaaaccaatgcatttcctgttggatttctgtctcttataccctcaatgatccacccttaactagacagcctcctaccctacagtagccatctacatgcctttctccaaaatcatgactcctccaagaaaaagcccatctcagacaaccaagaccatggctcttaggatcccaccgagctgtacctcaaagatctcaaatccagctatatccaggatccccaggaaggaagccccttgccgatgggtcttgtccagggctttgttcacgcgggtgagtatccagcggaaaaggcgctcatatgttgccttggccaaagcctctacagcaaagtcagcctgcagagggcaaccaggggaacccggttattctcaatgggctccattttcacataagccaggctggtggtgaagatttttattcttggccgggtgcagtgactcacactgtaatcccagcactttgggaggccgaggcaggtgggtcacttgaggtcgggagttcaagaccagcctgaccaacaaggcaaaaacccttctctactaaaaatacaaaaattagccaggcgttgtggtgcatgcctgtagtcccagctgcttgggggactgaggcaggagaatcgtttgaatctgggaggcagaggctacagtgagctgcgatggcaccactgcacccccccctgggcaacagagcaaggctctggctcaaaaacaaaaaacaaacaaacaaacaaaacctgacatgggactgtgaatattctagtattgaataaatgagggataaagagatggatgggtggatgcatggacagatgaatgaatgaatgaatgaatggaatgacagctggatgggtgatggatggacggacagatggacagatggctgggtcatggatggatggacagatggatgagtgagggatggagagatgatgggtgagcagatagatgggcagatgaatggatggatggatggatggatgaacagacagatgaatgagtgggtagaaagatggatggatggacagatgcagaggcagaccatgggtgaatggattaatgaatacatgaatgagtgaacaggtggatagatggatgaatggatggatgggtgggtgcatggatggataagtgataagtacatcattacctgttcttttgtctgagctttctgtaccacatctcgcccaaccttgatacgaggagtgaggatggatctggtgaaatctgtcacattaattcccatgaggtggcaaactttctgagcagctggatggagaaaagaaacatcgtgagtgcatcacaaaagaaatagcttggcaagaagacacatcgcatgggatatttgtgatctgtgaatacagcgggttctcttggggaaatgggacccgctgaccatgaatatagcttgaagtgtcctaaaggctgctgtcattagtggtcacactccccagtattttgctgagaggcaatgattggggtgggctgaagcaggccccagttgggggtttagggtcaggtagttctagtttcaagtccctgtcccttcacacttccaagtcatgtgactttggaaaagctctttaccctcccagcatcttgcttttctcagctttaaaaagggtcagctcttcggtaccttgttggtacccaggactaaataaggtaaagtatgtaaagtccctgagatagatagatttatttatttatttatttgtttatttatttatttatttttggagacagagtctcgctctgtcgcccaggctggagtgcagtggcgcgatctcagctcactgcaacctccgccttccgggttcaagcaattctcctgcctcagcctcccgagtagctggcattataggtgcctgccaccacacccagctaatttcttttgtattttagttgagatggagttacaccgtgttgcccaggctggtctcgaagtcctgaactcaggcaatccgcccacctcggcctccctaagtgctgggattacaggcgtgagccactggcccttgagatttatttaacagttacttagtaagtattaaatagttattaatagtaacatttattgaacagttactgttcaataaatatttctttcacccttctaggatatgtgttgcagcattgtttgcaatagcaaaatgctagagtcaacctaaatgctcttcttttattttgagatgcagtcttcctgtcgcccgggctgaagtgcagtggtgtgaccacgagctggtcccttaacatgaaaatagcattacatgctgctttgcatgtgcaaggcagagtaaatagagtgattttaggatttttttttccccatctcttggcaagagcactttttcatttctctttccctgaggtctttccttggcatccggattccattaatttgccagatttagggactctaatacataacaaacacctgagaatgaaactgccactgcaaaattataactgagacactgaacaagatctgacctaacggactccaccttgcttctaacctccaagctccactgaaccatttgtgggtgtaagccgaattaacttggcaggaacttagtttatagtttattttttatgttttggacacagagtctcactctgttacccaggctggagtgcagtggcacaatctcggcgcactgcaatctccgcctcctgcgttcaagcagttctcctgcctcagcctcctgagtagctgggattacaggcgcctgccactacgcctggctaatttttgtatttttagtagagatggggtttcaccatgttggcgaggctggtcttgaactcctgacttcaagtgatccacctgcctgggcctcccaaaatcctaggattacaggcatgagccaccacgcctagcctcttagtttatagtttaaaacacaagaaccctttcccaaaacaaacccccttcttgcctggagactagactgcctttgtaggaataacaaattagcccaaaggtttgaaattatggtttaggagtcctgtaactggaggctacaagagtctgaccctccctaaattgctcctggggataacatcactattgtaaaacctaagaccagtacttgagatatttttgcggaccctggcaccaggtggatcagctgacaccacccagatcgagaaactggctcatctgatcttatggcctctgtccaggaactgactcagggcaagaggacagcttcgactccctgtaatttcatctctgacccaaccaatcagcacccccaactcactggcctccccctaaccacattatgcttaaaaactctgatccacgaatgctcaaggagattgatttgagtaataataaaactctgttctcccatgcagccggctctgcgtgagttactcttactctatcgcaattcccctgtcttgattaattggctctgtctaggctgtgggcaaggtaaacccagtaagcggttgcaacaggtttgatcaaggtgggctctagggagcgggaaaaagcaacacaatatacagcctgggctgggaaataagaaacctaagttttgctctcagctcagccaccaacaagcatagtggtagccaggccagcttctcaaaacacaaaatactgtttatttgtgggtaggtttatcagatttagggggaaaattacaggatgctcagttaaacctgaatttcagataaacaagaatactcttttggtataatcacggtccaaatgttacaagggacataattaaaatttaaaaaaaggtttgttgtttacctaaaattgaaatttatctggacatcctgtattttatctggcacccctaattctcagggcaattgaggtctgtctccccaagacgaccacagataccgtaagaagagctattcttgtgtcatttcctgctgtatcccagtggcatattgcaggggcttgagaaatatttctttaacaaaacaattaagtggggtattttagaagagatggtccctcgggatcttgtctggtcactattaggggtaggacgtgatgactcttgcctgtaatcccagcattttgggaggccaaggtgggaggatcacttgagctcaggagttcaagatcagcttgggcaacacagcgagacctcgtctctattaaaacttgtaaaattttgtatttaaaaaaaagaacaaataaataaaactattaggtttgtttttttttaatccctgcgctctgattcaataactttccacatagggtcttgagcactgaaaagtttgaaaaagtgagtgataagaacctagtccaactgttgttaaaatcccagataccttcaccttgaaaaataaccagtggttaaatgtcacctcccccacccccccaaccccaaagtcattggtcatcaggaaaaagtggcaagtacctgtgttatctggcatggacgcctggtctgtgtttctttccttcttgaagacgatatttccaagctgcaggaccgatgataccaccttcaatatggctgaggtggggagagaagggcagagcagacacaaaggtcaatgccaaggtaccctggagttttggagcctaaagccactggggacccagagccagcttacatctttcctctgaagaaactagattctgagctcaatattttcatatggttgcttaaaaccttgcattacaatggaatgccacgcagcagggactggcaaattacagcccatggaccaaatctggcccactgcttgctattatacataaagttttagtggaaaacagctatactcattcatttacatattgtctgtaactatttgcatgctacactggcagagttaatgagttgcaacaaagatcgtctggcctacaaaggctaaagaatttactatctgaccctttacagaaaaatgtgttagcaacccctgccacagaacagtgagaatgaatgagctacaactaccacaaatcaaaactgatgtattggggccagcatagtgactcatgcctgcgaccccagcactttgggaggctgaggtgggagaactgcttgaagccaggagcttgatacagcctgggcaatgtagggagatcctgtctctaaaacaaaaaaaaaaccctgacatatcttccagacacaaataccgaacaaaagaggacagatggaaacaagaacatactgtctaagtccatatatagaccgtccattcaagaagaggcaaaactaatcgatgctgttagaagtcaggataatgattatccttaattgagggaagttcttagaaggtgcatgtgggagcttccatggggctggtggcattgtcttatttaaaatggattctagttacacagacgtgttcagtttataataattctttgcactgcacgctatggcatacacaattttctccatgtaaatcatatgtcaataaaaggatttttgaaataaaaaccctgtgcttcttacatactcttctgggtgtaacagatgcccatgttgggatgaagaagatatacatttgtttccacttgttgtccaggtgtctccaaacaaaaacgctgtgttcccagaatacttggaacctttctgactccatactcaggccatgttactgttaaaatagtttctatgtctgaaatccccataagaccatgagtttctggagagtggagggcctgccctaatcatctttgaatttccaaagcctattccaaggtcctgatacacatgggagggagggagagagatggatggatggtaggtggaaggtggatggatggatgaatgaataaatggatagaggatgggttcatggatgaatggacggatggatggatgggtgggtagatgaatgggtgaatgatggacggatgagtagaggatagatggatgaatagaggatggattgatggatgaataattcatggatagaggatagacggatgatggatggatggatagaggatagatggatagatggaatggacagaggattgatggatagacgatggatagatggatggagaattgatggaggaatggatacagcattgatggatggatgatggatggatgaatggatggatggacagatgatggatggatggtagatggatgaatggatggatgatgattaatgcaaattcttggcttagcttaactcaggtacaaatcacccagagttctggcttcaaatcagtcactatgttccaggaacaaagcctagagatcccagacttctctggttcctcaggccaaaccagacattacaaggcccttcacaacagctattctcacgccatggggtccctggcccagctcagcaaaaggacccagctgctgaccacccatccatttgctcccacttactatggtagaaagccttctccccaaaatgaatgaagctgctgttgacagggcttggaaacacacttccttttaaccataacatctatgaaagagtctttgtaaactatgaagagttgcactcacagttttaaaagtgtcaatttaaactaaagattcctgaaatgcctgcacagcccaggcgagccggccaactcagggtttctcaatcttgtcactgcagaaattgggggccagataattctctattgtggggagctgtcctgggtatcatgggaagtttagtagcatccctggcctctaaccactagatgtcagtggtggttaccctgacagagttgtgacaaccacaaatgtcaccagatactactcaatgtcccctgggaggcaaactcacctctggcagagaaccactggtctaaatgaacaaagccaactaatgaggactgtggggacccaaggaggccacaaacccatctgaaggggccagcagctactccgtcattgccacaggggatataagccaagtgttgctggaacttctgatttttctagataatggaaacccagagtttttatgtgaagtgtacccatgttttttggtgtgtgtgtgtgtgtgtgtgtgtgtgtgtgtgtgtgtgtgtgtgagactgagtcttgctgtcacccaggttggagtgcattggtgcaatctcggctcactgcaacctctgcgcttcccaggttcaggggaattctcctgcctcagcctccagagtagctgggattacaggcgtgtgccaccacacccggctaatttttctatttttagtagagacggagtttcaccatgttggccaggctggtctcaaactcctgacttcaagtgatccatgtgccttggcctcccatagggttgggattataggccacagtgcccggcctacccatatttaaactttaggaaccaatttctaaaaattttgaaggttgtagtggccgatctctcctgtgggctcaggaaccattggtttgcactttctggtatagttaaatgtaattccagaaatgacaaaagaatgccaccactcccaggccataagagatgaaccttggggcagaattagcagacagcaaagaagtaaaccagtgaggagacacaacacagcaagggtggtgacggctggcagcatcctggtgtgctggtgcaaagcacgcgctctgcagttagagagtcctgagttcaaatcccagctttgcttcttataaatctcattatctctgaatttccaaatcctagttccgggtccagatacacatggggagggagggagatggatggatggcagatggagggtgaatggatggatgaatgtataaatgtatagaggatgggttcatggatggatgggtgggtagatggatggacggatgggtgatggatggatgggtgatggaaggatgagtagaggatagatggatgatagaggatggattgatggatgaatcatggatgaatagaggatagagactctacatgagtctcaataagtcccatgagcctcagtttccctatctgcaaaacggagatggtaacagtagtacctgcttcgtgaagtttaggtcttgtaagatgctgagcaagggcctggcctagtaggtgataaagagtggaagccacctatattaggttgaatgttggtctttctaaaatatgtccacctggaacctgtgaatgtggcctaatttggggggttacatttatttttttttcctttttgtggataccggggtctcactatattgcccaggcaggtctcgaactcctgggctcaagctatcctcccgcctctgcctccctgagagctgggactacaggcgtgaaccaccgcgcccagcctgaacgtggcctattttggaaaaaatcggtcttcgcagatggaatcaagtacaagatctcaagatgagatcatcttggattaacctggtgggccctacatttaatgtcaagtgtctttatgatggacagaagagaagacccacagagtagaatgccacatgaaggatgaggcagagactggagtgagacaagccaaggaaaagccaggaacagccagagccaccagaagccaggacagaggcaaggaacagatctccctcagtgcctccaggaggaacaacccctgccaacatcttgtcttttaaaaaaaaaaaaattttttttttttaaatttttagtagagaaggggtcttgctatgttgctcaggctggtcttgaactcctggcctcaaacgatcctcttgccttggcctcccaaagtgctgggattacaggcatgagccattatgcccggctcctgccgacaccctgatttcagaaccctggcctccagaactgggagagaataaattcctgttgttttaaggcatcaagtttgtgctaattttttacagtggccttacacctctcttcttgctgaggaataagaaacaggactttccaacatcagacatgtgtaccaccagggatacacaggatggacaatttaggtgattttattttttatcttcaaaatacattagaagcagtataaccaggccaggcatggtggcgcatgaggatatcttgaggccaggagttcaaggctgcagaacccaatgtggtggggaaaatcctggtgtcccctggtcacttggagcctcatgaagctccagcctgaagcctgacccacccccttctccataggccccttgatggagggtttggaagtagctcttggtttataaatggggttggtgtacatttaggactaagttggttcctatgagagttcgtcatttgcacgccatcgtctgaatgcttgctctgtgtaccatctgctccattatttgcttaatcattttctttaaatttacttccttctctttccttacatttgttttaatagaaaactttctctatcttcagtgacaaatcatcttcacttgccataaatagatggcaattataaatataaatacaaggaaaacagtattaccaaattctagctagatgcttggggctgccgaaggtgctgggcctggagtctggtctctgtggttaaaggggaaacaagtgccaaagtacattgagaacactggggactgggcatggtggctcatgcctgtaatcccagcactttgggaggccaaggtgggctgattgtttgagcccaggagttcaagaccagagaatactggataacatggtgaagccttgtctctacccacccctccaaaaatcaaaccaaaacaaaacaaaaaaccccaggccaggcacggtggctcatgcctgcaatcccagcactttgggaggccaagatgggtggatcatctgaggtcaggagtttaagaccagcctggccaacatggcgagacccagtatctactaaaaatacaaaaaaaattagtggggcatggtggtgggcgcctataatcccagctacccaggaggctcagccaagagaattgcttgaacccaggaggcagaggttgcagtgagccgaggtcgtgccactgcactccagcctgggtgacaatagcaagcctccatctcaaacaaaacaaaacaaaaaccctaaaatcaaaaattagccaggcgtggtagcacatgtctgtagtctcaacgacttgagaggctgagctgggaggactgcttgagcctgcaaggcagagattgcagtgagctgagactgcgccaccgtactccagcctaggtgacagagtggtgtgatctcggctcactgcagcttcgacctcctgggctcaagcaatcttcctgcctcagtctcccaagtagctgggactacagtgtgcaccaccacacccagttaattttttgtattatttgtagagaagggatcttgccatgttgcccaggttagtctcaaactcaagctcaagtgatctgcctgccttggcttctcaaagtgctggaattacaggcgtgagccaccatgcccagcaaaacaatttaaatggtctcattgttttctttcacaaggacagacaatgatttaataaaccctctattaatcaacctattttagtttgttccagtttttttctatttattttttttgtagagacagagtctcactgtgttatccaggctggtctcgaactcctgggctcaagcaatcctcttgcctcagtgtctccaaatgctgggattacaggcatgagccactgtgcccagcctgttccagttttttattatttaaataaaactatactgaacagtgtagtacatcaagaaaaaaggatttggtaaattcctggcacacagcaaatacttaaccattgttcattgttatttaaaagcaagattagaagcaaaactgacccctgtcccaaatgaaatgaatcattcttggagggcctatgtcattcagacaaggaggctatcagcactagattctgatgtgggaccctggccaagacccacatacaccatccatttgtcaactgacccatacagcctaattttccagaccccaagttatcttcggaggagctgcccctccccttatgcagcatttcagcaacctcagtgctattctggggctccaaacgggcgtaggcgtgggaaggaagggaaactttccacagttctgtcctggtgttcctgaaagagattaaccttcaacactgaggcacatctaacgcagaaggaaaatcgtttctggaaacacagtgtcccgaccaagaatttctttctgagctgtcctgttctcaagacccagtgtgtttcttggccattggttggatgattttgatcaatatcaattgatcaccagagcaacccctccaggaaaagcctgagtaaatccactgcctcgatcactccccctcccctaaaccctgcccacatgttcctgatgaggccaacatctctaccttcagctccaagaatccattcttagggaccataatgaaaccaccctgcgctttccacaaccctgcctatgctgcatagctcaggaatgtgcatatcaacctaagccaaccaatcagagtcaatgacactccattcaggaacttaagccgggaatctactctgttctttggacataaacccaaagaatataagggctggaacccagctatgttgctgtcaacaaactgcatcctatagagaaacaatgtagtcgagagagatagaagacaagaaattaggttctagaaaaatcttttgaacacctagatctcactgtacctgaagcttgaattcctgaactttttttttttttgagatggagtctagctccatctcccaagctggagtggagtggtgtaatcttggctcactgcaacctctgccttccgggttcaagcaatcctcccacctcagcctcctgagtagctaggactacaagtgtgcaccaccagccctggctaattttttttttgtatttttagtagagacagggtttcaccaaattgaccaggttggtctcgaactcctgacctaaagtgatccgcccaccttggccccgcaaagcgctgagattacagacctgaaccactgtgcctaacctccctgaacttctcaacattctgagttagtcactttccctttggtttaagccagctcgggttacttgcaaccctagttatacagccacttttctacaacacaaacaaaccacctagaataaaattcattttcctccttttttttttttttttttaatggaaggtggggaattcagagagcagaaatctgtcctgaccagagaagagttcttaacaggttccactggtatccaggcaagctaccctccagactcaaggtgtgaggcttacatagctgctcctcctcgctgaaacccatgattgccatggcctccacggtttcctggaacatctcatcatcctgggctgctgggatgggcacaaagccattggagaggaaggtgtagttgttgaagccctccaaaagcaagtcacctagaaggagaggaagacaggtcagggtcaataagacatacttctaatttcaacatgagaccgagatctggtcaagggtctgggccatcataattcctttccctttatcaaggcttgaaccgtttaaagccctcacgcatcgtcacgtagacagcctcaccaaccactgccagccttacacagcggtgcaggttgtgcactgctccagtgactgcagctgatatccagccttggttctgcttgctaagccacaatccctggcacgaagttacatttacctggaggaagggatgcctttacctcaattgtctagaggcaccctgccttcagccttcagagacaaagctgtcagaagagttagatcaacctttactcttttttttttttttttttttttgagacggagtctcactctgtcgtccaggcaggagtgcagtggcgcgatctcggctcactgcaacctccgcctcccaggttcaagcgattctcctgcctcaacctcctgagtagctgggattacaggcgcccgccaccacgcccggctaaattttgtatttttagtagagatggggtttcaccatgttgaccacactagacttgaactcctgacctcaggtgatccacccaccttggcctctcaaagttctgggattacagacgtgagccaccgcacctggccttattcatgtatttataaaatttttatcaaattcaaacaggcacatgagttttaaaaatcaattactaccaaaggtttataatgaaaaatagcattctcctgtcacatcccttctccaactctaccttactccataatacctgcttttatctcttttagctgctttttatctggcagttaccactatctctctgtacaataggcttgctatatatactagcctattataatgtatataccattatgtattacatatcataggccaagggttccccaacccataggccatagaccagtaccggtccatgttaggaactgggccacacagcaggaggtgagcagcaggtgagcaagtgaagctttatccgctatttgcagctgctgcccatcgcttgcatcactgtctgagctccgcttcccataagatcagcagcagcattagattctcataggagcgcaaaccctatcgtgagctgcacatgtgccctccttataacactctaatgcctgataatctgtcactgtcccccatcaccccccgatgggactgcaggaaaacaagctcccaatgattctacattatggtgactagtataattatttcattgtatattacaatgtaataataaagtgcacagtaaatgtaatacacgtgaatcatccccacaccatccccccaaccctgcccgcccagtctgtggaaaacttttcttccaggaaaccagtcctcagtgccaaaagtaacaggtgcttttggcctattggaagaccagaggcaaagcacaatcgctgtaataggcgatttctggatatgtcaagtttagatagtatctagtgacttcctgctatggtaggcaaaaatgcagctttcttatactacctttcctttcctccagctatttttttttttttttttgagagggagtttcacctttgtccaggttggagtgcagtggtgcgatattggctgctcactgcaacctctgcctcccggattcaagcaattctcctgcctctcgagtagctgggattacaggcacccaccaccatgcccaggtaatttgttgtatttttagtagagacggggtttcatcatgttggctagtctagtcttgaacccctgacatcaggtgatccacccgcctcagcctcccaaagtgctgggattacaggtgtgagccaccgtgcccagccacccccagctatttttagttgaatcaatatataaggcttatatcacaggttggcaaatctggtcccctgttgtttttgtaaataaagttttattgaaacacagctgctctgatgtccttgtttatttctcatggctgctttctcactaggcaacagagttgagtagttgcaacagaggccatctggtccttaaagtctaaaacgtttactactgaccctttagcaaaaacagtttgccaactccctttttatgacattaattagatattctgtgtcaaactgtatcctatgattacatttcctttgttgttgttcagcttctcccccacccccaactttataattgcctttctttctcctgcaccatttgcttttattataccctccaatacatcaaggatcctcttccagatcaatctttaattaggatggattcggttatacttttggagagacgtcagcaagatatttttctttcaaaatcaaggtcttttatgggtcaagtcacttggaagctgcttgataaactcgaggttaaattgactgaaggcaccagttaactcaaacttttggattaacttgaaatgcctgattcaagtcacgaggattgaggtctttgccaagacttcattatcccgagtttggatgcatttagcaatatttggttctttctaaaagcctaacatctttccagttctatcatctagaatacaaacggcccctgggaatttagttctgagccctatacttgcccatttctggaagaccagaggcaaagcacaaaactggaacccaaggtaccaaacaaccaaactgttttcttgggtgccaaataaaaggaaaaggaatgtcaacatttttccctggcccattccacagggtcctgcactgtaactgctaatataccatgtttgctggtacataaaaaatccattcagcattccccctttaccaaaaattgctccacctcatagcctatgttcctgaaagccagccattaaggaaacttatttttattgtttgagacagagtctcactctatcgcctaggctggagtgcagtggtgcaatcttagctcactgcaaactccaccttctaggttcaagtgattctcctgcctcagcctcccaagtagctgggatgacaggcgccagccaccacacctggctaatttttgtatttttggggagacagggtttcactatcttggccgagctggtctcaaactcctgacctcaggtaatccgcccgcctctgcctccgaaagtgtgggattacaggcatgagccactttgccccaccctggaaatttaaataatggataatgccaccccctagtagctgaggtctacaatacactccgacacagcgaagttctgagctcacacagatccttttggtaactgtcttaaccaaaataactaaccttgggccacaaaagagatgggaagcaaagtctgtattgttcccatagaatttcagactcaaaacttattactaacatgtagactctactatgtacagatagtcactgatccattccttttttaagctatgcgatttgtatatatttttaagagttagtaaacagctgcaggtccagaactcataacttcctactggagtttggtatacagtgtattatatttacataaaaaaacttttccctacaacagaggtcagcaaacttctgcacactgcctgtttttgtaaataaagttttattgtaacacagtgatgcatctgcactcactgatttatgtgttgcctatgttcattggtttatgtgctgcctgtgctcattggtttatgtactgcctgtgctcattggtttatgtgttgcctgagctcactggtttatgtgttgcctgagctcactggtttatgtgttgcctgcactcattggtttatatattgcctgtggctgctcttgtattacaatggcagagttgaatagctgtgccagaagccacctggcctgcaaagcctgaagatttactatctggccttttacagaaaaagtcttgacccctgttctacaaagtcactggcaaaacatgtataatgaaaaatgcttagtcctgctgcccctgcaaattccttataaaaccagaatgcatcttttatatttgcaagttttataaattggcaagtaaggcaaatgtctttctccctttccttgaaggcgtagattgtgtctagttggacttgatgctctctggtctaatgagacatgaatcattaatgatctaatgtctaattggagttgatggctactatgtcacatagtaggtgctcagtaaatgagaatgactgaacacaagccacactcactcattgggaggagatgaagaactgttcatatgtcactcacagacatggtcctttctggcaggatctgagactgttttaatagccaatcccttaaccccggattctgatgaaagggaaggctcaagccatccaatcacatgtcattgctagtcacttacttctcatcttctccttggctccagcaatcatgtagtaaaagatgtggaatgtcctctcgtctctggcttggcgaattgcccgtgatttttctagcagatctggtttggagggagttagggattctggggatactgcgggtgttcctctggtcttccacctccatccctgtcacacccaattcacatgggatgactttccagttctacccctgggatcggtaatgtctaactttgaccattgcccctatggacaaatggaaccgctgggtgctgccagcagacttcagatgcaaaaaaaagggaggggaatagagtgaaaagaaaaagcataaaaaggctccaggaagaaggtaatggtaacgagatgttcccctaacagccatcaccagcaaatcttctttaaaatgagctgtcttcagacatgacagaatacaaataatgacaccatctatgatcctatgatttatgattcattcctgtgtgaaatgattgatataaattgtctcactgaagcctcacaaagtatgctaggaaataagtgcaactattatcggtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggagagggcagctgggaggctgggctactgtactgggtggatttccacagcactaagcatgatggtgcgggatgatggggctagatcagcagaccttgtcttcttcaagtcctaaagccagctagcagtgcccgggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggcagtgtgtgatcttggctcactgcaacctctgcctcccggatccaagcaattctcctgcctcagcctcctgagtagctgggactacaggtgcatgccaccacgcctggataatttttgtatttttagtagagacagggtttcaccatattggccaggtggtctcgaactcctgacctcaagtggtctgcccgcctcggcctcccaaagtgctggaattacaggcgtgaaccaccgtgcctggctgagatgtgtgtttctaaagagctcccaagtgatgctgatgctgctggtttggaaacatactttgagaaccactgatctaaaaggaaggctgaggccagaaggacggggctatgcctggggctcgctctaaacacaggaaatgaattgctgagaggtgtgtgcagggctgcaggacaagagggccctggctctggacttgaccgaagcctgacagccctcctagctgcaggatgggaatcctggctggtttgggcagattaaagtagaaacgtagaaaacattgagttaacgcaatagccaccacctatgagatgctcactttgggcccagtaccgtaccaagggctgtgcatattattatgcatattatttcatttaacccctgcaccagctccagaaactaggtgcaatcacccccattttaccgaggcaaaactgaggcccagagagcttcagtgattttcccaaatccccacagcttagacaagtacagtggagaggaagctactccacaacccaccctcttatccagggcacataacgtggaaaaatgggaccactaggtgctgctagaggacctcaggtgcagaaagaagctaagtcaggcccccaggtcctatacattgccaagcacgtgttccacaggaagcctgagccctagggccgcctgcaaagctcctgaggctgatcagtcactgaactctagacctggttgttcccccacgtccagaaatttctaacttggctccacttcaccgctcaggttcatgaaagagatgctctacttgttccttgcgataccagcattcttctgggtaaactctgttttcatcaatttcctacctaagaagtggagccgatcacagaccaactctctaagaggacgacaggtccagaatttggcctcggacaatggctgaataaggatgaagtgaagatcatacgatagacactacgtagccagcccttactctgcacctcgcatggtgcctagagctttatatgagttcattcactctattctcacatttctatgaggcaggtaccattcattatcatccccattttgctgatgaggcacagagaggtggagtaaccagcccaaggtcactcagctaagggacagatcatttgagcatcacatgcagcctaggctgcttgtttagggttcaaaccaggggtccggtccacacatgtataaccactgcaccacaatgcctgctgttaaggggagatttgttctggaagaaacctaagaggctggaaagatagaggtggctcttggactctcccagcctctgggcaggagattggtagggggcaggggtacccatttggcccaggctcagggaaaggatacaggtctcaatgttggctcccacgatgtaacccgtgacgtcgaagttgatgcggatgaatttgccctgccaacaggaaaacacagttcaggctttgctgcccaacttcagccgttaaccccatgctgtgggcaagcaggaggcagatggtacagaggatgggaggtggggcggggagattcttgcgaacactcagaaccccacaggtcaagttgtcaggcggaaccaacatctgctgagctgaaaccaccccaggcctgacagcaacagaacgtgtaaaacatgttcacagatcaatttcattcggcttttgcaatgaccgtagtccatcatggctatccctatttaaaaaaacttatttatttattagagacaaggttttgctctgtcagcgagggctggagtgcagtggtgcaatcacagctcactgtaaccttgaactcctgggctcaagcaatccccttttccccatgacctcaccctcccaagcagctaggactacaggcatgcaccaccatatctggctaatttttaaatttttttttgtagagataggatctcactgtgttgtccaggttggcctcagactgctgcactcaagcaatcctcccacctcagcctcccaaagtgctgggattacaggagtaaactaccacacccagcccactatccccattttaaagctgggaaaactaaggctaaaagagatcaagtgacttgtccaacgtgacgttgctcctgagaggtagggccctaagcagaaagaaggtttttccatattcaggggctagagggctccctccccagaccccaccctgctccaaaacatccacatcatccaactatggattaaaccttttctgtgggacaggtgagtatgcattggccacactgcccaagcaggccctgtgtaggatgtcctttaggcaggaatggctcatgttcctggccctagaggctcaacaagtatctccaaagatggccctatctacctgcctcagctaagccatgaaaccaaggatggaacccaatcctccatctgttggcatgaacccttttcctgtttcctcaacaggtgagacaggatttcatccttttcccccatcatgacataacatggtgggaagtgttggcgtgtgtggacacaatcccctaggcttgctcagtccttgacaaaaccttcaaactttccccattgggaaacatgcagtagagtgatttgggatgaccatatcccagatggagccagggagagccggctggtcacaggcaaggcccaggcaccttcttcactctccttcccaagatggcagggacgccagtgagtggaggatgtttttagggatttgtcttgcacgtgcttccatttatgacaggctagaaacattgcacagaattggaacatgcaaacgcagtgcttctcagtggaggcggcacatctgctatggagattttggaaatcggtggaagccattatttggcttgtcacatgttgggggggggccgctgttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacgcttttttttttttttttttttttttgagacaagagcctcactctgtcgcccaggttggagtgcagtggtgtgactttggctcactgcaacctccatctccccgggttcaaggaattctcccacctcagcctcccgagtagctgggaatacaggcatgtgtcactgcgcccagctaatttttgtatttttagtagagacagggtttcaccatgttagccaggctggtctcaaactcctgacctcaggtgatcttcccaactcagcctcccaaggtgctgggtttacaggtgtgagccactctgtgcctggtctagatttttatgcttttaaatgaaagcattaacaagtgtttaaaatgttgttctaatacaagaatatcccatctgtgtgactctagagaagattgttctttggttcagcgcttcactgagagtcagttgccattctggaaaatcccatgccaacatcatcagtgcctgaacttgacccttttccttgtatttgtagctgtcgccgtggatagacctaagtgtctgtctcttactgtgtcttctgttggtgtggcctggcccgagcattgatatgctgaaatgcactttatttatttatttttgtagagatggggtttccccatgttgcccaggctggtctcaaactcttgagctcaagtgatctgcccgcctcagtctcccaaagtactgggactacgggcatgagccacctcgcctggcctgaaatgcacactttcattatgaattgtcttatgttatttcttcttcatattccagttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagagacccccttctcctggaatgcagaggcaatttttccttcatcttttctcactaaaatatctttctgaccctcctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtgcctaccagagtaattgtacacagtaggtacttactaagtatttcttggaggaggtgtgtgcctggtacacagttggcactcaattcatgttttgttacataaaatggtatcggatataagggtctagcccataccaggtgctcaatacctaattttttaaattttattttaataatagagatgggatctcgctttgttgcccaggctggtctagaacccctgggctcaagtgatcctcccacctcagcctcccaaagtgctgggattacaggtgtgagccaccgcaccaggccaatcaatatttgttgagtgaatagtgaataaattaatgaatgaatgagagagtgagaggcaggagcccttgcaagattgtgagatacagcccatctctccagggtcagatgcccctcccacctctgcacgcaaacactctgcagccccaggcaggagatgacaccaaagcttttctggaaaatccatgtggctttgctacttacgaatcgtgaggagttgtcgttcttcactgttttggcgttgccgaaagcctccagaatcgggtttgcttgtagaagctgcttttccagctctccctaaaattcattcacatctagttattggagaaagcaacctaggtcctgacagttctaccttggatggatgttgtcacaaaactctgcccttaacccacaggttctctcctatctcctacctcctcttagaccctgatgctaatgttcagatttacaggaggatttcagaagagaagcaactgtctgagctctctaatagctaggacatctgctccctaggaaggtcacttttttcaagaccagggcctgctcatctgtgcaacatcactgccactcaaagccactgccttgcacaatgtcggtgatgtcatttacatcatgatgaatggtgccccccggagttgtgcagtgcaccacctgtcccactgtacatggcagtcgtgctgctgttcatgtttaacaagcagccttcttcaagttaaaccactacaagcctccttctaattattttagtgcaattttttttaagttgcaattttttctttctcaggactggttttctgaagtcttctacagcagacaagtaaggaatgcacaaaacccaccaggaatcctcttagcggactgcggaataaagcttcaaagcaggttgcctgagctccattcattgggttaaaggaagctgagactgtacacagcccaccggccccctctgccgggatgcctttgcacaaacgcggtcacgtgattaatcatggcaggaaagggccaatgtggtaagttaagctgggaaagcaaacgagctgctcttggcctagccctaaaacatggcggctgcagttgggccccgaggcctccaggccctggattctgggagtttttctccttgtcctcccctcctgctttcccttccttatttttccaggcatcagggctgggctggacaggagccgggaaagtgtctagaggggacaaggatgggcatggcttcctcctcattcctccgcatgctaggaaggcatcagggtacctggtctacaggacaaagcaggaagctgctatttgtttctgttttgatttgtccacacatcctcctttttgtagctcccagagaaagatgaagcaaaagcctcatccgcatacaaatctcagctacaagtggaatcaccacagctgagactggtggaaatttacaaggagcaccacgggcatttctttgttggtgggaagacgactaaaggaatcacttttgttcacataaacttggggtctccatgctctctgaaaaaggctccctttctagaatggggattctggcaggtaaggttgaaaagtcttggcaagagagctttaaatcgggggacctggttcaaaccctcaattttatagatgatgaaaccatagccccgaggagttaactgactcggccaaggtcacacaaaagcagatcccaaataagaactgtaattctccttctgatctgcaacacagtcacccagggtctaactaagatggattgaatgatcttttcgggagccaaggaagacacctgtgggtttcttctaggctgggacccacacatcagccccccaagctctgtgttagagatgagtttacatatgcacaggtccaagcaggaccaggttatgcgttgcgtagctggggccttaccgcgccaccaaagctagtgcatcgcgacctccaagactgtttctggaggcttgagtcaagcaaccagcatgcaagagacagacacgcactgcacacgcatgcacagggacacactggtgcaccagggacagggctgagggaagacacttagggatgatggcagggagagaagagggaggcatgccacagctgtgccatcgactgtccatcgagccagggaagctttggggcctgacagtcctaaaacactcagccagatgggacagacatctctgtctaggttgttccagtcaagggtaccaggagcggatgctttgaagggtgcaggggttcattctgaaccggagaaatccatttcaggctggagcgcaaccctggggactccaataggcgtcccgtgggtggtaaatgcacccccacacccttccctggcatcagacacccacaggatggtattttggtgcatttactgatttaagttgtgaaactctagggcctaccccatttctaccaccagctacgggactcggtgggtgcaagaggatcatgcagatctaagttcactccgtgcctcccctacacaccaggaaaacactctcagttactcacgtaggcaaaagatgggccttgctgtggttgaacaacacagtataaaacaaatgtcagcgttatttccatcacatggacatcaggggctggagaatatatgactttgatccccccaaacagcctggagtctcccagacagactggtcagctccttttccttgatactgtttcttttctctctgtttagctgcaggaatacgatcacagctcactgcagtctcaacctactgggctcaggcaatcctcctgcctcagcctcccaagtagctaagactacaggcatgcacaccaggcccagctaattctcttgatttttttttttttttttttttggtacagacagggtctcactatgtcacccaggctggtcctgaactcctgggctcagaccatcctcccaccttggcctcccaaaacacagattacaggcatgagcccccatgctcagccattccctcctttttctaatttcttagagatccagacatttcaaaggttttcataattactggggccacattaggctccttaaaacagtatccagtgagacaatgtctgagatgtgtttacgcatgcagccaaaacaagcagcacatagtaggcccttgataacgatgagttgttagaaagtattatctcctgtgtttactctttagggaaagggaaggcagtggaaactgtgtttaaactgccacacagcctctggggccattgttcccactcactatggctggaaaccaacttgccagagacaattctaggatgctgaatcttgagtttcctgcatttgtttggagaaggaaagttctccaaagccacgaccagcgcccatcctagatctccaagggcctccagacaagccggccatggtggctgccccagagtcccctctgaggacgcaaagtgacatctggaatggcgaacactggagacaccccatgccgtggtcagatctccatcctaccatcttcccacccacaaacctgcagacggaggcaccggccagtcctagcggccctaccacgtgccccctcctgtgggatagatggggcagggctgacacacgaggaggaagagaaggatgggccctagaggtgatgactctagaaacctgctcttcttttcctcccaagctcttagtcataccgtgtcatcatctgtttatttgagggattctttgacaactacatgctcttccacaggtctggaagctcagagaagagaataacagcatctctcagacttatccccaggtccccaccccaagtggttcctggcatacagtaggtgctcaatccacagttactgaatggcattgcactgaagcccacgggccgagtgataccagcatctccatcccagggacagggggacacgtggaggaatccgggaacccaaaaggtaccttaacccctgggacgttacagagattcatgaaaggagtgcttctcaatcaagggcaactgtcccaccccagggaacatctgacaatgtctagagatatttttggttgtcacaactggagggaagggggctgtcggcatctggcgggtcgaggccagggatgttgtgaaacattctacgagccacagggaagcccctccaaggaagagttatctggtccaaaatgacatcagtgccaccactgagaagccccgacgtggaggaagatctcgctatggaaggaaagggcttattctcatttcacaaaacgggcccccttctggagggatgcttctagctgagccaagaaatcacccacactcaacaggcctgctcgccaaaaagacggtccctctttgagtcttcaggggaggggtagtcagatggggcctgagttcttgcaatgatgttctgtttgtatctcggttgggctgcaagctggagaccggttggctaaatcatggcctctgattgggaactgccactcaccgtgatacttgtgtctttcttgcccttgtgggaggaggccaccacggccaggtactgaatgaccttcttggtgttttcggttttcccggctccagactcgcctctgaaagacacgggaacatcatctatgcacacgttccatggtgacctttccgcagttccatgagccaggcaggacaataatgatcatcaccaccatttcccagagggtgaaacagaggctcccagaggggaagtaacttgcccaaggccacatctctggtagtgagcggaactgggtccccagcctaggtccaatgcccaatctattccttccaagaggacatagaaaagaattcagatacaaagagtgaaaaggtgggccggatgtggtggctcatgcctgtgatcccagcacttggggaggctgaggtgggaggatcatttgagcccaggagtgtgagaccagctcagcaacacagagagacactgcctctagaaaaagatttaaaaattagccaggcatggtggcacatgcctgtagtcccagctatttgggaagttgaggcaggaggatcactcgagtccaggagttcaagaccagcctgagcaacacagcacaaccctgactctataaaaaataagaaaaattaaccaggcttggtggtgcatgcctgtagtcccagctactcaggaggctgaggtgggaggatggcttgagcccaggagtttgaggccacagtgagccatgatcacaccactgcactccagcctgggtgacagagcaagacctcatctctaaaaaaatagagtgaacaagaaaaccttagttttcttacataggtccaaacaggtttatttggaattatctacttttttttttttttttttttgagatggagtctcactctgtccccaggctggagtacagtggcacaatttcagctcactgcaagctccacctccctggttctcctgcctcagcctcccaagtagctgggactacaggcacccaccagcacactcggctaattttttgtatttttagtagagacggggtttcaccatgttagccaggatggtctcgatctcctgacctcgtgatccgcctgcagacatcattagcattgctagaaatggaaagaccaggcacaaggcagccttcaagaaaggatgtaagtgcctctggagtaccaggacctaaagtttaagaagctcccttatggaaagaaaaatttaccaaaaaaccggttatcccattggtcactgggcagatgcaagcccctttatcctctgaggaatcccaccccatgtatcaggaagctggctgatgatctcagccaagtatctaagaataaacccagttgaagtaattcacactaaagtgtaaatgactgatatgtttagatcagcacgacatggtttgtcgtatcaaaaaagtatgtcctcctggaatatgaaggtagatcttttttttttttttttttaccaagatggctttcgtgcactagctgcctgttttggccaccagaaatcatcacaatggaaccgctccatccagatactgcctctatgttccaccactcctagtgaaagataaggacagtgccttgaccaaaacttcacttgtttatcgtcttcttctatttttcagtttacttttgttttttgtgtttcctttctttgccttatctcttttattttctgagctcacttaatactctaaaatataagagagttttttttttaagttgaaaaaagaatttgttcaccccgaggtcagcccaaggttctctgtgctgaaccagtgccaccaaagctagtacagtctctgctcttcttcctaattaggaaataaagaaattaattttctctgccaaaggcccattaataacttggctcatggcttaaaaaagaaatagaagaaaagaaaaaagaaagagaaagaaaaaaaaagtgccccaaattgctgtgcctaatcctacaggtcccactgtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatatgtgtgtgtgtgtgtgtgtgtgtgtgtgtgtgtgtgtgtgtgtaaaagaggagaactggccaggtgcagcagagaactggccacgtttataatagcagctactcaggaggctgagttgggaggatgccttgaggccaggagtttgagagaagcctgggcaacatagcaagatcccatctcttaagacagagaagaattggcgtttgtcattggggggatatagggggaagggtccctttgctaaatgctctacatgaattatttcctttatcctcttcctgcttccatgttattatagaaggaagagtcttgcccagagtgggtaagcaattttccctaggtcacacagcaaagaagggatacagtcagaatggaaagtcaggtctctgattctaatgcagtcagaattccttttactacatttcaccaagttgttccatgacacaggcccaaccctctagggacttgctttctaaggccagaagaagggcaggggaaggggaattgatatttgttgaaggcctgcacagtactaggctttgggctcacagatcttttcatttactctacccagcaatctaatgagagagttattaattatccccatcacccatccggggaaactgaggcaaagagaggtttgaagtaaattgctccagcccacaattgctcctgctttcacacagataggaaatggaggagaagcaggatttgaacgtaggtccacttgacaccagggcccatgttctgcctcctacccttttattttaacaaatcagcaaagagaaaagacagagtgaagtcccagccccactccactggaattctgccatatattccaggaggctttacttgccccaatcaatgaaccaagccactcagtcattcacacctaagtatgaattacttcaatcaggctaacgtcagaaccttgcttgacttcattctaaagtgaaggggttggattctgattaaagcaagagaaaggagagaaatttttggatgtaggaaaccacttgcgtaggtggtcatgaacctattcagatccaagacaagaatcaggacagcagtgtgcacaaacaacatgtgtggatcacactcttcatgctgacaaaccagtgctcctagactgctgctgctcacttctcctttcccacaatagttccttcctttccaccctggccttgaacctctctcacctcctcccttttacaacaaagacatcaccgggtgtggtggctcacgcctgtcatcccggtactttgggaggctgaggcgggtggatcacttgaggtcaggagttcaagaccagcctggccaacatggtgaaaccctgtctctactaaaaatacaaaaagtagctgggcatggtggtgggtgcctgtagtcccagctacttggggagctgaggcaggagaatcccttgaacccaggaggcggagattacagtgagctgagctcgtgccactgcactccagcctgggcaatagaatgagactccatctcaaaaaacaaacaaacaaacaaacaaacagacagacaaaaaaaaaaacaaagacatcaatgtgccctatccgtggctatggtctcccactttgcctgggatggggagtgggacataaactctgggcatctaccccttcccatgttgctgctgggctccactgtttccaagttctgttgagaaaaataaattgccctgggaggttctgccaaagaaaacatcccaagctccaggctcgtgggcgtctgaaggttgatgtgcttagagctggttctagaaacattcatagcttggcttttctgacccctgacctctaggggtgaagatgccttcctggtctgagcaccctaaactcctttcttatttcttggggaatttggtactgagctccctcttcccggagaaggaccagactcatgaccacgttatggcctcctggccttgtaactaccccagtgccaagtccttttaatcagtccagccccagcagctgggaagaaccacccaatggccacttaatcccccagccaggctggcttcatgagtgtgacctgtaccgtctcacagggaccaccctgtgcttcatactctaatgttgccatctggaaattcttcctaattctttataaacgctctgcattttttttcttttctttttttttttttttttttgagactgactcttgctctattgcccaggctggagtgcagtgtgtgatggcggctcactgcaacctctacctcccaggttcaagtgattctcctgcctcaacctcccaagtagctggaactacaggtgcccgccactatgcctgggtaatttttatatttttagtagagatgggatttcaccatgttggcgaggctggcctcgaactcctgacctcatgtgatctgcccgcctcagcctcccaaagtgctgggattccaggtgtgagtcactgcactcagccagcattttcattttgcaaaattctacaaattctgcagctggtcctggctcccagggtcgaatattgccaagtccattgcagcctgtggtttgccactggtaggaaagccaaattgtctctgatgaacctcacagctattcagtccctggtctttatgtgactggcaaagcaccctggcattttgtactgtacaactcctacacgtcctgcaaaaccccaggcagaagcaacgcctctctcccctatagcatcaattggcagaatagcataatgggctccaggaccaggttgctcaagttcaaatccctcctctgccagttacctgggtgaccttaggcaagtcatttagcctctccatacctcagtttctttaccccattataaaatgggtataataaaaacacttaccttgtatgatttttttttttttttttttgagacaagatctcactctgtggcccaggctggagtgcagtgatgcaatcatagctcactgcagctgagaattcctaggctcaagtgatactcctgccccaatctcccaggtagctgggactacaggtgcacaccaccacagctggctgatttttaaattttctgtagagacaggggtctcgctatgttgctcaagctggtctcgaactcctggtctcaagtgatctctagcctcagcctcccaaagtgctgggactacaggcatgagccaccatgcctgaccttttatatgattcttatgaggattaaatgagtgaacatttatataaaatgcttagaacaatgcctggtatgccaaaatgttagttattattacttttgttttttgagacagagttttgcttcttgctcaggccggagtgcagtggcacaatcttgactcactgcaatctcgaactcctgggttcaagtgaccctcccacctcagcctcctgagtagctgggatgacaggcatgtgccactacacctagctaattttttgattttgtggggtctcgctaagttgcccaggatagtcttgaactccaggcctcaggcaatcctcctgcctcggccccctaaagtgttgggattacaggtgtgagccactgtgcccacctattattacttttataaccactgcttccacagaagttatatattgtttgtataatgattttcagcattcatcctatcattacaatataaataatattcacattttcccactgtttaagctaggagttagcaaactctttttgtaaaaggtcagacagtaaatattttagactttgagggtcacgcattctttgtcacatctgctcagctctccactgcagcacaaaagcaaatacgtaaacaagtgggtgcggctgtgtttcaataaaactttatctggaacagacagacaagggcctgatttgacccactggttaaactttgtccttccttggcttgagtcccttagcacgttctcatccatttcatttatttattttattgttatatatattttttgagatggggtctcactgtgtcacccaggctgaagtgcagtggtgcagtcttggctcagtgccaactttctgcctcccaggctcagtgaaccgagatcctcctgcctcatcctcctaagtagctgggactacaggcacatgccatcacgctcagctaatttttgtttttgtagagagggggtttggccatgttggccaggctggtcttgaactcctgagctcaagcgatcagcctgccttggcctcccgaagtgctaggattacaggcatgagccaccatgcccagcctgtcatccattttagacgaaagtttaaactcctccccagggcctggaagcacccccttacctctctctaattttatgtgaaaccaccctcctcctcttactttagccccctgatcacacagctctatctccagccaggcccatggcctctaattaaactgattatactggatggattacatgctagacaaaatacaactcaggcctaaaaattacatttattcagctttcagtttccttcctttcttgtcttccttcccttcctttccttccttcctgtctctgggtcttgctctgttgcccaggctgaggtgcagtggtgccatcatagctcacttagcctctaactcccaagctcaagtgatcctccctccccaacctcctgagtagctgggactacaggcatgcaccatcccacctagctaatttttaaattttttgtagtaatggggtcttactgtgttcctcagtttggtctcaaacttctggcttccagccaccctcccgcctcggcctctcaaggccctgagtttccaggcataagccaccacacccagccaattttcagtttcttttcttttcttttttttttttttttttttttgagacagagtctcgctctgtcacccaggctggagtgcactggcgtgatctcagctcactgcaagctccgccccccaggttcacgccattctcctgcctcagcctcctgaatagctgggactacaggcacccgccaccatgcccggctaatttttttgtattttttttagtagagatggggtttcaccgtgttagccaggatggtctcgaactcctgacctcgtgatccacccgcctcggcctcccaaagtgctgggattacaggcgtgagccacggtgcgtggccaattttcagtttcttttcttttcttttttttttttttttgagacagagtctcgctctgtcacccaggctggagtgcagtggtgcgatctctgctaactgcaagccccgccccccaggttcacaccattctcctgcctcagcctcctgaatagctgggactacaggcacccgccaccatgcccagctaatttttttgtatttttttagtagagatggggtttcaccgtgttagccaggatggtctcgaactcctgacctcgtgatccgcccgcctcggcctcccaaagtgctgggattacaggcctgagccacagtgcgcggccaattttcagtttcttaactgcataaccaaacagttggctccagcctggcttctcttaagcaccaactacgcgtaaaagctcagccctgctgtcaacttgtaggtccttcaagtcactttggctgaatttcacaacaagcaaaataaaattgaatacagagactgaagatgttggtggttctgggctgactggatgcatttgcaaataaaagtctgatcgttttgggatttccttcctaacaatggctaaggcctccttctccagcactggctgtgtgtgggcagtgtgccaagtccttgctaacgctgcattccaggagatggagatacacaatagccaagtaaacaaataatcaagatagttcgtggtggagatatcattgctacatctgggtgatgtgactgagaagatcgaggggaagggaggagaggggaggctgtggatggggaagccagggagttgctgagccttgaaagttacaagagagccctgtgggaaggatggagggaagggtgggccaggcagggcaaacagtatggacagaggtccaagggagggaaatgctgggcccaggtatgagacagaatggctcccagcatggctggagggccacaacagaggaggacagcaggaagtgaagagggaagagcagatcacactcagtcttccaagtcacagtaaggaatctgagttttattctcatgggtgcaggaaaccatttcacgaggggaacgggactttagaaccagtgtggggagaatcagaactgcaggatgggctgggcgaagtggctcatgcctgtaatcccagcactttgggaggctgactgaggtgggtggatcacctgagatcaggagtttgagaccaggctggccaacatggagaaaacccatctctattaacaatacaaaaattagctgggcatgatggcataatactcgggaagctgaggcaggagaattgcttgaacccaggaggcgggggttgcagtgagccaagatcgcaccactgcactccagcctgggcaacagagtgagactctgtctcaacaaaaaaatcaacaacaacaacaaactgcaggatgggccaggctcagcggctcatgcctgtaatcccagcacttgggaggccgaggctccccgggtcacctgaggtcaggagttcgagaccagcctgaccaacatgacaaaaccctgtctctactaaaaatacaaaattagccaggcatggtggtacatgcctgttatcccagctactcgggaggctgaggcaggagaatcacttgaacctgggaggtggaggttgctgtgagccaagatcacgccattgcactctagcctgggcaatgagagcaaaactccatctcaaaaacaaacaaacaaacaaacaaacaaactgcaagatggatactggattgcaggaaggatttttaaaaaatagtgagcactttcactacaatagcagctgatccttacaaagtgctcaccatggggcagtggcctgtttctcagttcttcacatgtagtgactcatttcatccttccaacaacccaatggggtgcttattgttcccattttacagatggggaaactgaggctcagagaagtgaactgacttatttcctggagcatacaactaactagacgatgatggggccagaattcaaacccaaggggttaggttctggaatccacactttatgacagcatgctaatgaatatttattcaatgaataatgagtgaatattcttataatgtatatttattaaaggaaggaagcaagcaagcaatgggagcagggagcttaagagactgctacagaggccctggtgagaggtgacgggaccctgaactaggaagaggcggtggagtcagaggaatggacagagatgagaaatatttcagcatcataccgtccaaggcaggaaccgctatctaaattaactaaaatcttaaaaattcagttctgcaatatacttgccactttttaagagctcaattaagtgaacttttaagtgaactttgtgctcatcacaaagttcttttggatagcaccgttttagatgaaacagcacctgctgatggcatgggtgctggaaatgagagcagggtggcctcttcttcatcttcacagcctctccataagctcagctcagagaggtcaagtgacccgtgcatagctacatagctaggaagccatctgaaagtcctactctttcctgcacctctctgttaccacacttaattcattcactcaacagagggcagttgagctacactattttggttcctggggagatgacatgtggctcacacatgggtttggctcctaggggatcaaatgcctctgtggctagctgaaaaacagcccccacaagaatgtccatggcctatcctcagaatctgtgaatatgtttgcttgagatgaggagactgtcttggatcatctaggtggggctaatataaccacaaaggtactgggccttataagagagaggtagggggaccagagaaagagatttgaagataccatgctgcaggatttaaagatggaggaagagaccatgagccaaggaatgcaggtgacccctagaagccagaaaactaggaaaccaagtcggcaggttgttttagcatttatatcctcatagctaggtagcattatatctctagatccagactattcattgtcaaacatcaaatgtgtacatcctaccatggaatatgagaattcagttcccatctaatcctcttccctttccccacagagccaagtccatcacagggagttattctggttagataaatactccaaacttgcacagctgggctccttagtccaatgtgattacttctccttccatcccaacttttgttttttcctggagtttataattgcctttgttttattgtttccaggttttctatctatatcaaccccaaacttattaattgtttcaatcttctctcaatacagttcattgccatcctaccatccatcaccatctgaaattctaattactagtttttaattgtccttccagataatttcatgcaaataggaaacatatgcacgtccatgcaatcctgctctttttaaagacacacacggttacattatgcatatgctggtttgcccctgtgttttccactcaacggtattatctataaagagcgttctctctcagcataaatagatcagcctcactctttgtagtggctacctggaaatgctatattttatttaaataacctctgttgattatagctttagttgcttccagaccttcaaatatatatatatataaatataaatatattaaatataatacatattatatattatgtaaatatatatatgcacagtctatcctcattatttatatattctatattttcaaattcaccgacctgctgaaagttatttgtaaccccaaaatcaatattcatggcacttttgtagtcatttgtgaacatgtgcagagtaaggaaaattcgattcccccaatgcacacgttcccagctcaggttgaacaggggaatgctctaccttctagtttcaactctcatactgtaaacaagtgtcctttctgtagtgtatttagtgccacctttttttgtatttttgtggctttttgttagttattttgcagtttaaaatgtcccctcagatgtgctcccttcggcagcacacatacaaaaatgtccccagcatagtgctcaagtgttggctcatgtttccaagcacaataaagttgtgatacccattatgtaataaatacacatcagataaacttcatccaggcatcagccacagagctgctggctgtgagttcaatgtcaatgaatcaacaatatatattaatatatgttacttgcatataaatacaatagtgaaaactctctcaatgattctaaaattgagttactatcttctgcctatgtacctaggtcttcaaagaaacagtgataccaatcaccaaatatggcactgatgtgtttgtggcttgataaatgtgaaatactaaagtgacagtttaacatcttccctatcaacacagatggctgttatgcaattagataagattctgcatataaaatctttagttcaagtcctggcacagagtacatgttcaataaatgctagttttttagaaggaggagaggtatggaaccaaatgatagcaggtgtcattaagagtttaagtttgcctgcctccgcagaagaccatatatcacaaatgtttagtgagcatctacatggtgccaggtataaagagaggcacttggaaccatgaacaaatcaaagatctctgcactcatggatcttttctttcataggttggatctcgactacagattaaaaaaaaaaaaaaacaaaaaaaaaacagaagaaaaagcagttccacttacgtgcatagaatggactggtcctcccgatctgcaaacagaaagaagaaaaaagagccatgaattaaaatgagctctgagctaagggtctggacttggctcctcccagggccctcccattctaaagcttctccatgctggcctcattggaagtgacaacaggtcagctgggctcattgcccaggctacaggggccacgaccaaagccaaaagggcagccccaaagtcccagaggcagccccagaaagatgctggagcctgactgatccaggagtcattagcatccagccacatcagctctggaggtgtcccgggaggcccaccccacccagattaggttagggaccaaacgcagatgttggatctatacagattggggtcccccttagccacttctccgctctgtggccttgggcaaatattcttaaactccatgcctcagttccttcatctgtaatatagtattgtgcacatttgtgtttttttgtaaatccagcatccatttcctcttcttccagaagcatcctgtggtccttgaggtttcccccatcacccctaccgtcatgtacagtcttagtgggactgcctcataagtaccttcaacaaagaggtaagaatgtgttccaggctgcattggtcagactctctggcctaaaactccaagctcagtcaaggacagggaagcacagcaggtggacagagccctgaggcagacttcctttctgcccctgggcccaagcagcccagtttctgtcatttacctagcctgattcctagtgttcccactgcaactgtgagctcctccatactcccctacaaatccctttcctctactagatgacagagtcagtctctcttgtttaccaccagagaaacccaaaagatacagaggtcatcaaagaactagatgtgattaagcagacattatccatcaccttctactcttaaagaggcctctgaggtggagccaggctctgaagacccatttccttcccaaagagagatctgagaacagttaccaatacgttcaatggtcacctaacaatgtagaaatcccagcatcatatctgctggtagacaatgccacagtggcaagcatttcttaaatccactccctggcttcagtcctactagttcagtgctcagctctcacaagcttcatttcatcaaaaatctcctaggcttggttttacattgtatctctagtactggcacatagatggtaggtgctgaattatgcttgttagatggatggattgagggatggatgagtagatggatgggaagatgagtggacggaaggaaggaagaaaggaaggaagggtagatgggtgaatggaagggtgggtagatgggtaggtagatggatgggtgggtgggtggatgaatagacagatggacgggagggtggataagcagatgagtaggtgagtaggtgggtgggtggatgggcagatgggtgggaaaatggatggatagatgagtagatggatgggaggatggaagaagaggtggatgggcaagtgagtggaaggaaggaagaaaggaaagaaggaaggaagaaaggatgggtggatggaagaatggatggataggtaaatggacgggaggataaatggatgggaggctgggtgaataggcagacagatggctggatggaaggatggatagatggacaggtagagagacaggaagacaaatggatgagtgggtgggtgggtaggtggacgaatagatggatggaaagaaggaaggatggatggatagataggaagaaagaaagaagaaaggagggaagggtgtgtagatgggtagatgggtgggtatatagctggttggacggatggttggacggaggagggaaggatgagtgagtggatgagagagtggatgggtgggtgaatgggagggaggacagagtgtataggccggtaaatgagttggatggatggatggatggatggatggatggatggatggatggatgggaatatgaatgggaggatggatgggactgaagaaggcaaggtgaaagagatgactctttcttccatctgtaatcttaagagagaactgattggatgtgggcacgttcctcagattctatgcccaactccaatcagttctctctctcttccctcggattatagatggatgtttgggtggcctggttgaacgaaatcctcaagacaaaaggcctaaagactagtcagctctggggtttcaattctggtgtgtttatataatggcacatttaaaaataggcaggccgggcgcagtggctcatgcctgtaatctcaccactttgggaggccaaggagggtggatcacttgagttcaggagttccagaccagcctggctaacatggtgaaaccccatctccactaaaaatacaaaaattagttgggtgtcatggcacacgcttgtaatcccagctactcagaaggctgaggcaggaaaattgcttgaactcaggaggcggacgttgcagtgagccgagatcgtgccactgcatgccaggctgggcaacagagcaagactctgtttcaaaaacaaataagatataaatacataaataaaataggcagccattgaaaagaaccaggcagagctttgtggatggacacagaaaaatatccaaaatatattaagctaaaaataaaagatgaggtagcatagtgttataccttttgtgttttaaaaagacagatatataggtaggatgcagtggttcatgcctgtaatctcaacactttgggaggctgagatgggaggatcacttgaggccaggagttccagaccagcctggacaacatagcaagacccagtctctacaaaaaaaaatttttttttaattagctatgtgtgatagacataccccttgtcccagctacttgggaggctgagacagtaggatcccttgagccaaggagttcaaggttgcagtgagctgtgattacaccactgcactccagcctgggcaatggagtgagaccctatctctaaaaacagacctgggatgggtgcggtggctcacacttgtaatcccagcacttcggaaggctgaggcgggcagatcacttgaggtcaggagttcaagaccagcctggccaacatggtgaaacgctgtctctactaaaaatacaaaaattagctgggcatggtagcatgcacctgtaatccaaggtactccggaggctgaggcaggagaatcacttcaacccaggaggtggaggttgcagtgaggtgagatcatgccactacactccagcctgggcaacagagcgagactccaaaaacaaaacaaaacaaacaaaaaaaaccaacaaacaggcctgagcctgaagtattgagaaaagggacaggaggaagacctactttcacccattctacttctatcctggttatgtttgtgctatgaacacatacaatcttttcctcatcccaccaaaaatggtcaatagaaaaagagtcggtattgttctttatgaaaccatcatgaccacaaagctaaaaaaagacagaaaagaaagagccaccgcattaggatcccactaacagctccgatctcccgagcactcactgcactgcaggcgtatgctgaacttctgtgttgaagtgacccactgaattctctcagcagctcctggggtgggcactggcattgcctccattttacaaataaggagagtgaggttcagaagtgaggcaacttgcccaaggtcactagggtgggttgaactgtgactcccaaaagctatgttcactcagaacctcagactgcgatgttattgactaaccaattgattgagatggggtctcactttgtcgcccaggtgggtgtacagtggcgtgatctcagctcactgcaacctcaacctcccaggctcaagcaatcctccctcttcggcctcccctgtagctgggactataggcacatgccagcatgcccggctaatttttgtattttttgtagagattgggtcttgctatgttgcccaggctggtttcacactcttgggctcaagtgacccacctgcctcagcctcccaaagtgctgggattacaggcgtgagccactgtatcccacctgtgattttatttagaataagggtcttgcagatgtaattaagggaaggatgttgagatgaggtcatcctggcttggagtgagacctaaatcaatggtgtccctatttataagagaaaggaggccgggcgtggtggctcacacctgtaatcccagcacgtgggtggatcacctgaggtcaggagttcgagaccagcctgggcaacatggtgaaacccatctctactaaaaatacaaaaaattagccaggcatggcggcaggcacctgtagtcccagctactcgggaggctaaggcaggagaatcacttgaacccaggaggtggaggttgcagtgagttgagattttgccactgcactccagcctgggcaacagagcaagaccccatctcaaagaaaaaaaaagcaggaaaaaagcaatcaaactttaatctctccattatactctggagacagacagatacccgtgcctttagcttccacccagggggagaaattcactcgaggacagagcaaaatgggaaaccagtttaattttttttttttttctgaaatggagtctcgctctgtcacccaggctggagtgcagtggctcgatcttggctcactgcaacctctgcctcctggtttcaagcaattcttccacctcggccccccgagtagctgggactacaggtgcgtgccaccacgcctggctaatttttctattttttgtagagacggggtttcaccatgttggccaggctggtctcgaactcctgacctcaggtgatccgcccgcctcagcctcccaaagtactaaaaagtgattttttaaaagagggtgaaggatagaagaaccaggtaccctgtgattagaacccagacagagagaacctcctgggaccggcccagacaacctccactatcttaaggaaagattttgagatggacagacagatgggctgtgttgatccactacttcagggagagaggcaggctttcctggcagccttgtgaatcctaggcccagagcaggagagatttataggctcagatgctcacagggcccccaggagagggagcgggctccaggagaaggcctgggagctgccagcgcggctccgagctgggggctgctgggagacctctggcctgacgttcccatcaaaaacacaccacttccaggcgtgggaagcttgcagggtgctggttacgagcagaaggactccatgtgggtgctgtctgccaacccgtgtggagcacagggaactctgagatcctggaaatttttatctgattccttccccaagcctgagcttgtgttggactcaaaagcagtgttctccaccgtacaaagcagtttcactccctccttgctttgcacaagtgatttcttctgcccagtgcacccaccaccacttcttctctggcctaatccattctctctctctctctcttttttccttccattgaggtaaaatttacactacataaaaagaaccattttaaagtgaataattcaagccaggtgcggtggcttatgcctgtaatcccagcactttgggaggccgacacagctggatctcctaaagtcgggagtttgagaccaacacggcaaaaccccgtctctaccaaaaatacaaaaattagctgggcgcggtggtgcacacctgtaatcccagctactcaggaggctgaggcaggagaatcgcgtgaaccagggaggtggagtttgcagtgagctgagatcgcgccactgcactccagcctgggtgacagagggagactccatctcaaaaaatagtaataaagataaaaaaataactaaagtgcataattcaggagcatttagtacattcacaatgttacgtaactaccacctttatctagttctaaaatattctgtcacccccaaatgaaaccctctacccgttaagcagccactcccccataagcccttgcaaccgccaatttgctttctgtctctatggtcttacctattctagatatttttgcataaatggaattataacatgtgcggcctttcatgtctgacttctttcactcagcatgtggctgaagttcatccatgttgtagcaggtcccagactttatgcctatttgtggctgagtcatatcacattgtacggatggatcatattttgtttatccattcaacagttgacggacatttgggttatttccaccttttggctattctgcatagtgctgctatgaacattcctgtacaagttttagtttgagtaccttttcaattcttcgggtacataccctaatctgtatctgaaacatcgtcttgggagtcaactcttctatgataccttctctaactctgcacttttctagagctgagttggagacctttccacttgacctcctacctgcaggatggccatggaccgtggtgcatgttgtacactgcataactctatggagaaactatttgcattggtcatttattgtattgcattgtgtatttattgtaataatctttcagcagatggaggaaaagtgctttgagaaaacggtgcctttctctaatataaacatgagtgtcacatggcctagtggttcccatggtccacaggttctctccattttagtaattatcatcattgtgatccttacttaataaatgtctcaaaacattctggcggaaaaaggtacagatgatatggaatgataataggccatctatccatgatatggcattcagagtttttcttgtttttcttttccatattggtaaaaattatggactttattcataatatccaaaaaatagaaacaaccaaatgttcatcaatgggtagatggataaacaaaatgtggtctacccagacagtgggatagtattcagccatgaaaagaaaggatgttatggccggcggccatggctcatgcctgaaattccagcactttgggaagctgaggcaggtggattgcttgagcccgggagtccgaaaccagcctgggcaacatggtgaaaccctatctctacaaaaaaaaatgcaaacattagctgggcatagtggcacaatccctgtggtctcagctactcaagaggctgaggtgggacaatggcttgagcccaggaggtggaggttgtagtaagccacgactgcaccacggtactccagctggggtgacagagacagaccctgtcttaaaaaatatataaatagtatgaatccatgatacaacgtggatgaaccttgacaacattatactaagtgaaagaagctagccggctgggcacggtggctcacacctgtaatcccagcactttgggaggctgaggtgggcagatcacgaggtcaggagttcaagaccagcctggccaatacagtgaaaccccgtctctactaaaaatacaaaaattagccaggtgtggtggcacgtgcctatagtcccagctactcgggaggctgaggcaggagaatcacttgaacccaggaggcagagtttgtggtgagccgagaccacatcactgcactccagcccgggcgagtgcagtgagacactctgtctcaaaaaaaaaaaaaaaaaaaaaaaaaaaaaaaaaaaagaagccagccacaaaaggtcacatatgattccatttatatgaaatgtccagaataggcaaatccatagagacagaaagtagatttgtgaattcgtggctgccaggagctgcgggtaggaatatggagtgacaaaaaaatgtgcacaagatttctttgggggatgatagaaatataaaattatattgcagcaatggctgcataaccatgtaaattatgagtgaatttagacagttatgcagacatagctgcaattttaggtgtgaactgtatccttaaaatgaatttatttaaattataccgcataaaccttttttaaaaatgatgttcattttataccacctctgaatgattataaatctgacttcttccacttcatgcagctctattaggtttccaacaattacaaaattgttcattttcaatgcttttcccctgaaccaatgagctcctgaaggtacaaggaacaatgcctgacacacagtaggtgctcaggaaatgcttgttattttgaattgctctctggctcagagaggcaaccaaggtagaagcaatggaaaatgcatattcacgtgttcacatattcattcaacaaacgagtcctgagccaggtaccgaaagcacaaaagtcaataagatctgcttttttttttcttttcttttttaagagatgaggtgtcactctgatgcccaggctgaagtgcagtagcacgatcatagctaactgcagtctggaactcctgggctaacagatccttccatctcagcctcctgagcagctgggactacaggtgcatgccactacgcctggctaatggtttttttgttttttgttttcattttttttgtagagacagggcctagtaaggtaacttagtaatattacccaggctggtcccaaactcctggcctcaagtgatcctcccgccttggcctcccaagtaactgaaatcacaggctcaagccaatgcaccgagcttcatgacttgcttatccttgcttttgagaagttcatgacccagggtgggagtcagatgggcaaagaaatgaccgtaagagatgagcagtgctacgatggatgtgaacccaagtgctatagacgtcaggttttttgtttgtttgttttttcacactgacctgagcaagacaggaagccttcacggcagaggtgaccactgaacagcattaagaaaaatgtgaaagaatctcctggggagaggtcgaggcagagcatcccaagcagagggcctgggacagaagctccaaagtgggcggggacacagtaccgagcctccgtggagtctgggaaggctggagctgggggcggccggccatcatcaggacccgcctggggctgagcttcccagcccagatccctggggctcatgtcacctcacaccccatccttaaacatgcctctctcccttcctcctccccagactccccacccagcctcggatgtgtaaggccccaggcacgtttcctgagaagataaagggcttcagcggttcctcccccgctgtgggcctgaggactcccaggaggtacccagctccccacagaccagctatttcggcccaagcccaaacacaagctggtggattctgtctgggaagccagagcactgtaggctgaccataaaaggagaaaacccagcggggactgagcacagacccaggctccctgcgtctgcccttctttctggtaacaggctgctgggggatccagtgagaggtaatcaaaacccgtctctgcagggccatcaatacccctgggctagtaaagaagaaaggtctcagcctccattgcctgcagaaaagtggctctctacctaatgccccgcacggaggcagatgccagaggttctggatcttctgtggtgtgactgtgaaggtggccactgcatggcccttgacggtgggtcctcggcagctgactgctaatgcctgttgaacttgtcctgtccatgcaccgtgtccctacacactgaccgaatcacccttgtaacaactggagtaagcacagtcatcatcctcacgggacaagtgaggaaactgaggcacaaagtaatagccggggcagagctgggaggtgaacccagctccagagcccatgacctaagccattctgtaagtgagggcccttctctttctccagccttcatctccccactctactctcccggcagagttggttaggatgacatgctgagtaagaagagatactttgagagcctttgctgcaacccaacaggtgttttccaaacctacaggaagccctggtattgtaaaagcagaactgggctgggcataggagctcatgcctgtaatcccagtgctttgggaggctgaggcagaaggattgcttgaggcgaggagtttgagactcaaagcgagacccctatctctatgaaaaaaaaattttttttaattagctgtggacagaggtgtgtgcctgtagccccagctatttggaaggctgaggcaggaaaattgcttgagcctaggagttcgaggttacagggagctattattgtgccactgcgctctagcttgggtgaaagagtgaaactctgtctcaaaaaatatataataaataaaaacatgaaagcagaactggccagtgaaggggtgtaggagacaggaaaaccaacgctctccctcttgggcctccactcctacctcctacattctcccccttctctctgctccagccccagcagcctcatagaacctatatcaagttccctagccaagcctacacttcaccttccaaggaagcctcccctgtcctcccaaggtccccagggctacacttccccactctctggacctcctctacttagcagctacttgtgggatgattcaattcgtatttacacatacgcacagtaggctgtgtctagggcaacatctaataatcaatattgttagaatgaccgggcgtggtggatcacatctgtaattccagcactttgggagaccgaggcgggaggattgcttgaggccaggagttcgagaccagcctgggcaacataatgagacctcatctctacaaaaaatcaaaaaattagccaggcgtgatgatctgtgcctgtggtcccagctacttgggaggctgagaggggaggatcacttgagcccaggagttggaggctggagtgagctatgagtgtgccactccactccagcctgggcaacagggcaaggccttgtctcacaaaaaaatgctgttggataaagaaaggaatggggagccagactgcccagaggctgggaggacaccgagggaggtggctgacacatgcaatttaacaaggaaggtgctggccaggcactgtgggtcacgcctataatcccagcactttgggaggccgaggtaggtggattgcttgggctcaggagttcaaggccagcctgaacaacatagcaaaacctcatctctacaaaaaatacaaaaattagccagttgtactggtgcatgcctgtatgcagctactctggaggctgaggtgggaggatcacctgagcctggagaggctgaggctcaggtgagccgagatcacaccactacactccagcctgggcaacagagtgagactctgtctcaaaaaagcccaaaacaaacaaggaaggtgttgccaagtgtcagctggggcttttcaggttcactcccttaagtatgtccctttttcaatttaatatttacggtttttgtttttgtttttgtttttttttgagacggagttttgctcttgttgcccaggctggagtgcagtggggcaatctcggctcactgcaacctctacctcccaggttcaagcgattctcctgcctcagcctcccgagtagctgggattatagtcgcccaccaccatgcctggctaattttttgtatttttagtagagatggggtttcactacattggccaggctggtctcgaactcctgacctcagatgatctgcctgcctctgcctcccaaagtgctgagattacaggtgtgaaccactgtgcctggccaatatttactattttataacaaataattctcctttgctgtctcccttccctgtaatgcaccatgggtaccaaaaataaaaataaaataaagataaaaacgtgaacttttcatgattagtcagagcaccaaacagacactcctagcacctctgtaaagactgagccagccagacagagccattcattcccacacacagtcccccatcattcccaaccgggccagacacatagctgacagccactgcaaaacccacaagagacagagaagcatttggctgtaccccttcctggagatgtgtttgtagcagcactgcctctgcagagaaacagctgggaattacttcttggctccaccctatcacctctgcccccagggcccgtttcctcaccagggaaatcgacaaaaatccagacctttcaagggcatgaagatgattgaaagagactggattcagaaagagcttaaaattgttttacccacagcacatttaagagcttggtaattgccgttaatatcatctttatcatcatcatctaaaacagtgatctagggaagaggttatagacagcagtgattctgaatcggcaggacaggatattcaaccaaagatatttaacccctttctgattacaaggtgtcatggtctgaatgctcatgtctccctcaaattcatatgctggaatccttacccctaaagtgatgatattaggaggtggggcctttgggaggtgatgagatcatgggggttcaatcctcattgggggagagacccagagagctagcaggtcccttccaccatgtgagacacagcgagaaggcagcactaggccctcaccagataccaagcttgatcttggacttcccagcctccagaaccacgagaaacaaatatctgtttaaaagccacccagtctatggtattttgatatagcagccttaacaggctaagacacaaggcctatgctagtcccttagccttctgggggcctcagtttcctcttccgttatatggggacaagaatactacactatctataccacgctacccaggagggaagagtaacattctgagggcagcgaagctgggtccccaggtttgactctcagttctggggccaagtaggtgtgctgagttttccccattgatcaaatggggaggctgccacccaccctgtgtggtgctagtgagggccgagcaatgtgggattgatggagcagtgaacccaggtcctgacctattgcaggggccctgaggacatcagtgcccttcctctctctgcctctactggggagcagcctcaggggagttgggtgagcaggaaccatccccagggggctgccaatctcaagcagaaggatacagccgagtgtgggaacttgcaaagtggagaaagtcgtttggatcactccacccgcagagttgtcttaagcttaaagaggaattagccaagagccccaagctgataaaggctggctgttatttctttttttaatcccctgagtgtggccatttgttgctaatgaggtgaggacaaaacattacttgtggctatcttgcatagggcaagtgcagaggctcagaatggaatcttatctgctttcctgcccctcctacaccccagggacccatggaggggctccaaagtggttcttgtctggagggctttaatggcgcttttctcctattcatcacgttcatttattgaacttagctccagcctcctaagctttgagctgtcaacactctgagatgaagacagtagacagccttccgtgggattgagggggatccctgtggttgcccggtgtcaccgactgaccagcagggctccggctttggagtcaggataatccaagtgtatatttggctctgacacttaacaaatctgcagcaagttctccactcctctgagtctgttttcccagctgtaaaagggagctaataatagctcttgcggctagcgttggatcacccaataaaccttgtaagcatatgctgagggcacacccacacaggcatgcacgagaaggaagaatgccatagttgccatttcataagcaccacgaagataaacatcatgggaaaaatagcaactttaggctgggcacggtggctcatacccataatcccagcactttgggaggtcaaggcaggaggatcacttgaggccaggaatgagagaccagcctgggcaacacagtaagatcttatctctaaaaaaaaaaaaaaaaaaaaaaaaaaaaaaagttttttcactaggcacagtgggctcacacctgtaatcccagcactttgagaagcctaggcaggtggatcacttgagctcaggagttcaagaccagcctgggcaacatggtgaaatcccgtctccacaaaaaatacaaaaattagccgggtgtggtggtgcatggctgcagtcccagctacttggggagctgaggtgagaagatcactggagcctaggaggtcaagcctgcagtgagccgtgtttgtgccactgcactctagcctgggtgacaaagtgagaacctgtctcaaaaataaaaaagactgggcacggtggctcatgcctgtaatcccagcactttggaaggccaaggtgggtggatcacctgaggtcaggagttcaagaccagtctggtcaacacggtgaaacaccatctctactaaaagtacaaaaattagctgggcatggtggcatgtgcctgtaatcccagctactcaggaggctgaggcaggagaatcacttgaacccaggaggtggaggttgcagtgagctgagatcgtgccattgcactccagcctgggtgacaggggtgaaactctgtctcaaaacaaacaaacaaaaaacagttgtttttttttaattagctgagcatggtggtacatctctgtagtctcagctacttgggaagctgaggcaggattgctgaacccaggagtttgaggctgcagtgagttacaatcgcaccattacactccagcctgggcaacagagcaagaccctgtctctaaaaaaagcaaaaacaaaaacaattttgtcagccttctttactttataatttaatttttttttatgacatatgcctgcaccttaatagtttcagggcttaattttaaaattcctaatctggtcctgtccaccttgtaggtttgtggtaaagattaactgagaatatttctgtaaagccctgagctttataggaagcatataataaaaatccatgattattattatcacttctttgtaaaagaaggcatgagagaattcccatgagaagatggtaggctgagtgcatgcatttagctctcttccttcctaaaccttactaaaataactgtaaaagactttccaaaaatacatgaaccagtttagccgggcatggtggctcatgcctggaatcccagctcttaggaaggcacaggcatgaggaaagctggagcccaggagttcaagacctgcctggaaaatataacaagaccccattctccacacaaaagaggggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccccaaaaaaaaacaaacaaaccaaaaagtgtaaaaatacatgaggcagtttaaaaagaactagagaggggagaacagcaaagccatcttggaagacagaaaatgggataagcgttgaaaagtaccaagaaaaagtccagacaccgtggctcacgcctgtaatcccagcactttgggaggccgagttgggtggatcacctaaggtcgggagttcaagaccagcctgaccaacatggttgaaccccatctctatttaaaatacaaaaattagccgggtgtggtggcggatgcctgtaatcccagctacttgggaggctgaggcaggagaatcacttgaacccgggaggtggaggttgcagtgagccaagatcatgccattgcactccagcctggacaacgagagtgaaactccatctcaaaaaaaaaaaaaaaaaaaaaaaaaaaaaaaggtaccaagaaaaaagtctaggtgagcagtgaggaaaggtgggaaacgacctaatttcaacaccgaattccccatttctgccccaaacctcagaaactggcaatgccaggggcctctggaagaaaagatcaaggaggagacaaaaacataaggactgggtcaaatataaggcactgttagacccctcccatatcttctacactccctgaagccaagtgactgcccttctcacaccccacagaaggtggtgggtttagtctctggtgagggttaaacagagggtctccgtcctggggggacaccaggaaccatactgaaagaaggaaggtataatgtacaaatttcactgcacattttgaaaccctcagcttcttttcaactagaccctcaaaatgatgctagacaaatctttaacctccaggcagaagatttttctacaaaccttctctgaagaatcagattagcccatgaacaaaagactgaaagacgaaacagaagtgtcctaatggggtagcccagtgctttcatattatagccaagcacatcagcaagcccatcctataagcactgagcttccatcaacaatttggtatcctgtgtactaaagcatccaagatgaatggatagccaagaatcccaagacatctgaagaaatccactaatatgacagacagaagttaaaacaattaggaaaatatgtatcttggaggaaatagactctgcattaaatatcctctgagaaacaggatattgcaaccacagaaaaagaatgtcatatgaaagaaacatttaaaaataaaatagaatttttggaatttaataaaatatataccagaaatttaaaacgcaatggaagggttagggaaaaaagttgaggtaagtgcccagaaaataccattaaaaacattaaagtgatgaaaatgacaaaagaaagagatttaaattataggattggtctaggaattccattatggaaataaaaagacttctaagaaaaagaaacagagaacacagggagaaagacagcatcaatgaaataatttgcaacatttcccagaatttgtggacacacgtttatagattaattgggccactaagtgtccaggataacaaataaaaatggactcatagcaagtcccatcatcctgaataggggtacaaagacagtctaaaagcttctagagaaggaggaaaaacaaaaactggtcatgtacaaaggatcaagaatattcccagccaggaaggtgaatataatcacacacacacacactcacaaacatacacacatacgaatcagattgggtttcatcttctcaaaactgaaactagaaggcaacaacacaaatgccttaaaaagctcaggcaaaaaaagttatttataactttctgaaaacaactttcttgcctgaaattttaaacccaactaaactatcctttaagtgttagagaagcatcaagcctctcagatatggaagttctcaatgcctcaagatcacgtacattctttcttgggaagctactggacaaagtgcttgatttaagcaggagagtaaagcaagaaagaggaagacatgaaaactgggaaacaaggaatccactatgaaagcactaaggggaatttcaaggatggtgaaaaagatcctatatgacagttactagctatagagaaagccagggcagatcagaaggctatagtagagatcacattcaaggagatgatatcaatatgatatccaatacatgtctggacatattaaaaggagattaacacatttagaaagagattttggggcagaattggtggttaaatacatggaaaacaagattggggaaaaaaaaggcaattgctaactccaggaaaaagaaaagtcatacagaaagaagaaaaatagtcacaaagcagtgcaaagctcagctttgaataacatctacataatcataataatgtaaactctagatagcattacatagtcataataatggaaactctgaacactgagtttgtcaaaactaagataaaattatactgggactctgatatgaggcatgtgtgttggaacgaggaaataggggcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccgtctgcatgaatacttttaacaaaaataaaaaccaattttttaaaaaagggaacaaggaattcctacatgcactgatatgtaacatcctctggcaaaatataggactgtatatatatggaatgctagtatttgtagggaaatcttagggaagaaaatagatacctatttgcttatacttgcaaaaatatctctaggagaaaacctcatacactagaaaccataattgtctcttgggagggaagctaagggtctaatgcacaagggttgaagggagaagttcaccttttgaatttgtatgtaacatctttccaaaaacaaaccacggccgggcgcagtggctcatgcctgtaatctcagcactttgggaggttgaggcgggcagatcacctgaggtcaggagtttgaaaccagcctggccaacatggcaaaaccccatctctactaaaaatacaaaaattagccaggcatggtggtgtgtgcctgtagtcccagctactcaggaggctgaggcacaagaattgcttgaacccaggagacagaggttgcagtgagcagaaatcataccactgagctgagatcgtgctgctgcactccagcctgggtggcagggcgagactctgcctcaaaaaaaaagggggggagaatttaaaaaataaacatgacataatttatgcatatgcagatataagatacatattttaaatatcagcttctcttcccataccctcaaggggcttggcttccacttgggagggtgccatgttgtgaagtatctcttagaaagtccctcccattttcccaactcctgtgaggcagcaaagggctgagctctggctctgagctccctgccacagtatactagtcaacccctctaaaccagctcctgccacactcatcatacccattctcacccctacatttatgcttttattattcttggctagaaagccatccctgcccccttctctcaccttagcaaaccattcttcgaggcttataaagccccacctctctcaaataacccaccccatccatcctgaccctggtaggttcttttctataaataactctaataattcattgattcaacaaatactgagcagctactatgtgccaggcaccagaaaatgtgctggagatacaatgatgcacatgcaagaaggatggagtttataggtcctcaggaacttactgtctatgtgacacaactgcaatgcttcatcttatattcagtgcatgtgtgttacccatccctcctcaatcccgccttttcacaccccatcttttccatgaagaactcaaggaagaagccacatgtgctagctttctctctccaccttcatggtaagcttagtgtggatcgcagcccagtgacttaacagaatgagatcgtgccatttatcaatggagtcaacacactgggcctacgtgtttcttcacaaaaaccaatttcctacttgggaatggagaaaaaattaagcaggtgaacggaattcttcccaagcttaaatttttctccattatttttgacattctttttattttttatttatttatttattttgagatggagtctcgctttgttgcccaggctagagtgcagtggcgtgatctcggctcactgcaagctccgcctcttgggttcacaccattctcctgcctcagcaccccctgagtagctgggactacaggcgcctgccactgtgcctggctagttttttttgtatttttagtagagacggagattcaccacgttagccaggatggtctcgatctcctgatctcatgatccccccaccttggcctcccaaagtgctgggattacaggcgttagccaccgtgcccgattctttttatttttggagtccgccatcaatgatttgccagaaagcaccaggtcatgccaaaatagacgagggcatagcaggtgttggttaacatttaaattaagtaaagagtttatcttttatggatgtgcatattcacggttttcattttctttctttctttcgtgacagggtcttactctgttgccaaggctggagtaccatagcacgatcatagcacactgcattcttgaagtcctgggctcaagccatcctcctgcctcagcctccagagtagctaggactacagactcacgcactgtggccagctaattatttttttgtagagacaagagctcactatgttggccaggctggtctctaactcctggcctcaagtgatcctcctgccttggcctcccaaagtgctaggactgaagacatgctgctgtgctcaatcatgatagtcatttcctattggagcttactatgtgtcaagtgagcatttctaagtagtttcaagagagctgactatgcaattttgtgttaaaacctagagaccatgaggaatcaaatatatgaacacagggtgtccttgtcaattacaacattgcctcacagttaagaggtggtctagcgcaggcatctcaaaccaccgactggtactgcacagcaggaggtgagtagtgggcttcatctgtatttacagccactccctatcactccaattactgcctgagctctgcttcctctcagatcagaggcggcattagactcttatagaaccaccaaccctactgtgaactgcacataagagggatccaggctgtgtgctccttatgagaatctaatgcctgatgatctgtcactgtctcccatcacccccagatgggaccgtctagttgcaggaaaacaagctcagggctcccactgattctacatgatggtgagttgtataatgatttcattatatatgacaatgtaatcatagaaataaagtgcacaataaatgtaatgcgctcgaatcatcccgaaccatctctcccctgcggtccatggaaaaactgacttctatgaaactggtccctggtgtcaaaaaggttggggactgctggtctaggaaagcaaaagtccccacaacacaaaagtattcttcaatgactacaagagcgatcaaactccaccgaaacctccttctccgacgattcagtggcttcaccttgccaattattgggtatcaatagccaccatcatgatatgaacacaaaacaaagtggcagttctggaaaacaaggtgcagtgactggcaaagtcagtggccttggaaaggccaaaaaaaagattcaggggccaagtgtggtggtgcacacctgtaatcccaccactttgggaggccgaggtgggaggatcacctgaggccaggagttcaagaccagtctgaccaacatggtaaagccccatctctactaaaaatacaaaattagcctggtgtgatggtgcatgcctgtaatcccagcactatgggaggctgaggcgggcagatcacaatgtcaggagatcgagaccatcctgggtaacatggtgaaaccccatctctactaaaaatacaaaattagccgggtgtggtggcacatgcctataatcccagttacttgggaggctgaggcagtagaatcgcttgaacccaggaggtggaggttgcagtgagctgagatcacaccattgcactccaacctgggcaccaagagggaaactccatccggaaaaaaaaaaaaaaaaagaaagaaagaaagacaaaagaaagaaaaagattcagggcaattcacagctgaatgaacgctaagaccacaggggctttgagagacttaaacactaaagaagtaaaagaagcccttaggaaaactggtgacccatcaaataaatctgtaagaatgatcctttttagctcgggctgcagaagtcaagcatgacatgaagatgtcgttttatgctcacatgatttcatccctcagcccagaaaaagttacagaaaaaaaccccacacccactcttaattcattttatactgaatctacaaattagcacctacttgtaattaaaataaaattcttattacatgtaagctgaaattaacctatttttataatttgcaatgttggttttcttttcttttcttttgagacaaggtctggctctctcacccaggctggaatgcagtggcgtgatctcggctcactgcaacctccacttcctggtctcaagcgatcctcccacctcagcctcccaagaagtgggactacaggtatgtgctaccacaccaaagtaatttttgtattttttgtagagacagggtttcgccatattgcccaggctggtctcgaactcatgacctcgagcaatccacccatctgggcttcccaaagtgccaggattacaggcgtgagccactgtgcctggcctgcaatgtcatttttcaagctcagtcaaatattttgcccactctctttccctcctccacacacatactatctacagtgaaactttggtctctgttttaagtgatctttttctggaacgaattatcttcagatagtaaaaatttccttcatttcatgccatttagttcagttagtgtaatgaaaggtcacgtaacaaaatgttaatggtgatgagttttggatgatagaatcataggtgccagcaagttctcttttacttaaatatatgtttaagtttttctagaatgaatatacaatattaaagactttttcaagttacaaataaattttttcagagcactgtagaaatgcttacccatctgtcgctccccctccttctcctttgctaacagaattttctttctttttggtatttagattaaaatgtgcttagtgggacctcagctccagaaaagaaccaggaattgctgggtatggtggcttatgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaagacagatacctgactccaggagccatcactttacaacctgagattacagctccaagattgcctttgcaaggctccacctgctggtctttggaggtaatggcaggccctgcctagaagggccaagattctggtcctacctgtggagtctggctcactgtcagaaagttggggcacttatacctgagtccctctatcttgggggcggggtcgtggcatctctcaggcacacctggattccggcctcaagaacttccagaattgggctcctctcaactcccaactcagatccctgggttcccacctgttggtgccctttcagagggggtgtgagttttcgagtttcttgtactcttcgcctgacctggtacacttgtttgcattaactgcctagtccctctgtttgacttgggggtggctatttcaggggctccaaagtgttctaaatagaaggtgagaaggcctgggtgcagtggctcatgcctataatcccagaactttgggaggccaaagtgggaggatcgcctgaggccaagagtttgagaccaaccagtatagcaagatcctgtcacttccaaaaacaaaacaaaacaaaacaaaaacaaaacaaaaaaacccacctttttaaaattagcttgacatgacagtccacacctatagtcccagctacttgggaggctgaggcaggagaattgcttgagcccaggaggcggaggttgcagggagccgagatggcaccactgcacttcagcctgggcgagaaagtgagaccctgtctcaaaaataataaaacaatagtaaaaataataacgtataaacatgaaagtaataggcacaagtcttaagtttggaaaaaccagcattaacaatcttcacaagaagctacaagatagagactatcaccccttttgacaaatgaggaaactgaggctgaagaggaaaagatatttacccacagtcccacaggggttgagggacaggtaggtgtcaacacagaccacaatggctcagccccagggctgttccccaccctctttccatcctttgcagacagctggcccgacggggaccttgggcagcgagccccggagctggagctggagcgggcccatgcccgtatttgcccaagctcttggctctccctcaccctcccaggctgcaaacacagatgttccttttgctttttccctttttcagccacagtaactcctggtccctcgcagtgcctgccaaactccacattcctggcaagaactgcagacaagcaggacaggaggggctccctggagctggccccgtgcagccctgagttcactcaccttgaagcatgctccggtaggccgtgtctgcgatggcgtagatgtgaggcggcatctcgtgcctcttcttgcccttgtacatgtcgacgatcttctccgagtagatgggcaggtgtttataggggttgaccaccacgcagaagaggccagagtacgtctgcagacagagaacccagcttacttccagacctcctccagggtagacagattgcacagaagcactcaatattctcatgttagagatggggaaactggagcttggagtcttagtggaaaccctgggcctcactgatattccaggtacgtgggaagaggagaaagggcgagagtgggtttccaagctgcctatgttttattttgcaactgtggggggttttgtgtttgttttgagatggggtctcactctgtcacctaggctggagtgcggtggtgtgaacgtgactcactgaaaccttgacctttctggactcaggtgatcctcctacctcagcctcctgagtagccaggactacaggcgggcgccaccaggcctggctgatgtttatattttctgtagagacatgggtttcactgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgacctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggtgtgcacaaccatgcccaggtaatttttattttgttttttgtagagacagggtttcaccatattgcccaggctggtctcgaactcctgagctgaggtgatgcgccagtctcagcctcccaaagtgctgggattacaggtgggaaccaccgcactcagccagagagggaatgtcgttaactgaacattggaggcatagaaagccacacacccctaaaaaggggctgtccagagggatccgcagtcatacagaaacacagctgccaaaactgtggtccaggagggagggaggaaaaggtaataatcctccaagctctctctcctcccaccaccctctgatctctttctgggacctcccaatgtccatatctaagaagaaaccccagtgactcagtctctagaagatggcagaggcatctcctcgtggcatcttcacaactactcagtaacagtgatttccccaccgcctgtttgacaggagggcaaagtgaggcatggtgaggttgtcaccaggttacacagctggagggaagttgggaactagaactcctgtttaccccacagcgcctgctcctgatcattaataccttccccatctgcaaaacagagaccaacactgacatgagctctccaatgtggatgaagcttgaaaatatgcctagtgaaagaagccaggcacgaaaagtcacgtactctatcatctcatttatgtgaagtgtctagagtaggcaaagccatggagacagaaaacagacttgtggttcccagaggctggaaagaggtgggaaatgaggaggaactgctcatgggtataaggtttccttttgaggctataaaaatgctctggggccaagtgtagtggctcatgcctgtaatcccagcactttgggaggccaaggtgggaggattgcttcaggctaagtgtttgagaccagctcaggcaacaacagccggaccccctctctacaaaaaaaaaaaaaaaaaaaaaatagctggccatggtggtgatcacctgtagtcccagctacttgggaggctgagtcaggaggattgcttgatcccaggagctcaaggtaatagtgagctatgattgtaccattgcactctagcccctgggtgacagagcaagaccctgtcttgaaattgatagctgtacaacattgtgaatgcacttaatggcactgttttctttaaaatgtttaaaatggtaaattttatgtcatatgcactttaccatttaaaaaatagcagtcctctcctactgggtgaataggagcatctgaaaataatcagatcagggacggaggagtcaaggcacaaggcgagtcccgccatgctgtacgtggtaaggcactattgtcatgatttttccttactggatactagattttcccatggttgaggtcacagttcaggagacaggctccaacccgtctcacaggaactgctttccccaaacgataaacatcagtactgcccaagactctgatggccataaagcgtatcctcttccctgcaagtgacttagggagaaccacagatccatctctcagttacagctagggtgaaccaagcaacagagggttaagtgacttgaccgaggtcaccaaagaagatcctggcagcaccaagcccagcctggcccgcccccaggtatgagcatggtccattatgctatccagcctaggcccatccaacagaaacagaaactactgatcgttcgttcattcattcattcattcattcattcattcattcattctgtacgtcccagatgccatgcaaaaggtgctgggactacattagaacattaaaaaaacacaggatcccagccctcaagggccttttagtcaagggctggagccaattagagagtgggaaagtctggctgggtgtggtggctcacaactgtaatcccagcactttgggaggtcaaggcaggaagattgcttgagcccagaagtctgagaccagcttgggcagcacagtgagacccccatctctataagaaatttaaaaattagctgggcatggtggcattcacctgtagtcccagccacttgggaggctgaggtgggaggtttgcttaagcctgggaggttgaggttgcagtaagccgtgattgtgccatgcactccagcctgtgtgacacggtgagaccttgtctcaaaaaagaaaaagaaagaaaaagagagagtgggaaggtccttccagggctcagtccactcagggacaatggtatgtaatgtctgggggtgctgcagaggaatattctttgaaggtacaggattgttgggcgcagtggttcacacctatgatcccagtactttgggagaccaaggagggcagattgctcacactcaggagttcaagaccaacctaggcaacacagtgagaccctgtttctaccaaaaatacaaaaaattagcagggcatggtggcacatgcctgtagtcccagctactcggcaggctgaggcaggagaatcacttgaacctgggaggtggagggaggttgtagtgagccaaggtggtgccattgcactccagcctgggtgacagagggagaacccatctcaaaaaaaaaaaaaaaaaaaaaaaaaaggaaacaggattgatggagacggaggttctcaccatcccctaaaaggagaatgaatgagtcaacatatgcctgtctaaatagccatcaaccatttactgagcacctactatataccacatctgtgtcagaggctggagataaagaaatcaatgatagctcctgcccttaaagaacttaaatcagagggggagacaagtacattaaaacacgtcgtaagaacagagaatgataggaacaaggaagggaaggccctaacccacattgggggtggtcagggaaacctccaggtggggaggtattccctgcactgagtcttaaaggacaacaaggtgttaaccagctcaagacaaagcagggacatgggcagaaaaacaggacacggggtccgtgggggtgaactataagcagcttggtataagcggctccatcggaccgaaatggagaagcaaagcaagggttagaggtaagcggggcccaggagcaacatccagcctggtggggctgggagtggggggctgcctgcctggacacccctcttccccattccatcacccaggaccctcccacccatcctgcaaacaccagctgcaagtgccttgagtccggggaaccccctttctcctcttcagtcccagcacaggccttggtatagaataggtgctaactaaatgcttgctaaatgcatgccaggggaataaattaatgatacagcttcctgggagcagggacagcctgacttcacctccgtgacctgggggccttgcacggcggcagtaggtactcagtggactacactgagccaggccaggggctatttcctgttcaatcagtgtcccctgtccccaggacaagcctcccaaagagaagagcccagtctgtggtcacctgaacaaaggtcaatcaagccccaccctccttcaggcctcgactccatctccagctcctctggggccatgtccactgccacgccccttttgaatgtaggtatcatttacagcccaacctgtcctcactcaagcccttgacctggaggcagtaaagggcagtggctaagggctcagaactgggtatggggtacttgaatttgaaccttcactttgctacttcttcgctgtgtgaccctgggcaagtcccttaacctctctgagtctcacttatcctcatctacaaaacagggaggcatacgaacaagcccttcatagatgtgctgcgagataatgctcgaaaagcatttagcatggcggctggtatgtagtaggtgctcaatcaatgttatttagtgactcttactatgctcccttcatttcacgagagggaagtcttgccaccttagagccttcaatatgctgttctctccacttggaacacttttcccctcatcttcccacagctggttccctctcctcttttagagctctgcctaaatgttacctcctggactgtgacccacacactactgtatctcctgcaccccgcacagtgccagggacagggtagacactcagtcagctgtaatcccagcacttcgggtggccaaggaggtcagatcacttgaggtcaggagttcgagaccagcctggccaacatggcaaaaccccgtctctactaaaaatacaaaaattagccaggcatgatggcaggcgcctgtaatcccagctagtcgggaggccgaggtaggagaatcacttgaacccaggaggtggaggttatagtgagctgagatcatggtgctgcactccagcctgggcaacagagtgagactctaaaaaaaaaaaaaaaagaaggaaggaaggaaggaaagtaagaaagaaaggaagaaagagagatgagagatagagaaaagaaaagaataaaaggaatttttaaaaagaaggaagaggccgggcatggtggctcacacctttaatgccagcactttgggaaatcgaggaggtcagatcacttgaggtcaggagtttgagaacagcctggctaacatggcaaaaccccgtctttactaaaaatacaaaaattagctgggtgtggtggcgcatgcctgtaatcccagctactcaggagtctgaggcaggagagtcacctgaaccaaggaggcagaggttatgtgagccgagatcatgccaccacactccagcctgggtgacaaagtgagactgtctcaaagaaaaaaaaaaaaagaataaaatgaatttttaaaaagaaggaaggaccacactgccttttcaactccatcactagcttctgaaagaggaatatgacttccatcctctttgtttgggacatctctcccagtgccgtgcacacaacaagcacttaatccatacttccaggtagatctgaatctctgctgagttctgtaaaagctttctaagcaagccagggtatgacgatggagtgaaggtaagactggtgcaggcagccgcacatctcacggcagggtcgtggggcttcagcatcgggctcttcctcccacattattcagccacttctccttcacctcgacccagcccaaccatagttggctgtgtttctgcctctctggccccacgagcccctctccagctggttaaattcagaggtttcaacatcccagcctcctgtgtcccagccggcatctcatgggccctgtgccaccagcaagtcccagctgcaggcccaggatttccctcttgtgaccgtattaggaagcagctccagtttttctctgacgctttatatggtcagccacagagccctgagcagggggtgctcccggggcctgcagcagaaatgaggaacagggagggaagggagggaagtggaaggaacactggctttcagacacacagggatggccgggcgcagtggctcacacctgtaatcccggcactttgggaggccaaggtgggtggatcacctgaggtcaagagttcgagaccagcccggccaacacagtgaaacctcatctctactaaaaatacaaaaattagcaaggtgtggtggcgcgtgcctgtaatcccagctactcgggaagctgaggcaggagaactgcttgaactcaggtggcagaggttgcagtgagctgagattgtgccactccactccagcctgggtgatacagcgagacttggtctcaaaaaaaaaaagacacacaggcctgggcagagtgttggctttgccttatcacctgcctgacttgtgcatacagacctacccctgagcttcctcagtaaagtgatggataatcacggcttctttatgaagctgcagtgcaatatcacggctttctaaatacccaacctagagacagacgtggtccaccaagcacgtgcttttgctgcagccttgcttttaagagcaaaaagactagaaacaacctaaatacctgtcaatagcagacaggcttaatcattatggttcatccctatagcagaagactgtgcagtggccctctctctactaccatggatgaatggccaaaatacacagttagatgcaaagattgagacgcacaacagccggggcctgtgctgccattttggaggggtgcaggaggggctctctatgtggctgcatgtgtataaaacatcactggaggctggatggagcagctcacacctgtaattgtagcactttgggaggctgaggtgggtggatcacttgaggtcaggagttcaagaccagcctggctaacatggcaaaaacccatctttacaaaaaatacaaaaattatctgggtgtggtgatgcacacctgtaatcccagctactcaggaggctggggcgggatgatcgcttgaatccagaaggcataggttgcaggagccgagatcgcaccattgcactccagcctgggtgacagagtgagactttatcacaaaaaaagcaataggctgggcacagtggcttaagcctgtaatcccagcaccttggcaggccgaggcaggtggatcacctgaggtcaggagatcgagaccagcctggccaacatggcaaaaccccctctctactaaaaatacaaaaatcagctgggtgtggtagtacacgcctgtagtctcagctacttgggaggctgagggaggagaattgcttgaacctgggagggggctgttgcagtgagccaagatcatgccacttcactccagtctgggtgagagagtgagactccatctcgaaaaataatataaataaataaataacatgactggagggctacatatgtaaccagcaaccacagtgtctctaagaaggggaactggaagggcgagaaataggaacgaagggggaagttctatattcccttatacactattttatttcatatttgcatgtcttacctattcaaaaacatatttgaagtctgactagatagttatgaacagacagaaaaaactataaggtagggttaagtggaaaaaaaatcatactgcaaaacatacaaggagtgactttttcttatgtttggggtgtgtgtgtgtgtgtgtgtgtgtgtgtgtgtgtacatacatgaacctgtgaatcatgtttgcctccagggaagagggctgctttttgtgatacatacttatttttaaatattctcctgaggtctttgcatagattatccttgtattactggaggaggttctttgaagcaataatgacttgaaagatcagaaggctgggtgcagtggctcatgcctgtaatcccagcacgttgggaggcggaggtgggaggatcatctgagttcaggagttcaagaccaacctggccaacatggtgaaaccacttctctactaaaaatacaaaaattagctgggcgtggtggcatgtgcctgtaatcccagctactgggaggctgaggcacaagaatcgcttgaactcaggaaatggaggttgcagtgagccaggatcacaccactgctctccagcctgcgtgacagagcgagactccatgttaaaaaaaaaaaaagatcagaagggctaatgcttggggcttgacaaagggcagcttccagttacagtgtctttctaccctctagggaccagtgcagtggctggcacccaggaggcctctgttcacaatctgcttgttccttgtgtccccgggtggacactgcttccagagtaggctaagattgctgggccaggtctctaaggcggaaaaattgtcacctgctaaagtttggaaggagggcttctcctgaccccctgggcattccagaagcagaaccagaactggaaaaatgtcctttggggttcatggttcagggacttgggcttggagttccaatgagcaggggggcccatccaccttggctctggatcatgattttcccaaccccagaggtttggtatagggtggagggtcccactgtctacagagacaaagcaggtaaggcatgagtgaagcagggcgtgtgtgagtgaacaaaagaggtgccacggtcaatggttaccatggcctgggagacgacagggagtggtgaggtctgcggaaaagcagagcaaaaagcccatctcacagggactgctactcgcactctgcattctgcagtgtcaggtcctctgctttttcgagcaatgccagaaacagatttctttttttgatatattaagttaactcaatttaaaaacaaaaatcactcctctgtgttagcaggttgtaatcattagtctagcacctagttaggtgctcaaggaatcataataaaaggttcaattccttcttgctctgcacttaaagcttgtctacctcaaagctaacaaggcctctggcactgtcccctcctgctccagcccacgaccatcacctcctgctctaagcctattaccccaagagccctttgctactaatcataggtagtcaccctggccctggactcacacagaccttgtctgaatcccagctctgcccaccttccagtggtgggactaagcacatctgagcttcagcaacctcatctttttttttttttttttttttttttttttttttttttgagatgtagtctcactctgtcacccaggctggagtgcagtggcacaatatcatgcctgtaatcctaacactttgggaggccgaagtggtgaagattgcttgagctcaggagttcgagatctgtttgggcaatacggtgtgaccccacctctaccaaaaacacaaaaaaattagctgggcatcgtgctacatgcctgtagtcccagctactaaggagactgagataggatcccttgagttccaggaggcagaggttgcagtgagctgagatcatgccactgtactccagcctgggcaacagagtaagaccccatctcaaaagaaagaaaaagaaaaaagaagaaagaaaaaagaagacagaaagacagagaaagaaaggaagaaagagagagggagggagggagggaggaaggaaggaaggaaggaaggaagggaggaacgaactaactaactcgaggcagacgaactcagccaaaagacagcattcagaagaccaagggacccttaggaccaggcgtcaaagccatgctccccgccaggtatgccacaaacggtcttcagcagtttaggtagactgctggacattgctgagcccagaacctgcatctctaagattaggaggaaagctcctctggcttctatagactcttctagatccaagagcacaagaggtctgccagaaccttctcaagggcacatcgtttgaggcgagccttgcagaacggaggagaaagtttatcttcatcacagagggcaaagtcatgcatgccagaccacggacctggtatcacctcactacccgcctattaacaagactcatgcatgctgctattatgggctgggagagtaagttactgtgctcccccaccccaacccctttccttctttatcttctccgtcatggacgacggtttctattaagcaattaaactgaccagaaaggaacaagagaagagcgggaccatcatcacaaggctgaaaggattttaatctaatctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggcctgtcctgaaactccctagatggtgatgatacgtcttagatgaaagacctgggccccaaagagtccaattttccctctagctccctacagacgggcctctttagaaatatccaacatactggctgggcgtggtggttcaggcctgtgatcctagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaacccgggaggtggaggttgcaatgagccaagatcgctccacttcactccagcctgagcaacaaaagtgaaattccatctcaaaaaaaaaaaaaagaagaaagaaagaaaaagaaaatgtccaccatacaaacagccccagatcaataatttttccatacaaacagtgccacagacaagagacttcccctacttaagaaagtaaagatacattttgcaacactgcacctcagcttccttccctaaaaggggcaaacatttttaactcaggggatgctgtgttaaataaaatacaatgtgtcaatgtacagcacttggattggaggacatatttaatagttacggccaggcacagtggctcacacccgtaatcccagcgccgtgaaaagtcaaggcaggagatggcttgaggccaggagtttgagaccagcctgggcaatatagtgagatcccagtctctacagaagtttttttttttttttttaattagccaggtgtggtggtgcacacctgtggtccacagctactcaggaggctgaggtgagaggatcgtttgaatccaggacttggaagctgtactgagctacgatagaaccactgcactccagcctcaaagacagagtaagcccccatctcaaaaaaaaaaaaaaaagttatgagttgctaagttgctcactcttaccatttggctctttaaaaagccactctaactccttctgaaatatctataagaacagtggaaaaatggcctatccccatgacagattctatactaccccttacaaggggtatctttggggcttcctgagatatattacacaagtcaacactgagcatttccaaatggaaaaaagagcaagtcactaaactgtgtgcccaataggcttttaaatatgtaaacagataccatgctcacaaagagacaaagaatgcaccgcatctctggttaaggactaatttttctgttttgtgttcactatgctttctgaactctccaagtgttccatagtgaacgtgtcttagtttcctaattaggaaaaaaatgtgcaggacatttttagagatgacaaggggctttttgtaattttcatttggcaaaatgtacagaccagaaccaaagagacacaaggatgccaagtgatggaagaagaacatcttactagtaaaatcaaaagtgatcatgaccacagcaaaaaccaatctagtaacacttaacattttcagtgcctgcacttaacatgtagcaggaagtgtattaagtgctttctatttagagtaacccactccatgaagctggtactatttttttttttttttttttttgaaacagacaaggtcttgctctgtcacccaggctagagtgcagtggcacaatcatagctcactgcagccttgaactcctgggctcaagtgatcctcctgcctcagcctccctgagtagctgggattatgagtacgcaccactgcacctggctaatttatttttgcagagatggggtctcgttgtgttgcccaggctggtctcaaactcctgggctcaagtgagccacctgcctcagtttctcaaagtgctgggattacaggcatgagccactatgcccggctcccaagaggctggcactattcttgcatccattttacagaaaaggaaacaaagcttcagaggcatgaggtaacctgctcgagggtgagcaaggcctttcagagagaagacatagacataggccgggttgggtgacctctgcacatcagtctggcgacccgtgccccacaacatcacactccaagccccaatcatctagtccaagcagtccaacagaactttctatgataatgggaacattctgcacttatgctacccagtacaccagccactagccacaggtggctattgactacttgacctagggccaacacaacaaaagaaataaatttgttattttttattgtcttttacttatgtatttatttagagatgaagttttgctcttattgcccaagctggagtacaataacgcgattttggctcactgcaacctccatctcccaggttcaagcgattctcctgcctcggcctcccaagtagctgggattacaggcgcacaccatcatgcccagctaatttttgtatttttagtagagacggggttttaccatgttggccaggcttgtctagaactcctgacctcaggtgatccacccaccttggcctcccaaagtgctgggattacaggtgtgagcccacgcacccagctaataaattttttaatgtttcttttttttttttttttttttttgagatggagtttcgctcttattgcccaggctggagtgcaacggcaccatctcggctcactgcaacctctgcctcccgggttcaagcaattctcctgcctcagcctctcaagtagctgggattacagatgtgcactaccatgcctggctaattttggcatttttagtagagacagggtttcatcacgttggccaggctggtctcaaactcctgacctcaagtgatctacccgccttggcctcccagcgtgctgggattacaggcatgagtcgccaaacctggtctaatgtttcttttaattaatttaaatctaaatttagttagccacgagtggccagtggctaccatattgtgccatctctagtccactctgttctgcaagtctacctaaaatagtcctacgaccaacctgaacattcccctctgtgacaaggaaggcctccctaaaacctagccacatcctcatgtctcctacccacctggctgccaagacaaaccagcctttccaaagtggttatgagctcttctttactttcaagaggaaggaaggacagagaacgatgccaatgaaatctgttgagagtttatcatacgtcttggcacttggcacatgtgatgacatgggattgtcacacctcctgtctgtaatgagggtgattattcccattttacggataggaaaaccaaggcttcgagagaggaaataacctcttcaagggctgagatgtgaacccaccttggaatgattccacctcatcttgcaatctccctcgatcaaaccttcagcctcccatttcctttttttttttttttgagacagagtcttattctgtcacccaggctggagtgcagtggtacagtcttggctcactgcacctccacctcctggattcaagcaattcctctgccccagcctccccagtagctgggattacagatgcgcaccaccacccttggctactttttgtatttttagtagagacggcatttcatcatgttggccagcgtggtctcgaacttctgacctcaggtgatctgcccacctcggcctcccaaagtgctgggagtacaggcatgagccactgtgcccagccctcccaacacatttctaatgcctactttccttatgaggccaggagtaggtacctggctgcctgcaatactcacatatattagccctgagaagtaccgctccctcaggttgtgtagcacggaggcttcgttgaggcacgtcagctccgccatgtcctccaccttggagaacttgggtgggttcatcttctggatgtcatctttcccaaccgtgaccttcttgccattctccaccagctccacaaccacctcatcccccttctcctccttaatgctggctgcctcgaagccctgcttctccgaggggacccagacgagtctcttggcggcccagtcagcctgggccactgggctgttgatgaagtttttgtccacaaagaggaacttctcatcgtcactgagttggcccttctgcgccatggtgccttgttggtcccctgtggaataaggtaacagggtcagaatcagaccacaaccaagcccggaagacagaccaaccactcaccttgccctgtctaggaactcggtctgcagagacatcccaccaagtacaaagacctgcagtattgtgtatgtggtcaaagaacagagaccacccaaaggcccttcagaaagggatgtgtgtcatcgcctaaaataccaaaagtcagacaacccaaatgtccaccaacatacagctggatacataagccatgctatttccacactgtgaaatactacccagtgctcaggaggcaggaagtagggctggacaaggtggctcacacctgtaaacccaacactgtgggaggccgaggtgggcaaatcacttgaggccaggagttcaagaccagcctggccaacatggtgaaaccccgtctctactgaaaatacaaaaattagccaggtgtgatggtgtgcacctgtaatcccagccacttgggaggctcaggcagaattgctcaaacccaggaggcagaggttgcagtgagccaagatagtgccactgcactccagcctgggtgacagagccagactccatctcaaaaaaaaaaaaaaaaaaagaagaagaagccggaagtaagtgtacacgtgctaatatgggaagatggtcaagtctaactgtgcgctgcaaaataagagtcctcatacgattaaacatagaattacccagattccttgagcccaggagttggagaccagcctaagcaacatggcaaaaccttgtctctacaaaaaatacaaaaaattagccaggcatggtagcgcacacctgtagtctcagctacttgggaggctgaggtgggagaatcacctgagcctgggaggtcaagattgcagtgagccaagatcaagccactgcactccagcctgggtgacagagtgagactctgccttaaaaacaaacaaacaacccaaggtatataactggaaactcagtaaaaggaaagaaattatgcaataaaataaatgagtctcaaaagcatcatgctcagtgaaacaaatcagaaaggccacacgctctattactccttcaatacgaaaaactattaggctggtgcaaacgtaagtgtggttattgagatagaaggtaatggcggccgggcgcggtggctcacgcctgtaatctcagcaccttgggaggctgaggtgagtggatcacctgaggtcaggagttcaagaccagcctgggcaacatggtgagacccctgtctctactaaaaatacaaatattaatggagtgtggtggcacacacctgtagtcccagctactcaggaggctgaggcaagaggattgcttgaacccaggaggcggaggttgcagtgagctgagatcgcgccactgcactccagcctcggcgacagagcgagactctgtctcgaaaaaaaaaaaaagtaatggcaaaatagaaaaggcatatctatggtgacaggcaatcaagagttgccagaggaggccatgcacggtggctcacacctgtaatcccagcactttgggaggccaaggcaggggggatcacttgaggtcaggagtttgaaaccagcctgcccaatgtggtaaaaccccatctctactaaaaatacaaaaattagccgggcatggtggtgcacacctgtaatcccagttactcaaaaagctgaggcaggagaatcacttgaacctgggaggcagaggctgcagtgagccgagactgcaccattgcactccagcctgagtgacagagtgagacgctgtctcaaaaaaattaaaaaaaagagttgccagtggcaaggaaaggaatggattagtaagaggcacagaagaggtacataagaggtaagaggcaccacctttcggggtgataaaagtattccctgtggtcatggtggtgcttacaagactgtatacatttgtcaaaactcattaagaatgttctatccactataggatgagtaaagtgaacaataaaatattacatcgtttccaagagctagaagaaggacattgaatgttcccaacacaaagagatgataaatgtcattatataggaagtagcaaaataaaagtaatggcaaatgcttgagatgatggatatgctaattatcctgatcttatctccccacacattatatgtattaatatcaaaacattactaagagctggactcagtggctcacacctgtaatcccagcactgtgggaagctgagacaggaggatcccttgaggccaggagttcaagaccaacctgggcaacataagaagcccctgtctctgtaaaaaaattaaaaattagcctggcacggtggtgcatgcctacggttccagctactcaggaggctaagacgggaagatggctagagcccaggaggtcaaggctgcagtgagttgtaatcatgccactgcactccagcctgggccacagagcgagaccctgtctcaaaaccatccaaccaaacaactaaaaaaatcattatggaccccatgaacatgtatgattatttgtcaattaagaaataaattttttaagttgaaaaaactcactcaagctgtacacttaaaaaaacttgaatttgttttaaatcggtgagttttactttatatagattatacctcaataaagctgattaaaatatttgtcataaagtatttgtcttcattttatatgtttgtgtgtacatttctaaaagtctagaaaactgcataccaaaatattatactagggttctatctggtcaaatacgagacagtgtgaatatcaataagaaaaataattatatgtccatcaccctaacaccccaaaaagggtggaaagacaaatatatttaaatgcatttgttcaaaatgatttttgttgttgttgtttgagatggagtcttgctctgttgtctatgctggagggcagtggtgcaatcttggctcactgcaacctctgcctctgggttcaagcgattctcctgccttagcttcccgagtaactaggattacaggcgtgcaccatcacacccagctaatttttgtatttttagtagagacggggcttcgccaagttggccaggctggtctcaaactcctgacctcaagtgatccaccagcctcgggctctcaaagtgaagggattacaggcatgagccactgtgcccagccccaaatgcattattttttaaatgggtacagaaagtggggtggaaatgtgaaaatcttgattctgcgttttctatacaaattgttccttagggtaactaaattaagaaggggaagtctctcttgatggaagattaggtcattaaatgtcctgtctacatgggaagcccatggatggtagattcacgttatctgtcgttatccagatgtgtttatgaggagagggacagagacaacacactctataggcctgtccggccccccgttcctgactctctgaccatagctgcaggggctgtcctggaaacactggcttacagccccttctacctcttgctgctgggctccaaagaactgagttgctggctaagtgaggacatatggccaccaggatctatgcgtggttgacatccctccttcagcagggaattcacaactcctttgaattcactgataatccccacgcttgggccccaaatcccacagcgacagaataaagacccatgtcccactcctggatccctagagctgagcagccaactcctgaaacccaaccttttgggtgatgcagattttgcaagacagaatgggagtggcagatattccaatacctatttttttcctttcagggctgaaaataataattaaaaaactaattttaagaacctgctgctgggtgcagtggctcatgcctgtaatcccagcactttgggaggccaaggccggtggaacacctgaggtcaggagttcgagaccagcctggccaacatgtgaaaccccatctctactaaaaatacgaaaagttgctgggcgtggtagcatgcgcctacaatcccagctactcgggaggctgaggcaggagaatcacttgaacccgggaggtggaggttgcagtgagccaagattgtgcctctcaccgcactccagcctgggcagtaagagcgaaactcagtctcaaaaaaacgaaaaacaaacctggaagttgatttgctcagagattttctgctgggagacctgatatcgtagctgatgaaaaaaaagtggcggctaggtgcggtggctcacacctgtaatcctagcactttgttggggctgaggtaggaggattgcttgaggtccggagttcaagaccagctggccaacgtggcgaaacctgatctctactaaaaacacaaaaatattagctgggcttggtggcaggcacctgtaatcctagctactcgggaggctgaggcacgagaattgcttgaacccaggaagcagaggttgcagtgagctgagatggtgccactgcactctggcccaggcaacagagcaagacttcatccaaaaaaaaaaaaaaaaaaaaaaaaaaaagggcagagaaatgaggaaatcccatctaaatctgaataatcacttcagatatccagaaagagaaataaagatctggtagacaacatgtattgtcctaagtttaacaatcctcctttctgcattttaaaattgttattgaatttggcttagctcatagtaagaccaacagtgtcctgcccctgactccagttaccctatcttaaaaaagactcccttctacatggaagaattccagcgaatacatgcagaacaataaaactaggatgtaactgtttataaagctaatagtgggtctcaagctgggcacggtggttcacacctgtaatcccagcactttgagaggcccaggtgggcggaccacctgaggtcaagagtttgaggccagcctggtcaacatgggaaaaccctgtctctactaaaaaatacaaaaattagctgggcatagtggcatgtgcctgtaattccagctactcaggaggctgaggcaggagaattacttgaactccaaaggtggaggttgcaatgagccgagatcatgccactgtactccagcctggacaacagagcaagactttgccaaggaaggaaggaaggaaagaaagaagaaaggaaggaagaggccgggcacagtggctcacacctgtaatcccagcactttgggaggctgaggcgggcagatcacgaagtcaagagatcgagaccatcctggctaacacggcaaaaccctgtctctactaaaaaaaaaaaaaaaaattagccgggcgtggtggcggccgcgtgtagtcccagctactctggaggctgaggcaggagaatggtgtgaacctgggaggcggagcttgcagtgagtgggtgagtggagatgcgccgctgcactccagcctggacgacagagtgagactccgtctcaaaaaaaaaaaaagaaagaaaggaagaaagaaagggtcttggcaagttggcaagttctaccagtaattgctaaaaccattaggccaatggggctcacatttcctggtgcattagcttctgagtcagtaggactgggatggggcccaagaatatgcattcctaaccagcttccgggtgatgatgatgatgctggtctagggtccccaccacaagactgactatatcagatgaagagctcttgtggaatttttaagggatgggtccgcctgccatcacctaaatctactaattaaccctaacatcacaaaaagagagagctgactagacattataaacattacatgcctgcagatgggccactacaggaagtgccgttaccactaatgacatattcttgctcaaaagaaaaggggatggagatgggggatgaaggtgatgaagcctccagatctgacgcctgtctatggaaaatgcaaggcacaggagagcatgctaaacaatgcagtaaactcccaaaggtgagagactatgctctgtcgcccagctagagtgcaatggcgggatcttggctcactgcaacctccacctcctaggttcaagtgattctcctgcctcagcctcccgaggagctaggattacaggtgcatgccaccacgcctggctgatttttgtatttttagtagagacggggtttcaccatattgtccaggctggtctcaaactcctgacctcaggtgatctaccggccttggcctctcaaagtgctgacattacaggtgtgagccaccacgctcggccagtactctctttctttaacaaataaaatacaaacaaaaaggaggggaacccatagattaaaaaataattgaaagaaaagaggctggcagtagcccacatgtataatcccatattttgggaggccaaggcaggaggattgcttgagcccaggagttcgagaccagactgggcattatagcaagaccccatcccttaaaaaaaatatcagccaggcatgatgatgcgtgcttgtagtcccagctactaggaggctgaggcaggagggttgcttgagcccaggagtttgaggctgcagtgagctatgattacatcactgcactccagcctgggtgtcagggtgagaccctgtctcaaaaaagagaaagccacagagaacgagaacatttcataaatatagggcattttcattagcctaaaagatctttctgagcctaaataaagtacaagttcattggtgctggcaacatttgattggttgcctcctcttgagaggtaagataacctgtagtcatgtaaagacacccagactttgcaatcagatgctaattcaaacgtgactctgccactgcagaatgcgtgcttctgggtgacttacgtagatctgagactcagatttactgtatattaatactggggacctaacgggtgccctgcagagctgccatgaagtttagatgaaactctctacaccaagcttgtctaacctgcagcccacaggctgcatggggcccaggacggctttgaatgtggcccgatacaaattcataaactttcttaaaacagtatgatattttttcgcgatttttttttttttttttagctcatcagctatcattagtgctagtgtattttacgtgtggcccaagacaattcttctttttctggggtggcccagggaagccaaaagataggacacccctgatctacaccaagtaccttctgtttctataccctttctcacttccggtgactctaagccacttcgctcattcctaaccaatagcatttactactgttggatgttttaattatgtttatttctggacagccatagtcacagaagtggcttgatacgacgcgtcttcttttaatagtataaccaaggttagtttaaacaggcagcaaaataggaaatgcggcaaaatattcaatcattccctgataatctcttgtttcttaaggtgtcgcagcagatcgtgtgtgtgtgtgtgagagagagagagagaaaaagaaggagagagagagagagaaactggaggatgcgtaagagaaatgggagggtgtgaagatgaagtaagattgatcacaagtaggccgagtgtgatggctcatgcctataatcccagaactttgggaggctgaggtgggaggataacttgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccgggaggtggaggttgccgtaagccgacatcataccactacactccagccttggcgacagagtcagcctccatctcaaaaaaaaagaagtgtcagagctgggacccaaacctgggtctcattctggagtctatttggttctgcctttcacataaggtgggtgggcttgtcagatgcccataaaggaatcaatcctgtaaggcacctggcacagtacctgacacattacaaacacccaaaataggactcgaatcaggtgaagtaaactacagctccacaccacaaaaaaggacatctcacaacacatccttgagcaaaagaaggtggtcacaaaaagcacaggttctgtgactattgaactgaggtccaaaaccaggcagaattaatctacggtgatagaactcagataaggaatgaatgagtctccggtgtgcaatgattgcaaggacagaacgtgaggggggcttgtgagggttgacctctagatcttcatctgaatgccagccctatgagtgttcactttctgaaaattcatcaaactgttgggccaggtgacatggctcacgcctgtaatcccagcactttgagaagccaagatgggaggaccacttgagcccaggagtttgagaccagcctggccaacacagcaagacccatctctaagaaaaaatgttttttaattacctgtgtggaagactgaggtaggaggataacctgagcccaggaggctgagaccggcctggtcaacatggtgaaaccttgtctctagcaaacatacaaaaattaaccggttgtgatagtgtgcacctgcagtcccagctactcaggaggctgaggtgggaggatcacttaagctcaggaggtcggggatgcagtgagccatgatcatgccactgcactgcagcctgggtgacagagtgagacccccatctataaaaaatatatcctcttgaaaattcatcaagctgcacacttttttgcacatcaagcgtacttttttggttgtaaagtacacttcattttccttccctcttatctttaattgtggtaaaatacagctaacattcaccacctcggccacttaaacacagttcagtagcattaagtatattgatattcttgtgcaataatgaagagtttgtgcagatggtagccaattacatcccaagagggctaggagagtgtttcatttgttctaagcactatgacaagtaaagtggacttcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattctttgtagagacggggtttcaccatgttgtccaggctgaggtcttgaactcctgacctcaagtgatctgcctgcctcggtctcccaaagtgctgggattacaggcatgagccgctgtgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtacaaaaaaggagagcttggagcaggctggattccctctggctttgatgtctctgacagttacgacgtgcaaaatctgctttggtcaaaagacagcaagatgggggatgagaagcttcgactcatgctagaatggtgttttccatagcatgccccttggaaccctaattccctgaaatatctgggctggggtggagctgcggaggttgagaagctcttcaaacagtggcgcagtcaaggtcaaatccatctggaaggtgctacatattcccctttccctcattgagacacaaaacacacaacaggacacttgagtctctggcagatccggaaacctgaaagctgttttgctcctacgagccttgggtccccaaaacaacatttagccacagatttgccaaatgttttgagaatgttttcctaaaaatttgccaaatttttgagaaaattcagtgagcctgacaaattaataatactaatactagtaataatagttgctaagtcttttttttttttttttttttttgacacagagtctcgctctgttacccaggctggagtgcagtgacgcaatctcagctcactgcaacctccacgtttctgggttcaagtgattctcgtgcctcagcctcccaagtagctgggactacaggcatgcgctaccatgcctggctaatttttgtatttttagtagagatgaggtttcaccatattggccaggctggtcttgaactccaggcctcaagcaatcctcccaccttggccccccaaagtgctgggattacaggcgtgagccaccgcagctggccacaaactctgcactgtgactcttgggctgcgtcattctgtgtcgtgaggggagctcttccgtgcattgtgggatgttccgcagcatccctggtctctgcccacctgatgccagtagcaccccttcctccactcatgacaatcaaaaatgtctccagacactgctagatgtcccctggggtggcaaaactgcttccagttgagaaccacagctttagaataaaaacaagggctgtcttgggaaaggcagttaaagctgagagcagctctcacttagtcaaactcaactcggaataccaactgcagaagatcagacgggggcaaggtgaacacactggaccagagacggaccgccagttggcccaaccccagggacactcttcatctaccttgatgcaccttcccaaccctccctcctccaccatcgctcatgtttaaggtcctgcatcagctccaagggctgaaaggacatctctgaaattactacccagaactgctgaccacgaagtacagttcactcatcaagagctgctctcaatgtttttggttgggggaagggtctcactatatgcccagggtggagtgcagtggtgcaatcatagcttactgcaggctcaaactcatgggctcaagggatcctcccacctcaggtgtgggccactatgcccggcttattttttgtagagatgggggtcttgctattttgcctaggctggtctcaaactcctgatctcaaatgatcctcctgccttggcttcccaaagctctaggatgacaggcgtgagtcacctcgtccaactttctcgaatgtttggatgaaaacaaatgactctgtcacctttggcattagcgatgtttgacacatctgagtgtgtcagccttgtttacagtcctgtcctgaccaacaactgcttcattctttttttttgagacagggtctggctctgttgcccaggctagagtgaagtggcgcgatctctgctttctgcaaactctgcctcccaggctcaagccattctcccacctcagcctcccaagtagctgggatcacaggcacgcaccagaacacccagctaattttttaattcttgcatttttttgtagagacaggggtctcactttgtggcccaggctggtctcaaactcctgagctcaagcgatctgcctgcctcagcctcccaaagtgctaggattacaagcatgagccaccgcgcccaggctgcttcattttttgagcacaaacaagctaatcattagcctctggaagaccttaggatgtcaagtaacgagtctcagctttgccccaaacctgctgggtgactctggacaagtcacttgccctctctgggccttgtatttttcatttagggaaaataaatcaatggtaggctggcccagctctaccattttatgggacccgtctgtgactcccagtcaaagggctgaaactggaccaactgagaatgtcaggttgctttagtttgttttaccatcagtttcatttttcccagaagaactcaggggcaaaagatcttgccctctctgcttcagcattaataaaaagtaaattaggccgggcatggtggctgatgcctgtaatcccagtacttcgggaggccgaggcaggcggataacctgaggtcagtagttcaagaccagcctggccaacatggtgaaaccccgtctctactaaaaatacaaaaaatagccaggtgtggtggtgggcgcctgtaataccagctactcaggaggctgaggaaggagaatcgcttgaacccaggaggtggagggtgcagtgagctgagatcccatcactgcactccagcctgggcgacaagagcaaaactctgtcttgaaaataaataaataaatagtaaattaaatatcccagagcccagagagtataggatttgcacatcacctcacctggtcaacagcttccctcaggattttactgccaagccattggctaaagattttggaccagagacaaaaacccaaatgtttttggagatcaggtaagtaatacagagtgacccagaccagatgttagagtattgcttatattctaaataccatgcagggttcagcactgtggctcacgtctgtaatcccaacactgggaggccaaggcaggcagttcgcttgagcttaggagtttgacaccagcctgcgcaacatggtgaaaccccatctctacagaaaatacaaaaattagccaggcatggcagcacatgccggtagtcccagctactcgggaggctgaggtgggaagatcgcttgagcctgggaggtagaggttgcagtgagccaagatcatgccactgcactctagcctgggtgacagagtgagactccatctcaaaaagaaaaaaaagaaaaaagaaaaattgctcatattctaaatgtcataaagggctggatacagtggttcacacctgtaatccaagaactatgggaggccaagccaagaggattgcttgaattaggagctctagactagcctgggcagcacagtgagatcccatctctatttcaaataaacgaatgaatgaatgccacacaggcaaaacagaagttctctgaacctgatctgcaacacaattcgccagctggaaggacctctgcagtggaaatcctcgctcaaggcctggtccaggtgtagggaggcatcaaatgtgtcgcagggagaggcactgggcactctaaatgcacctgcttggcaggtccccagtagtaccaaaaaggcagtttagatctattattcataacagccactgtatttattgggccccttgtattcatcaggtatcaggccagacagcttcctatatagaccatctcactgtctcctaagcgctctgtaaggtggcatcacctgctattgctattttcctgctaagatgaccgaggtcctggaaggtaaatgcaagacccccacttgtaaaatttggagtcaggagtacaatccagaatctaatcctagttttctgctaagagtaaatggacacccgattaattcttagcagaaagtccctttcttgcccctgaccctactccaccatttctaccctcccctcaccattcacatccccccacctcccaagggcttgttcccaagaaagccctacttcacttttacaggaaaaaaagtgaatggtgaacctgtcacattcttattgccttgtgacatctgcctaatcatctgaataccaatggtttcaagtaactccagaaagaagttctcttaatgcataacactattttttcctcccaaccaagagaacttggttggcaagagttacggtagcccctgtgaaggatgcttctggaagcgagcaagaactgattatttctggccctaaaagccccactgtgttttatattttacaattctggcataccacagcttaaaataaatgtatagtctcctatgtcaggggtccccaacccttgtgctgcagtatcagtcaatggcctgttaggaaccaggccacatagcaggaggggacggtgggtgagtgaccatcactgcctaagctccgcctcctgtcagataagcagcattagattttcacagaagcacaaaccctattgccaactccacctgcaagggatctaggttgtacgttccttatgagaatctaaccaatgcctgatgatgaggtgggacagtttcatcccaaaaccatcctccccactccaccctggaaaatattgtcttccacgaaaccagtctctggtgccaagaggatggggactgctgtcatatgtgactgcaacaagttgcaatttgcaatgcctttttttttttttttttgagaccgagtctcactctttgcccaggctggagtgcagtggtgtgatctcggctcaatgcaacctctgcctctgaggctcaagcgattctcgtgcctcagcctcccgagtagctgggattacaggtgcccacgaccatgcccagataatttttgtatttttagtagagatagggtttagcagagaccatgttggccaggctggtcttgaactcctgacctcaggtgacccacctgctgcggcctcccaaagtgctgggattacaggcgtgagccactgcacctggtctgcaatgtctttagccagtcatttgcaatatctattaattttagatacgcatgccctttaactcagcaagcgcatttctgggaatttatcctacagataaattcatataattagacaaaaagtccaaggatgaaagagtggcattatctattattcccattttcctgctaagcctatcggggtcttgaaaggtaaatgcaaggccctcccttgcaaaagttggggaaccaggattagaatcccgatctgtttgaagcctaatttactcagagatggcattagcgatgtttgacacatctgaatatgtcagccctattcacagtcctgtcctaacaactcactgcttcatcccttgagcacaaacaagctattcattagcctgtggaagatccttaggtcttcgagttacaagtctcagctctgcccaaaactcgctgggtgatgctaggcaagtcacttgccctctctgggccttgtatttttcagcctggtacagtaaagttctatgcccctcaccttttttttgagacagagtctcactctgttgcccaggctagagaacagtgatgcaatcagggcccacggcagccttgaactcctgggctcaagcaatcctcctgcctcactcaacctcctgaataactaggactacagatgcatgccaccatgcccagctcattttaaaaatttttttgtagagatggtgcctcgctatgttgcccactctggtctcaaactcctgacttcaagccatccccccacctcagcctcccaaattgctgggattacaggtatgacctgccatacctggcctctatggccctttcctagcaactttgatgaggttgttcctccttagcccctgaaaccctgatacaagtcacagatgtccgacctcccctttcagccactgtgagcagcttcttcctctgtccttggatcacatacaaggtttctttcaaattcttgcctgcctttctctaaattcagtctttcctccattgtgtggccagggttaaaagttgaaaggtcaggagtggaaggagaagacctagagagcaaaaaggccatcccttaaagtatgccatcaagaccctaaataagccaggcgcggtggctcacgcctgtaatctgagcactttgggagaccaagccaggcgaatcacttgaggtcagcggttcgagaccagcctggccaatatggtgaaaccccatctctactaaaaatacaaaaaattagccaggcatggtggtgggcgcctataaacccagctactctctactcaggaggctgaggctggagaagtgcctgaacctaggaggcggaggttgcagtgagccaagatcgcaccactgcactccagcctgggcgacagagcaagactctgtctcaaaaacaaacaaacaaaaccctaaacaaatgtaattggaatttgtaacattcccaatccaggtaaggaatggtagcttaatatattaaagattctaatcaccactttcagcccaaatagaaacgaggtttatgagatcaaagggaagaaaattaagagaagcttctcctttaacggccacatagtttaggcttcccggttctgccaaagatgagccatgccatactgagcaaacatcttgaactctctggttgtgtttgctataaataaccatcactgaagcttaccaggggccaggcactgtgctaaacccttcatacacattagctcatcaaatcctcccatgagggtaatctgtgaaactctggagttagaaagacctagatttgtagaatcttcttttccttactggttagctgagctatcttaagcaagttattcagactccatatgtgtaaaataaagccagttagaataacagtatctactctaaagggttgttatgaagacgtaagataatgtccacaaagcgtttagcatctcgccaggcaaaagtgcccaaaaaacatgagttattctcattagccccatttcccggatgagaaagtgaggtttggggaggtgcgggagatgatttttaaatttgcttatggccttctatgattctactggattgaatattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaactgacgagggggccggggatggcctcatggaaaacgcttccataaatgggcatgtttgcctcaatctctgccctcccacggaaaagtaatgataacaaatccataacagataccttgtacggaataacacatctatttcggacatgataataaaaaaacatggtgtttacaaggcaagcctggcggcttctcggaaaagacccagctagttcacgttctggactctcggcatggcagcccacctagggtcactggtttcagctaggtcaccccctcaatcaggggacaaacagtgccttttattttaaatgtgcaaaaagtcagtttatgttttcttcaaaggacacggtgataaacatttactttgttggaagcatttagtcccaccagaaacctgaccccaacaagtttgtgtccatggtaaagaagaaagatagtggggtcaagggtatgaacttggactcaaactgacccgggaatgggttctaccacttgctggctgtgtgacactttacctctctgagcctcagctgccttgtatactaaacaggcatcataaagcctttcttatgaagttgttgcaaagattaaatgagataaattaagttaaatgttgcaacagcatgtggcactgaagtgttccatcaacggtagctatctcaaagggaaaacatcaatttccttcaaacaaaattctctatcttatttcacaccctgccacctaatgactttcagttcagcgtcaagttccgtctctgaacaattctaaaatagtatcgttgagtaaatcaaagaaacaaaaaactatgcaaagcagtttattaatagcctgcattctttttgccaaaccccggacggacagttcaccatttaatctctcagttcttcatactgcaactaaacactcccaccttgggtttctaaatattttcttttacttcttgacaagcatggctttggatggtaccttttctcaagtggcaaaatccctaccagaccctgtgctggaagaaaacttacaacaggcagtagccacactttctctcgttttacccatttggttgggcacgagagtggcattgacacaggtggctctgcgggaaattctagtgtaatcttacctaacgcacctgcagatcgtggaagcaaatggagactttggagcccacctgggtatctgggggccctttggggtcaacctgggtgagttgttttttttttttttaatttggagaagaggaaaaagtgggctgtaacaaactagatcacaaccagccttatctcccaggggttctcaacatagaagaacctcccctaaactgattaaaaaaaaaaaacaacaacactcctttctgctaagcctatgcccatgtgtttttaactgatttaatgcattatcaacacaactgtgcaatacggtcaaatccacaaggagcctcactttgcccttctgtgtgatagcaagtgacttttcagtgaagttcagctgtaaattttttggtgcctagaataaaagtgagatgccttgattgtctgcaccggacctctgagatttccaagggagcatatctcctggattagcctcttaacaagaatcactcgggactaatttttttttttttaaggcagtttttctggggattctagagttgggaaatggagttgggtccaggcattgatatcgttaataagcacccccaaaatggtacttctcactggcaatcttaagaaatgctgtttggggaaagtctaggataatctaagacgataaggcagagagagatccaaatcacaactctgcccccaccatggcccttacgaggttgacaacagggacccctaagtgcaccccagcccctatagaataccctataggacttttaacacccccctgccctgcaatctgcccccagaatgacaactactacttacagatctccaactggggggactagtggagaggaaactggatggcgagctcggatctgacgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaagagggccggctgtgcagcgtgaagggtagggaaaggggatttcttgaactttgcaaagtgcaagacaggaggcccccacccttgctgggaaccgtgcaggaaggggaagtttttacttttcccaacttgccatctccacctccacccacatcaccacgaccaaaatacaaataaaaattaaaaataagcccactgtgattatttcagctgtccccctcccctgtgcgccactcgccagctgcgtgaccttgggcaagtcacttcacttctctgagacttggtgtccatagctacaaaatgggggaaggcggtggcggtgataattacgttatttacaagatgcaagtgtcaagatccaaggagaaagtgggtgtgcccccagagtctgcgagttcccttcaacaacttcccttccccaaggattcctcgcctaaaattgcattccctgtctctctccatcacaggctctctcgctctgtctctgccactgtctctgcatgtctgtcactctgatcattgctgtctctcgctctatcttttgtctctgtccctctcgcttctctagatctgtcgatgtatctgtctctccctcctgtctcactttgtctctggtctctgtgtctcttgctctccatctctcccgcgtgtctcactcctatctctgcgctttctctctctctcttccccaggctctccgtcttctccccgtccctccctccccgctcctgtccacgcacgcacacacaggccataaaaggaagtcgaggcggtgggctggccccgcgccaggccggggacccgcgggcagcccgggcgctccgctccccgcgcggcaccagctcctccgaggttcccgggccgggccgggccgggccggtccccctccccgggagcggcgggagcggcgggcgggagacaacccaaaaagggcaggcgcggactccttcctgcaggaattcccagcgccgcataccagctctgggctgccggctccccctgactaaatatggtgccgagtggccttcctgctccccggcgtcgggggagggggcccttcacgcagccaccggccgccgttgccccgcggggctagatggggacccctctgcttggggaaggcccggaagggggcagcccccagtcccacgtgggtttctgctgcttcaggctagaggatttggagagagggttaaagttgggcagacccctcctgggttctgtacttgacgcaggcccttagtctacaaccactcctcttgcaaccaggtggaggggctgggggccgggggtgcggggggtggctttattaatacccccattttgcaggtgagaaaattgagtccctgcaggggtaaagggatttgaccaagctctcactgggacagtcattgattggtgctggcactggaacctttctgatgacaccattcacttccagagaggagacattaaagggaaatgcccaggcaaactggccttgaggcccagggcgtgtatctgagagtagatgtctggctttgaatctgccagtgctgctttctacctatatgaccatgggcaagtaactttgcctctccatgcctcaatttccctacctgtaagatgggaagaacatcagctacttcctggcctttttgtaagcagtccttgagatgatccatgtaaaatgaacatggtgcaccgcttcatgtgagctgctgttactcgcaacaaacatgaaaccaactagagttgcaccaggcctccgggatataaagagaggcctcttcccctgcaggctcccaggcccatctggagagctctgcatctcagacccttttgggtccttcttcatccttccaacatcaagcttacctggttttcaccctggaaactcctgagcctggccctcaccctgcaatgggcctagatcagagagtcaagaacagcctgcatttagctggctggggaagtgaggggtaaagctctgcggaaaatgatgaatgagctgctccgcacaggcttttaacatctacgctgtaaaaggagtggaaatcgtccctgcatcagcacagaaatgatgtggagcagagaagtaacggaagggggaaaattgaagtcaatcatccgcttcccatcctggaaagggaaggccatcggaatctagcttgctggcctcgaagtaaaaactggcattaatactagaggcatgaacactgtatttccaaagggttccattcgattctttaaataacttgttggtaacttttaaaagagaataattataatgtgattaacaactggagactgtaacactcaattttacttcattctctcacctaccccttatataacaaccctttattaaaaattaaagtaggcagccgggcacggtggctcttgcctgtaatcccagcactttgggaggccaaagtaggcggatcacttgaagtcagaagttcaagaccagcctagccaacatggtgaaacccccatttctactaaaaatataaaaattagctgggcatggtggtgcacacctgtggtcccagctacttgggaggctgaggcaggataattgcttgaacccaggaggcagaggttgcagtgagctgagattgtgtcactgcactccagcctgggagcctggatgacagagcaagactccaactcaaaaaaaaaaaaaaaaagcaaaactaaagtggccaaggccaggcatggtggctcacaactgtaatcctagcactttgggaggccaaagcaggaggattgcttgagctcaggagtttgagaccagcctgggcaacatagcaagaccctgtctctacaaaaaataaaaagttagccatgtgtggtggtgggtacctgtaatcccagctccttgggaggctgaggtgggaagatcacttgagcctgggaggcagaggttgcagtgagctgagactctgtcactgtactccagcctgggtggcagagtgagaccctgtcttgaaaaaaaaaattttttttaagtagccagcctgggcaacatggtgagatgcaatctcaataaataaataaataataaatagcagctgggcgtagtgtagcctgaagttccagctactagggaggctgaggtaggaggatctcttgagcttggaaggttgagactacagtgaactatgattgcaccactgcactctagcctgggcgacagagcaagatgttgtctctaaaaaataaggtacatactttaattccctccctacccccattttattgttgagaatctaggtttggaggggttaaataacacagcagtggtggaacaggaattccaaccccagtctttctgacacaggccatagtagacagcagtctgaggttttaaacccagatctcttaagcaccaaccaagcacctttgggattgtcagtaaacctctctgagcgcattttctcaaggaaaaacaaagatgatcagattctttgcctcaagtacctttctgattgttaaatatgacagcacatgtgaaggcctttatgaaccatctccgacctctctagtaccctctggaagcaggcagggacagtatgttcacttaagagtcattcaatagatatgtgtccaatgcatgaagttccgatgtttgaatcttcagaagtgcattgttatcattcgatcagatgcctctgtttcatttctcatggctcaaaaggtcagttcttttaagatggaggaggcaatagtctctttttaaaatgtcactttgactgagtgctgtcaagtaattttccttggcatatctttttctgtgaccggctgtttaatgggagtttccacgaatccatgaaacaagacagccaaggggaaatttctctcttatagtctttttttgctgttggcttaaaaaagccccaaagtggctgggcatgcctgtaatcctagcactttgagaggctgcagcggaaggatcgcttgagcccaggagttcaagaacagcctaggtaacatagcaagatccctgtctctacaaaataataataataataataataataataataataataataataataattagtcgagcacagcagtgtgtgcctgtagtcccaactagagagtgaagtaggaggattgtttgagccccagagtttgaggctgcagtgaactgtgatcgtaccagtgcactccagcctgggcaacagagcaagaccctgtctcaaaaaaacaaaacaaaacaaaaccatgaagtgtgatcccctccaatttttagtaacatcgaagattgggtctgagcatggcttactcctgcatgtgcctcaagatttaatattttttggccgggcacagtggctcacacctgtaatcccagcactttgggaggccaaggtggagggaacacttgaggtcaggagttcgagaccagcctggccaacatggtaaaaccctatcactactaaaaatacaaaaactagtcgggtgtggttgtgcacgcctgtagtcccagctacttgggaggctgagacaggagaatcccttgaacctgggaggtggaggttgcagtgagccaagatcacaccattgcactctagcctaggctagagagagaggctccatctcaaaaaaaaaaaaaagaagatttaataattttaaagtgttatcagccttgatctacttgactcatatagagtcaggtagatctggcccaagatctgtgaataaaggaacatcgttcctgaccacaagcagggccatgctccaactcttgcacaaaagcacttttgtttcactcatggtggcccccatgatggacctcacacttctcccgatactagactgcattgcatagtaacctgcaatgctctttccttcatcatcagtttccaattctgatgtcacgatttggttcatgacattcctgatagattctctatgtctatcaggaagggtcctaaaactctcaataaaagtagttctacagttttttaaaaatgaaacacacagggcacggttgctcacgcctgtaatcccagcactttgggaggctgaggcaggtggatctcctgaggtcaggagttcgagaccagcctggccaacatggtgaaaccccatctgtactaaaagcacaaaaattagccaggcatggtggcgggcgcctgtaatcccagctactcaggaggctgaggtgggagaatcgcttgaacctgagaggcagaggttgcagtgagccaagatcatgccattgcactctagcctgggcgacaaaagtgaaactccgtctcaataaaaaaacaaaaacaaacaaacaaacagaaacaaaaacaaacacgctcttaccatataatccagaaaattcttcttaggatttgcccaaaagagttgaaaacttctgtccatacaaaaccctgcacgcacatgaagtttataacagctttactcactatcgccaaaacttggaagcagccaagatgtccctcagtaggtgaatggatacataacaatggaatattattcagtgctaaaaacaaatgagctatcaaggcatgaaaagacgaaggaaaattacagctgggcattgtggctcatgcctgtaatcccagcactttgggaggtcaaggcagatggatcagctgaggtcaggagttcgagttcagcctggccaacatggtgaaaccctgtctctgctaaaaatacaaaaattaaccaggtgtgatggtggacacctgtaatctgagctactcaggaggctgaagcaggagaatcgcttgaatcagggagatggagtttgctgtgagccgagatcgtaccactgcactccagcctgggtgacagagcgagactctgtctaaaaaaaaaaaaaggcaggaagaaaacttaaatgcttgttactaaatgaaagatgctaatctgaaaaggccacgtactgtacgattccaactatacaacattctggaagagacaggaataggtggagtagagaagattttctagggcagtgacactcctctgcatgatactaaaatggtgaatacatgtcactagacatctgtccaaaaccatggaatgtgcaggcagtccccaacttataatggttaaacttaacgatttttcaactttatgaaggtgggaaaatggtgcattcagtgaaaccgtactttgaataccgacaaaaccatgttttttcactttcaatacagtattcaataaattacatgagatggtcaacactttattataaaataggatttgtgtttgataattttgcccaatggtaggctaatctaagtgacctgaacatgttaagtaggctaggctaagctaagatgctcggtaggtgaggtgtattaaatacattttgggctgggcatggtggctcacatctgtaatcccagtactttgtgaggctaagatgggcagatcacttggattcaggagttcgagaccagcctgggcaacatagtgagatcctgtctctacaaaaaatacaaaaattcaccaggtgtggtggcatgtgcctatagtcccagctattcaggagactgaggcaaaggaccacttgagccttggaggcggaggttgcagtgagcccagatcgcacaactgcactgcagcctgggtgctagagtgagaccctatccaataaataaataaatgcattttgacttattttcaacttgtgatagttttgagatgtaatcccatgagtcaaagagcatctgtacaataccaagagtgaaccctaatgtaactatggactttttgtgataataatgtgtcaaaatagatccacccattggaatacatgtgccactcgatgccggatcttgacagtgggagaagctagacatgcatgggtgcagggggcagtcaggagctctgtgcttccagtccatttagccatgaacctaaaactgctctaaaaaacgagtctacttttataaaagtagttttgttttgttttttttttccagagaatagtctcactctgtcgcccaggctggagtgcaatggcgtgatctcagcgcactgcaacctccgcctcctgggttcaagcgattctcctgcctcagcctccccagtagctgggattacaggcacatgccaccacgcctggctaattttgtattttttgtagaaatagggttttgcgatgtttgccaggctgctctcgaactcctgacctcaggtgatacgcccgccttggcctcccaaagtgccgggattacaggcgtgagccaccatgcccagcctaaaggtagcttttttttttttattttttattttttgagacggaatttcactcgttgcccaggctggagtgcgatggctcgatcttagctcactgcaacccccacctccacagttcaagtgattctcctgtctcagcctcctgagtaactgggattacaggcgcatgccaccgcgcctaattttttaatttttagtagagatggggtttcatcatattggtcaggctggtctcaaactcctgacctcaggtgatccacccgcttcggcctcccaaagtgctgggattacaggcctgagtcaccaagcctggccagcagttttatttcacttttattttaataagattcctgaacaccacacaatcctcgaatcgtggttgttaccaaaaaatcaagtaccaagtggccgggaagcattgtcccaaatgcctttaaaggcatattctcacaaatgttcatctttcatgtacacttggctttaaaagaacacatcaaattttacatcaacataaaggtatgtgagtgatacacaaatgtgttcttgcacatcattataaggctattagtttgttctgtgcaagcatatacactaagcttaaatttatcttcttcaaaagccacctctgctcctgctatgaggttttagatcacccaagttgtacatttcctaaatccctcttcagttcccattcccatcctgtttttgtgtaaatccaagttttctcctaaaacttctggagcatctctagaagataagttctcccgacaattccaagaaacccacgagtaaggtacttaaatataacacatttatgagaagggttggcttgtcctctgtgcttttccttccttcctataaacatgtgcagacggcaggaaagtacccccgcctccacccctcaacagcgaagcttctgaagatcccgacggaaggcatggcagccatctccaatcattcttctgtttttgatgtgtggcttttgatgagagaacagtgatatgaacaccctttgcaccaaagtgacttgcttattttttttattaaatgatacattgaaagtataaaaagttgccgcagtacaaacaaattacagaataatgcatataaaagcgctatggactacacgtgacaattctgcttaacttccatcttgatgattttatatcagtatccaaaattatatactccagcattttttccgaatatagtcttacatgattgcaattcctgaggtaaactaagtgtccactgccaacatccttggacgaaaaccaagtcccccgggagaattcagatatttatattcacacatacaatacaacggaattcatcaatgtaatcagatattgcagatttaaaaatggaaaatggactcttgcaatacttctgcatccatatataattttaccagcagggcctcccaaaatgttgtgtaagtatagtttaaatggatttcattaataagtttctgcatttagataaaaattcttggctaatctgtaagaagtgaacactgactagcattgccaaacagaaaatcaaaagtttcaacaatttgcaaagcagcacagaattgacaccctaaagaggatgccaattttgctaactacagctcttaccactcttctccatggaaaacctttaagctaaatgttgtcagtgtttaggtgtgcaggcaaaatttaattctgaatataccatcgaacttttgccaatcaggagctgtctatcatcatagtcagttgttttcaatgaaatgagcctgtggacactacattaaaaatacttctttaataaatatcgaagtagcgtattagagatagcacatactatttttctatcccaagaataaaaattgatgtttggtaagagtttcggagcccaaacaagtagggggctggccctcttctggctcatctgtgattgcacaaccgagggccacacggagattaaacaatgccatctttgaaaaatccctttctggtatttctcccaaagcctgtctcttcatgcttacttcacattctttatctaataaaataaactctttgttttatttacagcaaaattattacagcaaatttacttctcctctaccttttaattaaatcttccagtaagccaaagtctaaggaaagaaaaagtacattgttgcctattgaaaaggtaatacaaagccctttcatttccttacaaactttaagggcctttataatacttcctaaatggctgggctcagtggctcacacctgtaatcccagcgctttgggaggctggggcacacagatcacctgaggtcaggagttcaagaccagcctggccagcatggtgaaaccccatctctactaaaaatacaaaaactactccggtgtggtggcacaggcctgttttcccagctacttgggaggctgaggcaggagaatcacttgaatccgggaggcagagattgcagtgagccgagatcgtgccactgcactccagtctgggtgacagagcgagactccatctcaaaaaaacaaaaaatacttcgtaaaaacaatactttttttttcaagtcaaatccaataagctagatgacaagagttagcttttattcacaaatgtagttaaacatgaggggtgttttgtagaaactccaatttctacaaacattagtggtgcattttggtaacattgggacaataaataagttatttaattaataatacaattttaagacaaaagataccccaaacaaagcattatctgttgactgcctgagaaacatgaagatcttcaatgttagtacttttctgttcctcctttcttaggtggtcatctgaaatgcacagaaaccaatgttaatacttatcccaagtcaaaacacacagataggtagacatagctacaaatatcttaggatgttacatatttaatattctatgagtactttagatggtttaggacaatgaaaaaaacccattattttttaaacactattgaagaaatcagaggccaagcgtggtggctcacgcctgtaatcccagtactttgggaggccgaggtgggtggatcacctgaggtcaagagttatagactagtctggccaacatggtgaaaccccgtgtctcctcaaaatacaaaaattacccgggcgtggtggcaggcgcctgtaatcccagctactcgggaggctgaggcaggagaattgcttgaacctgggaggcagaagttgcagtgagccaagatcgtgccatttcactccagcctgggcaacaagagtgaaactcggtctcaaaaaaaaaaaaaaaaaaaagaaagaaatcagaaatgtctggcattagggactctaattattcaaaagagtttcttgactttttttttgagtagagtacaacctgcagtaaacccatgcataagtagttacaaacctctctcttacatgtaaggaatgaaatttgcaagaaaggacaaggtgttcaatcagcattttgagggttgccaaagctcttcaattacaacacaatgaaaaccacttcaaatagatcacctgaggtcaggagatagagaccctgtctctactaaaaatataaaaattagccaggcgtggtggcgggcacctacaatcccagctacttgggaggctgagggcaggagaatcgcttgaactcagaagtggaggttgcagtgagccgagatcgtgccactgcactccagcctgggcgacagagcaagactcttgtctcgagaagaaaaaaaaagaacctagagacttaatatcctaatgcaacaaaaatgtaatgcaaaaactagattcttgagaatatatgaaccccaaacactttctacaactgataaaacatctttcttgcaacaactttgataataggaaaaaatatatacataaatttagataagctgctagaaaatgcaattttatcactgggttttctaattctacaatgtgattatacacacgctttattagttctcagctgcttattctcagtgccaatactactttaagggtctggaaaacagatggaaatctctctccctttattttaggtaactttgctggacagaaaaaaaattaacaatttcctcagaaggtaacaattttaggtcttctagaaaagtgttataaaaaatgaagtctactatgcttgatagatgtgcaataaagttaagctgatgactgtccctattataaaaatctggtctttcatttacaataaaaatcttcgccaggaatgtagtcccagctgtagtcccagctacttgggaggctgaggtgggaggatcacctgggcctgtgaggtcaaggctgcagagagccatgattgtgtcactgcactccagcctgggagacagagtgagaccctatctcttaaaaacaaaaaaaaaaagaaaaaaaatgtgtgtgtgtgtatatatatataaagttgaatagcaaaaactactttgccttcaagattacaagcactaacagcagcagtacaaatgcactggctgtcatttcaaaggtgggtgtgcctacataaaccctcttcattttttttcagcactgaaaacttggatgagagaagcactttttcatcttggcatgctttggacttacttctttctttccttttttttttttttttttgagacagagtctcgctctgtcgcccaggctggagtgtagtggcgcaatctcggctcactgcaacctccacctcctgggttcaagcgattttcctgcctcggcctcccgagtagctgggactacaggcgtacaccaccacgtccagctaatttttgtattttcagtagagacagggtttcaccatgttggctaggctggtctcgaactcctgacctcaagtgatctgcccacctaggcctcccaaggtgctgggattacaggggtgagctgccgtggcctggcctgaacttattttcaagtaaaagccaatttagtttcagggtttgatatttctgttgaatgagcttctgtggagacaaggtgctgtgatgtagaataaggattttagtatcttcataaccttttcaatgctgtcaaataagagttacggagacagtaagctagagttgaggaagtaaatggaaagcttaagtgtgttactgaaacatgatgcagttctggctgacaactttcaaggcactacacaaagaggttgtgtcaataaaatttttgatgaccaagaaaataatttgcaaaatcactgttcttccccgattcattcagcagtcatcctcatttctgagctgtctgcagagctttccacagaacaggcacccaaggtggctttactgacttgaactcgattctgatgttcctggcactttagtggtgtacaggtcgtgtgtctaggtgtctctttccctccctccctccataaatacctttctctctatggtgtatgcgtaatctaccgctttcatctcagaagaacagaaattggttaggaaatagtgttccttataactttcttactagtcatgagccgtgagtattaacaaggctgattatgaaacttacaaaccagaaagttatttctcaagcggttatttttctttatgggactgatagtatcaatgacttggggttgctgtgttaagaagtgttaaggtgtacaatatccactggtgacaactgaactcagaaactcatattgtcatatattcttggtaagtgtatagactgataaagcctttttggaggggaattagacaatatctactacatttttaaatatgcatatcctttgaaccaacaactctactttaggcatccacacaagagaaacgtgtagacaaagatacaatgttacatcacaatactgtaatgtgtggacaaagatacaatgttacatcacaataccgtaaaagcaaaatatttaaaactaaataagagtgattataaggtgggagagtagcctgggcaacaggacaagaccctgactgcaaaaaattaaaaaataagcgaggtgcagtggtgcacccctatagtcccggctacttgggatgctgatgtggaaagactgatcccaggagtttgaggctacagtgagctatgattgtgccactgcactccaacctggatgacagagtaagacctcatctctaaaattaaaaaaaggatgattgtaataatactctggaatatgaaacaaagttaaaaacgagatctacacgtatcaacaagtaaaaaaaagcaaattgcaggataacgtgcaccataacaatgtatatatatttaaatacacagaaatgagtcccgaaggggctgggcatggccagatgcagtggctcacacctgtaatcccagcactttgggaggccaaggggggtggattgcctgaggtcatgagttggagaccagcctggccaacacagtgaacctcatctctactaaaaatacaaaaattaggcgggtgtggtagcacatgcctgcagccccagctacttgggaggcaggagaatcacttgaacctgggaggcggaggttgcagtgaggtgagattgtgccattgcactccagcctgggtgacagagtgacagtccatctaaaatttaaataataataataaaataaaataaaataaataaaataaaatagaaatgagtcccaaagaataccctgcaaactgctaacagggacaccttctataaaaagggagaagaattgaggagttagggagaggcaagaaggaagaaaggaaagttaaagggaactttttactatttaaaaaatttagagatttactcatgtacttgcactattaatgttttattttgctcgttaagtacttgccaattagtaggcagtaatgtcagttccttaccaatccctaaaaagagaatttggaaaacttctccataatctatatgtggaaaggtatacgggaacagcaatcaaatgtgctgattctgctactaattatctgctacaggtcttagttgagttacttaacctcttagtattggaaccttcttaaagttttctcaactatgaaataagtagatgggaatgacttattttccaacgttccatccagttcagcattctaatatatatagaaagatatctcctagtgcagtcagaaaccacctccaaaataggttatcctgattcactgtttactttcagacctcaagagacaccaagcatctaacacggtcactactggtcatagcagtttaggaaactacaaaggcaatccacattttaggcgtttcctaaaagtttcctaaaagttcgtgtcaacattcaagatttacatttgttctgataattggcagcctaaaccccacctttaactgtccttaaaaattgaccagctcttggttgggcgcggtggctcaagcctgtaatcccagcactttgggaggccaaggtgggcggatcatgaggtcaggagatcaagaccatcctggctaacacagggaaaccctgtctccactaaagatacaaaaaattagccgagtgtggtgatgggcgcctgtagtcccagctacttgggaggctgaggcaggggaatggcatgaacccaggaggcagagcttacagtgagacgagatcacaccactacactctagcctgggcgacagagcgagactctgtctcaaaaaaaaaaaaaaattgatcagctctctaccacaactgaaaacactgagctataacccactcaattcaaatggtgaaaatgggatcccattgctgggataatcaaaataagtcagggccaggtacaggctcgtgcctgtaacccccacactctgagaggctgaggtgggaaatcacttaagaccgagttcaagaccagcctagtgaacacggttgagacttccatgtccacaaaaattaaaaaattagctgggtgtggtgcctgaagtcctagctacttgggaagctgaggcaagaaggtgagaggattgcttgagcccggcagttcaaggttacggtgagctataatagcaccactgcactctagtcaggcgacagagtgactagaaaaaatacataaaaatttatgtatttttatgtctcaaaaaaatacataaaaatttatgtatttttatgtctcaaaaaaatacataaaaatttaaaagctaccaaaagctcatttaaaaaacaggcaatctgaaagaaatgtgggcgattctcctaacaatctgtaacttgtaggtaacttccactgtaacataaacagtatcctaaaaatgcaaatgacttctctatctgtatttagcaatcttaccttttattttgcagtcatggagaggaaaaaaaataatcacttgataaaaagctatttattcagtataccaaggatctaagctgctccaaatacttacaatttacatgaaaattggagttttcagtatttttttgtttttttttaaatttaattaatataattttttaattaaaaaaatagagatggggtttcaccatgtcacttaggctagtctcaaactcctggcctcaagcgatccacctgcctcggcctcccaaactgctgggattacaggcatgagccattgtgcctagcccagagttttaaatacttctataaagaaattacatctaagaattctgcccagttatgcctcccacccttccctgtccaagattctttacaaaaagcattctgtttcttggagtaacataggctagacatattagatataagcagaattaaactatgactcaaaagctcagtaaagactccaaaagaaaaatatataggaagaaaacatatttgctgacagctaaatgatgaatcttggaaaactcatacccattggctttcttctactaggttgtctgccaagacttgggtctgaaggctgaagtgaaggccctttcagaaatgcattctggatgccatccttagttccacgcaagaaatgggctaaaatcccatataaaagaggtctatagcaggaagaaaacaaaacaaaaccaaaagctaataaatctgcataaacgggaaaagcttaaaacatttattctttaaaaggtaacctctgacatcaaaaagaccaagtgattcactagactttaaaaagcggcatgattatccaaaatgcaaattgttcatacttttaaatttaagagtaccacttaatttcatgacaattttaaaacccagagaaaacatgttaacaacttaaacctcatctacactgaaatatcatttctatcaatccacaggaatctcttttaaactccaaagtccagtagagtatttcccaatacctaaccccatctaatacacaacaggtattcaataaacacctcttgattaataagtccttgccctgaaaaagtcttaggtcctgagagccaggtgacctgagttcaaattctggctttgccatttgctagctgtgggactctgtgtaagattcttaacctctccagcctcataaatgtttcttcctttataaattaggataagcaccgtccctcccttatagggctgttatgcactaaatgagttaataaatgtcaagtgttttttactgtgcctggcacatatgaaatggtatataaatgttagctcctgtgtagctaacatttatttagattaatatttacattacctattattttaaaatcttctttatagtttacagaacgtatacctcttctcatctaatcctcatcgtgtaatgtcaagatcatcaactgcaatttataaaggagaaaaccacagccaggagatttgctagagattcccccagatagtaaacaaagtttacacttgaaccccaaatcccatattgttttccttacagtgtgctgcctgggaatttatattagtactcttgcatcaaggaaagctgctctgctgacaatcaagagtggtacaatggaaatgttttcctttgtttccaatctcaaatttgaaaacacaattaaaaggatttaatctttatttttaatttttgtgggtacatagtaggtgtatatatttgtggggaggatttattttttgagatatgtatctatttactagctggtataatggtttacagtacgacgctcccttccaaagatggaatctcattgccctctgagtgtgagctgaactcacttctaactggcacaaagctgacttcagaggccacgtggtaatggccctgcagcttcctccttgctttctctcttggattgctgcctttgggagaagtcagatgcctcaggacacttcagcagccctggaaagttacatgcagtaaggaattgaggccgcctgtcaatatcattatgagtttggaagcagatagttcagccacattcaaggcttccgactacaaccctggctggcatcttgactccaacctcaagggggagcctgagctagacttacgtgactaagccaatcccaaatccccgaatattccacaaataatctatgttgttgttctaagctaccaaattctggaataatatcacactaatttttccatgccacagggaaaccaggaaagtaagtttctttatttaataagatgccgcaactcttatgaaagcgtcacctagtaatataaaacaggtctctttgtttactttaatcttccccaaagtgttaactggttcaagatgatttttaaatgttaaaagttttattttttaaataaatattcaaaaaaatgtacttgtgattaaaattttgggttggacatgggggctcaggcctgtaatcccaggactttggggggccagcctggcctcaaacaggagtttgagacagcctgaacaacatagcgagtcccctagctctacagcaattttattttaaattagccacagaaggtaatatgcacctgtggtcccagctacttgggaggctgaggtgagaggatcgcttgagtgcagaagggagaggcaacttgcaaattcatggattaaggtttatcttttaaaataagtttcaaaaagataaagaaaagtgcggcctcacaataacttgcctgtaattctgaaatgcaaaattctgaaaactggattctcttcatatatctggcaaaaaatcatcagatggcaagggttgacctaacaaggctattaacaaggctattacagactttatcttactttgtgtgaaaacattaatgtgctgggtgtggtggctcaagcctgtaatcccagcactttgggaggccaaggcaggaggatcacctgaggtcgggagttcaagaccagcctgaccaacatggagaaaccccgtatctactaaaaatacaaaattagccgggtgtggtggcatgctcctgtaatcccagctactcaggaggctgaggcagaagagtcacttgaacccaagaggcagaggttgcagtgagctgagatcatgtcattgcactcaaaaaaaaaaaaaaagagaaagaaaatattaatgtgattgtggaatactactttaggactccctggcacatacatgtagtatttggtagatgtaccatattactttttttttttttttaaagaattgaagtcttgggccgatggctcacacctgtaatcctagcactttgggaggccgaggcaggaggatcatgaggtcaggagatcgagaccatcctggctaacacggtgaaaccgtctctactaaaaatacaaaaaattagccaggcgtggtggcatgcgtctatagtcccagctacttgggaggctgaggcaggagaatcgcttgaacctgggaggcggcagttgccgtgagccgagatcacgccactgcactccagcctggacgacagagtgagactctgtctcgaaaaaaaaaaaaagaactctcgctgtgtggcccacactggagtgcagcagcaagatcatggctcactgcagcctcaatctcctggatttaagtaatcttcttgcctcaccctcctaagtagctaggactacaggcatgtcattttaaaacccgacagcatttggattttcaaacatgtatctggcctcagtggtttcagatgcagcactgcagatctgtaagtaaataatatgagtaatatgtgactatggcaaactctgtgaatgccaatcactgaagtgtgagaaacaagggcttaaagaagttacctaacttttaaaaaataaagccgttttagcaacttttttttttgcttcctcatcctctctcaaacttacttttttttttttttttggaaacggagtctcgcttctgtcgcccaggctgagtgcagtggcacgatctcggctcactgcaagctccacctccccgtttgacgcccattttcctgcctcggcctcccaagtagctgggactacaggcatccgccaccttgcccggctaattttttgtatgtttagcagagacggggtttcaccgtgttagccaggatggtctccatttcctaacctcgtgatctgcccgcctcggcctcccaaagtgctgagattacaggcgtgagccaatgcgcccggccttcttttttaaaaaaatatcaaacatttcacgaatttgcgtgtcatccctttgccggggccatgctaatctctgtaccgctccaattttagtttatgtgctgttaaagtgagcacaaacttcttaatactttcatctgaagtaggtatctcaaaagctaccaagaagccagtaatagtcattgcttatttccatcaactgctaaatgtaaaatgatgtcttgtattaaatgatgtaataactcactgctcatcctaagtcacgcttagattcccccaattatttttcccactgttctcaattatacaatttttatacttttcaaaacacttgttaccaggtgcagtggctcatgcctgtaatcccaacactttggaaggccaaggtaggtggataacttgagctgaggaattggagaccagcctggctaacatggtaaaacaccatttctaaaaaaaatacaaaaattggccaggcatgatggtgcatgccagcgtatgcctgtaattccagctacatgggaggctgaggtgggagaatcgcttgagcccaggagttcgaggctgcagtgagccatgatcaagccgctgcactctagagacctgggcaacagagtgaaaccctgccttgaaaaaacaaacaaaaaaacctcacagcactttgggaggtggaggtgggcagatcacttgaggccaggagttcgagaccggcctggccaacatggtgaaaccccatctctacaaaaaaatatgaaaaaaaattagctgggcatggtggtgcacacctgtaatcccagctactcaggaggctgaggcagaatcagttgaacccaggaggagattgcggtgagctgagatggggccactgcactccagcatgggcgacagagcgagaccctatctcacaaaaaggaaaaaagaaaaaaaaaagaaacaagggaagatgagaggaagagaaagaggaaaatgccataaaggagttactatctgaacagggccaacagaaaggaaagatgctccaatagaagttaagatgctccaatagaagagggagaaaggtgatgtagggcttctaggataagggaatggtttacaaggcaaagcagcataaagttgcaaagtgtcttccaggcataatcagaaatcaggtgtgagcagatagaacaacagacgggtagaaagaggtgtaaagtgctacgctaagcaacagggacttcactatacacacaatgacaaaggtagtatatgatcctggaacattaattttacacaaggatttgtgggagagttagatttaactggaatgtcatttaaaacatttatatagtaaagcaaacaactttcagaacttttttttttttttttgagacagggtctgattctgtcacctaggctagagtgcagtggtgtgatcttggctcactgcaacctccgctgcccaggttaaagcgattctcatgcctgagcctccctagcagctgggactacaggcacacgccaccatgccttgctaatctttttgttatttttagtagagatggggtttcgccatgttgaccaggctggtctcaaactcctgacctcaggtgatccacttgcctcagcctctgaagtgctgggactacaggcatgagccaccacgtctggctagagatggggtttccccatgttgtccaggctagtcttgaactcctgagctcaagtgatccttccacttcagccttccaaagtgctggcattacaggcacgagatacctcacttggccttaagaacttttaggatgagaaaacgtaaggcttcaaagaaagttctagatttaaaaaaaggctgctttaagctatgttctcaggtctcctatgtacttttttttttttttttggctatacagggactctccagaaaaagtttaagaaacactgaaatagaaaaaaactaagaaaactagaaagtggtcatcctccttttcaagagcatagttggtgagaggaggtacacagagggcaaaggacagagtaatagtaacgaaagcagtgggctgattcagtaatcttggtagaaaaaggtattcgagcagaagcttggggttggaagttcatagtttttgtttttgtttttgtttttgttttaggagaggagagatctgagtacattcctaagttggagtgaaggaagagttaaatatgaagaaaacaactgacaaggcaaagtctcagaggccaggcatggagggctcacacctgcaaccctagcactttgggaggccaaggcaggaagatcacttgaggtcaggagttcgagaccagcctgggcaaaaaagcgaggccttgcctctacaaaaataatttgaaaatacaaataaaagttgaaattataaattaaaaaacaaacaaagccttagaaggacaaaggatcaagaagtcaaaaggagctaactccagaaagaagatgctgagtcactctgaagccatgtaattgtagcttcagcaaacacagatctcatctgacttattcactgctgcacaccctggatttaggacaatgcttgacacacactagatctgaataaatacttgaattaaaatgaagtaaaaccaccatggtgcaattatgactcaatacaatatgtggaaacttctttaaaaaaatgtcttacattgtattatcctttgattcttcaaatgcatttagttcatggatgagaaactgtctgtccaacggaactacaggttgaccagattctgggagaaataaattcatgagaacactcagtctattaaactaaaaagcaaataagattttgaaaagaatcacatttaccagacatacactttttagattttggaagaatgatgacaacacacaccaagacagatcaaattgcctgtgattttatgactttcaaaatatctcttttgttaaatgcatgtcttaatacagtttaacataaattcactttttaaattccccagtgtttggttggaaaaataccatttctatatccaaattataatactaaattttggaagtctgtttatcaataacttatttttgaaaagaatatccacttggtgacaatacttataaataaaaattaaagttaacctgaagtgtggggcagctggaactttcacactttgctggtgggaaagcacaatggtacaggcactttggaaaacagttgagcagttttcttataaaggtgagcgtgcacttaaccacacaacccagcaatctcactcttagctttctacccaagattaatgaaaacttatgttctcacaaaaacctgtatgtaaatgtttatggcagcttgattcctaactgctaaaactagaaacaactcaatgcccatcaactggtcatagatgagcaaactagcacagccacacaatagaacagtgttcaaaggaaaaacaaacatggctgaatcttgaatgtattacactaagtgaaaaaaggcagactcaaaaggctacatcatgtacggttccatctacagcaagggtccccaacccccgagccacagattagaaactgggccacacagcaggaggtgaggagtgggcaagcaagtgagggaagcttgatctgtgtttacagctgctgcccatcactagcatcactgcctgagctcagcctcctgttggcagaattagattctcatagaagcgtgaaccctattgtgaactgcacatgcgagggatctgggctgtgcactccttatgagaatctaaggcctgatgatctctcactgcctcccatcacccccagatgggaccatctagttgcaggaaaacaggcttagggctcccactgattctacattatggtgagttataattatttcattatatattacaacacaatcatagaaataaaatgcacaataaatggagtatgcttgaatcatcccgaaccatcctcccaggtccatggaaaaattgtcttccatgaaaccagtccctggtgccaaaaaggctggtgatatcttgattgtgatctggtagtaattacacaactgcaggcatttgactaaagtacagaactgtacagtttaaaaggtaaattttattgtatgtaaattatatcccagttttttaaaaaaagccaaaccatttaatatgaaaacttgactactgtcactatatttcattctagtgaatcccaagtccccactattttcataatttcttcttttctgggtgtaactggtatcatacagccatctataacaaacaaaggaaagcagagatgctgatatcaaagatccttaaaccataaaaatcatgagtctttatgtagttcagacgtatgtttaatattaaataaaggatctgtaacgaaaaattctaacttcacaaagaattcattctctcttgcaaaatctacttcctggcctcgcttctttgctgaggcatgaagtagtcaaagcagagatggaacctgaaacgagggaatccgatgacacacattcagggtgcctcagaccaacccccagctgcatcccccaccccaccaagtccaggggtaaccaggattctgacttatttatatccatccagtctctcctcacttttttgaaagaagacatttaaaagtcagcagaagatattaaaaatattctcaccactcaataactgttacacttgaagagcaaatttatttctcaagaaataaaattcaacagataaagggaatttatctttatctccccacccccaacccccaatatcattctctgcctcctatcactaggatgagtttggagtttcccgctgctagagtctggatatttgtctccgcccaaatctcatgttgcaacgcactccccagtgttggaagtgggacctggcgggagttgtttgggtcatgggggtggatccctcatggcctggtgctgtccttaccacagtgagtgggttctcatgagaacaggtcatttataagtgtgtggcactaaccttccccacccttggcccctgccttcaccatgtaacgtgcttgctgcagtgagcaaaagctccctgaggcctcccagaagctaagcagatgccagtgccatgcttgtacagtctgcagaaccgtgagccaagtaaacctcttttcttcaaccgggtgcggtggctcacgcctgtaatcccaacattttgggaggccgaggagggcggatcacgaggtcaggagactgagaccatcctggctaacggtgaaaccctgtctctactaaaaatacaaaaaattagctgggcatggcctgtagtcccagctacttgggaggctgaggcaggagaatcacttgaacccaggaggtagacgttgcagtgagccgagatcaatccacactccagcctgggtgacagagcaagactctgtctcaaaacaaacaaacaaacaaacaaacatacaaaaaaacctcttctcttcataaattacccagtctcaggtgtttatttatagcaatccaaaaacaacctaatataccagcctagtcctttataaataccatgcttttagatacatacatttgtaaatgtacctaagcactacatagtagtaatatttcaaagttttatctccattatatctatctatctatctatctatctatctatctatctatctatctatctagatacacacacacacacacacaaatagacatatatctacatatctatatatagacagggacagttttttttcttttaagagacaggagttggaccagcctgtccaatatagtgaaaccccgtctctactaaaaaatacaaaaattcgccgggcctggcagcacacacctgtagttccaggtactcgggaggctgaggcaggagaactgcttgaacccaggaggcggaggatgcagtgagctgagatcacaatagagtgagactccgtctcaaaaaaaaagaaagaaaaaaaagacaggggttgggtgcagtggctcatgcctgtaatcccagcatttggggagtgtgagataggtggatcacctgagcccaggagttcaataccaggctgggcaacatagtgagagctcatctctataaataataaaaaaatttagctgggcatggaggcatgcacctgtggtcccagctactcaggagactgacgcaggaagactgcttgagcccaggaggtgaaagttgcaataagccatgatcgcaccactgcagtccagcctttgcaacagagtgagattctgtctctggaaaaagaaaaaagagacagggtctctctctgttgcccagactggagtgcagtgatgcgatcatggctcactaaagcccagagcacatgggctcacatgatcaccccctccccgacccctgctcagcctcagctaggacaacagacacgtgccaccatgcatggctaattttaaaaactcttttccagagatggggtctccctgtgttgcccaggctggtcgcgaactcctgggctcaagtaatcttgcctcggcctcccaaagcactgagattacaggtgtgagccacctacccagcctattttttaacaaataatatacttaatcagcgtatatttttaaagcttaatacacaggaaaaaactggtggcaaacaggacaaaacgtcaacaattgtttattctcggttacaggaattatagatgatttttccaagtatatgcctagtttaagtgattatttagttatgtattttctcttgtaagaatctgtttaagctacagaaagaacccatgtgatttttgtgtcccagtcacccagatggcactatctggtaagggaattagatttctaggataaacagtttctgagaattggggaaaggggagaaacagattttatgtgataaataataaccacttacctgctatgaggacagatgctgtatacttatatttgttgaattctaaatactctcgaattaattcattaattagaaggttttcatgagacaatgatggtcggggttcacggtcatcatctagggcattgaaaacttcagctcggatccttgcttttaaatgccctaataccccctttttttccaaggtgtcctttaaaactgttcgatataaaatattaaggcttcagttacagagtaaatttgtcattcttaggcatactttgaaaagaaatgttgaaaaggtaaatggtacaaaaacagctctcaagcagctcttaatctaaacattgtgacaaattattaaacaattacactaccaccagccatgtttatactaaaacatatagttctcatgttgcagtgatttagtcttaatatatttgagcaaattcaagtttattcctacatcatcagcactgtcaggggctgtagtctaatacatattcttttttattttatttattattttttttgagacacagtctcgctctttcacccaggctggagtgcagtggcacgatctcagctcactgcaacctctgcctcccaggttcaagcaattctcctgcctcagcctccagggtagttgggactacaggcacgtgccaccacgcccaactatttcttttttgtatttttagtagagacggggtttcactgtgttggccaggatggtctcaatctcctgacctcgtgatccacccacctcagcctcccaaagtgttgggattacaggtgtcagccaccgtgcccggccaatacataattctttagtgaggggaaaaggcgggggataggattatagttgcttactgagacctgaacttaagccccagtctctcatatattttcaagagtgtctgccactgcacacaggttctgcttgtcactaacaacctctggtctagaaagatgattaaagaaaacaactacattccataaaagaagtctgttgggttactgtgtaaaaaccttgatggcagggcatggtggctcatgcctgtaacccagcactttgggaggctcaggcgggcggatcacgagatcagcaaattgagaccatcttggctaacaaggtgaaatccccctctctactaaaaaaatacaaaaaattagccgggtgtggtggcacgcacctgtagtcccagcaacttgggaggctgaggcacaagaattacttgaacctgggaggtggagggtgcagtgagctgaggtggtgccactgcactctagcctgggcgaaagagtgagactctgtttaaaacaaccaaccaaccaaccaaccaaaaaaaaaaacacaaacctttgataatccacaacgctttagggagtgaaaaggtgttgggtttttcattgttgttattttgaaacaatctcgctctgtcgccaggttggagtgcagtggcacgatctcggctcactgcaatctccaggctccctggttcaagcaattctcctgcctcagcctcccaaatagctgggattacaggtgtgcgataccacgactggctaatttttgtatttttagtagagacagggtttcactatgttggccaggatggtctccatctcctgacctcgtgatccacccgcctcagcctcccaaagtactgggattacaggcatgagccactgcgcccactggcctcgttgttttaaagacaactatgagttaattccttagaacagtaggattctgaaattttaagcctagttagaaatctaccacgtgactgtatcaatgccatcttaaggagtcagggatgtgtatgcagaatggaaatctaacttactgattagccagagtcaccatgacaaagcagttatgatcatgggatttggctgtacatacttagtatagataatggggatcttaggactgaattggcaccatcccttgtagtgatctgcaacttttattttcaaacagttcctactggctaaatgacaacttcagagaatgaacacatctcatccacagagtcaagaacagagcaagagctcagtaggtgtcacctagaaggattataatacattgctgtacactactgggaaatcaatgtagtttaacactgttctgcaccctgccaaaggcaccaagtaagtacatcacaataacaaaaatccataaagagagcccaggagcttatccaagtcagtatggacataagatctttctaagcttcaataaataacgtcaacaataaccctggatcatatgactaaagagatagaatcttcactgacttttgacctttctttcccctcatttttaaagcatcccttcaaccttcttgcagataggttaagtacagttatcaccagatcagagtttgtaacaggtccataaaaggaaggtacagccttattgtactcttagaatcataactgaacccctattctctaattccatctttggaaattggatggagagattttgtcactggcaaggatcctgtcccaattactctgtattgcacacaggacagcctcaaactggacagagaaacgagaattagtgacagtggaatgaggaaagctagcatgtctcatcagcacctcagtggtggattaccaacccatgcctcagttgccttctctaaaataatgagctctacctctcagagatagaaccaagtaagaaggaaaaacgtgatcgtgcttaaaaaaggtaaatgcccataaaatgtaaggtaactggctggcaaacaagttttcaccgggtttcttttggaggtccatagcattttacctttccctctattatgcttagaacactgcgccatcaaaacttcttcggaaaggtcttaacctcgcttatatttcaagagtaccttttttattttattttttaatttgtttttttttttgagacaaggtctcattttgttgcccaggctggagtgcagtggcaccactgtagctcattgtcacctctatctcctgggctcaagctatcttcctgtttcagcctgtggggtagctggaactaccacaggccactatgcccggctcttttttttaatttttattttttaaataaagatggggtctcaccatgttggccaggctggtcttaaacttctgggctcaagcgatcctcccaaagtgttaggattacaggcatgagccactgtgcttggcccattccaagtgtacctttaaatcctctgaaaatgtatgcaatattacatgtgatgtgtatttccctgggaacagcatctgtagactcgtgaagtctgttcttgtggacagatgcatgcctgttctgttttatgattgttcaccagccctgtccccaaatacacacttttatacacgtctcctccctaaaatatctaagaattactagtttaaaccctgggttccctgcaaagtggaactggttttattttttggacagcaatcttgctcagtgattaagacctggcgctccagtgcgtcacaactaggttcccatgctgtgtctctttccagtgaaatcactttgagctatttcacttctcagtacctcgtttcccagtctatgaaatgggcatagggttgttacaatcaggtaacacacaggctgagttgagtagtgcctgacacatgaggctcaatgataactattattactattacttgtctggacatttgcttcaaagtaaacagcgtacaaatgtcattaatgactcaaacataactagcttagagtatcttttcctgaaaagacaggagaatggccaggccagcaaactttttgcctctagtttcttctgatgaaaaaggggccaggcgctcacacctgtaatcccagcactttgagggggccaaggcaggaggatagcttgagaccaggagttcgacagtaagaccccgtgtctacaaaaaatacaaaaattagccgggcgtagtgaagagcccctgtattcccacctgctctggaagctgaggtgggaggatagctggagtcccggagttcgaagctgcagtgagctgtgatcgcgctactgcactccagcctgggcgacagagagaccctctctttaaaaaaaaaaaaaaaaagcaaggaggggagggctacttaacaggttgttgtaaggacccaacgagacaaccaagcaaattgtttagggcagtgcctaacccaataggggttgtgggaattgtagtcatcagccctgagtgccaagcctggtccaagtcctccagcccccggcagggtccaagaagatgagccaggggcccaagatgcaggcctgtaggcctcttagatgcctgaagattacgcaactcctcctttagctccaaactggcttaaaactcgccagtgggcaacctcttccccataagagctccccgcgcacgggccaagacagcagccagacgctccccgcaggccctcacaccgaagaatgacgcctgtaaaagccaacccatgtgttccgcgcgctctcctcccatcccatcctttccacaagatgaaggcccgacgcttcccatgtggaggcctccctgctcgcactcaccagccttcaactctgccacagtcgccatttttcaacggccgccagggccgcaccgcggccctgcgcacgcgcagctccgccccactcaccctgcggcgtggtctgtagccaataggcgcacagctctcgccccgcccacttccgcccctctcagtttatgagctctgcggttgagtgggtagtgaatgtcgaccagagactccaccaatcagcgagcgctctcggaaggcccagttgagtgagacggcagggagggcggggactgaggcagtggagagccctgtggggtgctgctggcaccttagtgcttaactttagccagctgagtttttcattgtctctgcagcctcaagtaccaactgctagtagttaccacctattaaccctgcggttctcaaacttgagcatgaatcctcatcacctccaagacttgtttaaacggattgtttgctagtcctccccatagagtttctgattctgtaaatctggggtgaggccctaggatttgcatttctatcgagttcccaggtggtactggtactgctggtcggtctggagatcacacctcgagaaccactgtattaagcacttactgtgacgccttagcgcattatttccttatgatcacgccgtttttacaatgaaggaaacagagtcctccatcgctgaagagacttaaccaaggtcaccagcctgtcctcttccactcgcacttacacagtgcatgtaaggagtccaggagctttttatggaactaactaatgaaggaataagctccaacatcccatggaagtaaaggaaaaggaacaggggaataatgtaccctaaactgagtgtgaggttgcatgattccagttgtaatgccggtgagatccaaacacttggctaaataataaacatcgattagacgtacacctaagagtggccgggcgcggtggctcacgcctgtaatcccagcactttgggaggccgaggcgggcggatcccgaggtcaggagatcgagaccatcctggctaacacggtgaaaccctgtctctactaaaaatacaaaaaattagccgggcgtgctggcgggcgcctgtactcccagctactcgggaggctgaggcaggagaatggcgtgaacccgggaggtggagcttgcagtgagccgagatggcaccactgcactccagcctgggcgacagagtgagactccgtctcaaaaaaaaaaaaaaaaaagtacacctaagagctgccagggcacggtggtttacgcctggaatcccagcactttgggagactgaggtaaggagttcgagaacagcctggccagcctggtgaaaccccctctgtactaaaaaaaaagtacaaaaattagccgggcgtggtagcaggagcctgtaatcccagctacttgggaggctgaggcacaagaatcgcttgaacctgggaggcagaggttgcagtgagatgagatcgcgctactgcactccaacctggacgacagagcgagacaccgcctcaaaaaaaaaaaaaaaaaaaaaccacctaagagcaaggaaacctctttccgaggaacttccagcatacttttggttccatgcctattgtttttaaaactgatacattggccaggtgcggtggctcatccctgtaatcccagcactttgggaggacgaggagggaggattgcttaagctcgggagtttgagatcagcctgggcaatgcaagaccccatctctccaaaataaatacaaaaaattagccgggcatggtggtgcatgcctgtagtcccagttactccagaggccgaggatagaggattgcttgagctcaggagttctagaccaagctgggcaacatgagacgcatttctacaaaaaaaaaaaaaaattagccagatatgatggtgcatgccagctactcgagaggctgaggagagaggatcacttgagcctggacggctgattgtaccactgcactccactctgggcgacagagtgagtccctttctcaaaaaaaaaaaaaaaaaaaaaaaaaaaagaaaagaaaaagagagaaagaaaaattgatatatcacaattatggggagggacgtgatattttgatacacatatacaatgtgtaattatcaagtcaaggcaattgggataaacatcacctcaaacattctttgtgttggaagcattacaagtattctagctattttgaaatatacaatcaataattgttaactattttttttaaagggagggggaacagcctgggcagcatagggagaacctgtctttaaaaacgagcaaacaaggccgggtgcggtggttcacgcttgtaatcccagcactttgggaggcctgaggcaggcagatcacaaggtcaggaattcgagaccagcctggccaacacagtgaaaccccatctctactaaaaatacaaaaattagccgggcgtggtggcagaggcctgtaatcccagctattcgggaggctgaggcaggaaaattgcttgaacccaggaggcagaggttgcagtgagccaggggtgcagaggttgcactccagcctggggaacagagtaagactccgactcaaaacaaaacaaaacaaaacaaaagagcaaacagccaggcacggtggctcacgcttgtaatcccagcactttgggaggccgaggagggcagatcacctgaggtcaggagtttgagaccagcctggccgacatggtgaaaccccatttctaccaaaaatacaaaaattagctgggcatggtggcaggcatctgtaatcccagctactcgggaggctgaggcaggagaatcgtttgaacctgggaggtggaggttgcagtgagccgagatcacgccgctgtgctccagcctgggcgacaagagtgaaactccgtgtcaaaaaaaaccaaaacgaacaaacaaacaaaaaaaccgagcaaacaaaacaaaaaattagcctggcatgtgtccctgtagtccgagctactcgggaggctgaggcaggaggattgcttgagcctaggaggtggaggctacagtgagccatgaccataacactgcatttctagcctggtgacaaggggagatgccttttctttcccttccttccttccttccttccttctttccttccttcctttcctccctcctctctctctccttccttccttcctccccgccctttccctttccttccttccttccctccctccctccctctttctctctttctctttctttctttctttcttttctttctttctttctctctctctttcctctttctctcttactttttcttgagacttaaaaaaaaaggggggccaggcagagtatcttgacctagagtctaggataatgctctttaaactgctggttaaccaaatagtaggttttgaaatctatttattagtagatccccatgagtacattttcagtgaaatggaatgtaacaaatagaaaacatagaagtatggttttctagaactttcctttcaggtacacatgtgtgttctggtacctgttgtatttcttaaagtgatcagccatcagaaaagtttgaaagtgattgtaacctagaggaatctcttcctattccaaactggattaatttttgactggattaatttttgattatgggacacatatctgttctgtaaccttgaaaaggtcctatcttgtttctctactctgtaaaaccacagtgactgaatacctggccagcatttcaagagatttttggggattaactaaattccataggtggtatttttaagtccctcagaaaaagcactcctgtggtgttatgatataggtattgattttcatctccacgattcctggcatctaactcccattcacctcattataatgttgaggcactttaggcctcaggaaacagaatctccctctctgatcttctcctgtccacctctgacctgccccaagcaggactctaatctgactgtgggtcaaaagaccctcattccagaaagggttctgcctgctaccctcaaggaagaaatgctgcacagagagcccaagaaaagtctgagcagacaggctttgctgggtttagatcaggcactttctgtccaatcagatttctttcttttttttttttttttttgagacggagtcttgctctgtcgcccaggctggagtgcagtggtacagtctccgttcactgcaacctctccctcctgggttcaagcgattctcctgtctcaaccacccaagtagctgggattacaggtgtgcaccaccatgcctggctaatttttttttttttccagacagagttccgctcttgttgcccaggttggagtgcaatggcacgatctcggttcacctcaacctctgcttcccgggctcaagcaattctcctgcctcagcctcccaagtagctgggattacaggcatgtacaaccacacctggctaattttgtatttttagtagagatggggtttctccatgttagtcaggctggtgtcgaactcccgacctcaggtgatccgcccacctcggcctcccaaagtgctgggattacaggcgtgagccaccacgtctggcctgtccaatcacatttctacacggtgttcaatcacacctatgtaataaagtgtcccataaaaacccaagagaactgggttgggagaacttctggatagcagaacacgtggaggttgttgaagggtgttgcattcagggaaagcatggaagctccacaccccttcccctatactttgccctatgtgtcacttcatctgtataaacaaaattaagtgtttccctgaattctttgagccactccagcaaattaatggaacccaaaatgggggttgtggaagctccaacttgaaggcggtccatcagaagtttcagaggcccaaacttgcgactggtgtctgaaggaaggcagtcttggggactgagctatcaccctgtgggaaatgacactattttcaggtcgaagatgtcagatttaaactgaaggacacccagctggcgtcagctgcagaactgattgtttgctggccaggcgcaatggctgaagtctgtaatcccagcattttgggaggcagaggtgggtggatcacttgaggtcaagagttccacactagcctggtgacatggtgaaaccttgtctccactaaaaatacaaaaaatagctgggtgtggtggcatgcacctgtaatcccagctactcaagaggctgagccaggagaatcgcttgaacctgggaagcagaggttgcagtgagcagagatcatgctatgggtgacagagtgaggctaaacctaaaaaaaaagattgtatgcttgctggtggggggatttccccacacatttctggggtccacagaagtattctgtgttgattattggtgtgttgatgtgtgagcagagaaaaaacacggtttgagaaagtttatatccaaaaaactcctgaatatgttgatgaggaactcggagagagaggcaaataataatgtgattgaccgattggcagtggtaatcatacagtagctaacattcattatactctctgtatggcaaggactgctctaaaagctttacattaagtattcaccaacaaccctatgagatggatacttacatgcaattgtctcaagtaaaattgtatttaaaaacatactggccaggtgtggtggctcatggctgtcatcccagcactttgggaggctgagacaggcggattgcttgaggccaggaggagttcaagacgagcttggtcaacatagtgaaaccctgtctctactaaaaatacaaaaaattatttgggtgtggtggcacacacctgtaatcccagctacttgggaggctgtggcatgagaatcacttgaacccgggaggcagaggtttcagtgagctgagaatgcgccactgcactccaacctgggcgacagagaaagactctgtctcacaaacaaacaaaaaacatgtactaatgaccaggcacagcagttcatgcctgtaatcccagcactttgagaggctgaagcgagaggatcagttgaagccaggagtttgagaccagccaagccaacaaatcaagaacccatgtctttaaaaaaaaaaaaagtagctgggcatggtggcacatgcctgtattcctagctgctcaggaggctgaggcaggtggattgcttgagtccaggagttcaaggctgtagtgagctatgactgtaccagtggactccagcctgggcagcagagcaagaccccatctctgaaaaaataaatacctttatacatacattaaaaacatgcactgacattgagtaacactgaattgctggggatatgtcgaaacaggcactgccatacatagttggtaggtaggcaatcaacaccaccatccagaaggcagtttgtcaatatctcatcagattttcacaccctttgactcatcaaatctacttctaagaatgtatcttacagatataatcacacctacttacaaaggatataagtataagaatattcattcactgttgatagtagaaaaaactatgcacacctttcagaaaggctaaaataaagactactgacaatactgttggcaaacacacatgtactactggtgggaagacaaagtggtatagtcactttggaaagcagtttggcaattgcttattaagtcataggtacacttggcccagtaatcccaaaactaagtgtttgcccaagtgaagtaaaaacttgtaggccgggcgcggtggctcacgtctgtaatcccagcactttggggggccaaggcgcatggatcatttgaggtcaggagtttgagatcagcctgagcaacatggtgaaaccccgtctctactaaaaatataaaaattagccaggcatgatggagcatgcctataatcccagctacccaggaaaattagccaggtgtggtggagggtgcctgtaatcccagctacccaggaggctgaggcaggagaatcacttgaacccgggcagcagaggttgcagtgagccgagatcgtttcactgcactccagcctgggcaacaagagctaaagtccacctcacacacacaaaaaaaagaacttgtagccaggcacagtggcttatgcctataatccccacagtttatgaggccaaagcgggatgaacgcttgaatctagaagtttgagaccggcctgggcaacatggtgaaaccccatctctacaaaaaaaaaaaaattacaaaaattagacaggcgtgtaggagtgaacatgtagtcccagctactccagaggctaaggtgagaagacctgcagagcctgggaggtccaggttgcagtgagtcgtgatcacaccactgcactccagtctgggcaacatagtgaaactgtgtttcaaaaaaataaaaaatgttctctggtgaggactcggtgattgagggtcagtgttcgatggagacttacttttttttttctttttgagacagtctctgttgcccaggctggaatgcaatagcaccatcatagctcactacagcctcgacctccaggctcaactgatccttcagcctcccgagtagctgggaccacaggcacgtgccgccacgcccagctatttttattttttgtagagatggggtctcaccatgttgctcaagctgatctcaaattcttgggctcaagcaatcctcctgcctcgaactcccaaaggcctggggttgcaggcataaaacaccacacccagccttacttttgtccatagacttattttaatttattaattaatttatttatttgagactgagtcttgctctattgcccaggctggagtgcagtggcacgatctgggctcactgcaacctccgcctcccaggttcaagcaattctagtgcctcagcctcccgagcagctgggattacaggtgcacaccatcatgcctggctaatttttgtatttttagtagagacagggtttcaccatgttggccaggctggtttcgaactcctgacctcaagtgatcctcctgtctcggcctcccaaagtgctgggattacaggtgtgagccaccgtgcccagcctaattttaacttttaactatgtacatgcattactgtgcacaaccagctgtgggcaagtacagcccaatagcccctcctcttcactgtcttgagtatctcttgctcgttgttgagggcccgtctagcgccatgccccataggctgcctataggagtccttttgacccttcaggcacccacacaattgtggaaatgtggctggaccaacaaatagtgggagtgagtggtaatccatgtgtgacatgcgagaggtgcacatttttttctctctctcttttttttttccatagaaatataaaatgtttgtagaaatgtaaaatcttttgtttttctttttttttatttttccagacaggggttaactctgtcacccaagttgggctgcagtggtgcagtcacagctcactgcagcctcaacatcccagtctaagggatcctcccacctcagcctcctgagtagctgggactacaggtgtgtgtcatcacacctggctacttcttttattttctgtagaagcagagtctcgctatgttgcccaggctagtcttaaactcctggtctcaaacaaattctcccacctcagcctcccaaagtgctgggattacaggcatgaggcactatgcccagcctgtaatcttattagcacacagccatgccccccactttttttttttttatttttgagagaggttctcactctcacccaggctggagtgcagtggcatgataaggggtcactgcagcttcaacctcccctggctcaggcaatcctcccatctcatcctcccaagtagctgggactacttgtgcatgccaccatgcccagctaattttttgtattttttgtagagatagggtttcgccatgttgctcagactggtcttgaactcctagattcaagcattctgcccacctcagcctcccaaagtgctgggattaattacaggcgtgagccaccgcatctggccgcctgcctgtttcttaatgcattgtctatgggcgcttttacacggcaacagaggaattgagaagctgcaacagaactcacttaaaatattttacccggcacttgaagaaaacatttgtccactcttgaattctttttcatactttttctaggccacaggtatattattaacagattaaccattattttttttttcagctatagccaataataataaaaaagagcaactcacattgatggtgcccttattgtgtgtgtgtcgtttcatggcatcctgaagacagctgagagacagatgtgatcatgcctgttttacagatggaaactgaggtttggagggttgaagttgcttctgagtaaatggctgagtcagtgcaacttgaccccagttctgctccactcacccaacgttgctcagccgttttcggttgtttcagtttcactgcagacacttctctgttctccccctgccctccttctctcccccaaactctctctcttccttctcctcctttctcttcttctgctccccaatccccctcctcctctttcatcttcttcctcctcctccttcctcctcccagccctcctcctcctcctcaacctcctccccttctatctcctccccctcctcctctttcttctccctcgccctcctctcttcttttctctcccccaaccccctctctactgggcctttgcatgtgcccatcccccagcctggaaacttcctcctgttctggttaatttctgctcattctccaggtctcagtctacctttttgttgtcgttgttgttgttgttgagacggagtctcgttctgttgcccaggctggagtgcagtggtgcgatctcggctcaccgcaagccccgcctcccaggttcacgccattctcctgcctcagcctcccgagtagctgggactacaggtgtgcgccactgcacctggctaatttttcgtatttttagtagagatgcggtttcaccatgttggccaggctggtctcaaactcctgggctcaagcgatccacttgcctcagcctcccaaagtgctgggattacaggcatgagccaccgtgcctggtctccaggtctgtttaaatgtcatttcttcctaaagctttcctggctaattcgattcttcttctcaaatgtatcttggggggtgaaaggtctgagaagagggaggggcatagagataaaggaagcttccaacagaggtgcatcaccaatgcccttctcccaggtccgaggtcatacccctggctcgaggggaggcggcttccgatgcctggtccatgctggggtatcaagttccagccctctcaccccagtttgggacaattctgtaggaccgcctcactggcagagcttgctgagggagtaagctgaggcctttgtaggccacaaggttgagaccagcctgagcatcatagtagggccttgtttctatgaaaacatttttttaaaaaatgaaacttcccacatgacaatttttttttttgagacggagtctcactctgtcacccaggctggagtgcaatggtgcgatctcagctcactgccacttccgcctcccaggttcaagtgattctcatctcagcctctcaagtagctgagattacaggtgcccaccaccacacctggctaatttttatatattttagtagagatggggtctcgccatgttggccaggctggtcttgaactcctgacttcaagtgatccgctcatctctgcctcccaaagtgctgggattacagccatgagccacagcgcccggcttccccatgacaattttaaacatgagaactatgtatatgccacagtctggaacttgggatctcaaataatcttggattccttgttctcagtccccatacagaagggaggagggctggcctttggactcccccaaatctgggttcgaatcccagctccaccactgcaagtctggttgctctggaccagttacttaacgttctctaaatgtcagttacatccgtgagataagctacctcgcgggacttcattcagtccttcttcaaatatctgtagaatatttgtaggctgaggcctttgctgggaccgtggagaagcccaacttcctcctccctttcccccacttcctaggctttgatccagccctggagccttgatcgaattgatctctctttcaagtcttccagggaggctgtgactcaatcctagaaaccaggggcaggtccaggctgcctgtggtctacttgctccacttcctcaggtgctcaagggtgactcatcactcagtaagttcagagcagagggcgttctcctcaatgtgtgccaggagcacagcaggaatgtaggcaccctcagagctccccagaattccctaaccctggaccacactgtggcattgcagcctatgtggggctgaggctctgtttcacattgggtgcccaatggactgctttacaggacagatgccttgttatcctgctctgctccggtagaacaaatatttgtagaaggaccgaatgaagtcctgcaaggtagctcatctcacagacgaaactgatgtttagagaacattaaataactggcccagagcaaccagacttaaagtggtggagctgggattcaaacccagatttgggggagtccaaaggccagccctcctcccttctgtatggggactgagaacacggaatccatgaccatttgagatcccaagttccagactgtggcatgtacatagttctcatgattaaaattgtcacgtgagaagtttcattaaaattttttttttttttttttttttttgtagagacaaggtctcactatgttgtccaggctggtctcaagctcctgacctcaagcgatcctcctgcctcagcctaccaaattgttgggattgtaggtgtgaaccactgcactctgcccagaggtttcaaagtgaactttttttctttaatcaagatggggtctcactatgttgcccagactggtctcaaactcctgagctcaagcgatcctcccgccttggcatcccaaattgctgggcttacaggcatgagccactgcacctggcctcaaagtggaatgtttttagtggggggaaggtgctggatattactgtcagtcctttagaggaagtaaaataaatcctacaggtacattgacattctcaggtcactttcagagggatgagcaataaattcattcaatgccttctttactaaaagcattagagataaagaaattctggaagtaaatcttgctgaaatgcattttgtcaggggaactcagttgaacaaaaactaaaggttgagttcagaaaaggtaaatgtcttttaccaagatttagttcttttcttccaggtagatatgccttttcttaggatctggagtgagaggctgttggaaaataagggttggggaaagccacagatggaattttacaaattggagacagctacttaatagaaacggcatctcatcagacaagtcaaggcaactgttgaaaatatgacatgtctctctatcagccattcatggcccaggacactatggcaaccaaatccaaactgctggttcaaagagattagtctgaatcccaaaagaatcctaattctctcctgatttattaaggaagaaaacaacaaccgcctttatttgcaatattattgcattgcatgcaatcctaggaaaaggtgtggctgttatttttgaagaagtactcaccctatactagatacagtatgaaacattattcatgcgtcattgcatttatttctcacgtgatctcaagaggtagatgctactgtcatcctgattttaagatgaagaaagcaagccttagggagttaaagggaactgcccaaggtcaaacagctggaaagagacttggccagacgcaaaaacagtctgatgcccggttcaaggtcctttagtttcatctgtccagtaagtagacagagtatttgatacttgggctggactagacaaatctatgatgtgtaattgttctgtgaactcacagatcctagcgtgaagagttttttgttttgttttgttttggtttttttagatgcagtttcgctcttcttgcctacgctggagtgcaatggcgtgatcttggctcactgcaacctccaccttccgggtacaagtgattctcctgcctcagcctcctgagtagctgggactacaggcacccaccaccacgcccggctaattttttgtatttttagtagagatggggtttcactatgttggccaggctggtctcaaactcctgacctcaagtgatccacccgcctcagcctctcaaattgctgggattacaggcgtgagccactgtgcccggcctttttttttttttttttttagatagggtcttgctctgtcgcccaggctagagtgcagtggtacaatcatagctcactgtagccttgaattcctgggctcaagcgattctcccacctcaacctccctgagtggctgggactacaggtgcgtaccattacaacacctggctaatttttttttattttttaatattttgtagagacaaattcttgttatgttacccaaggtggtattgaactcctggcctcaagtgatcctcccaccttgtcctcccaaagttctgagattacaggtgtgagccactgtgcttaaccaagtgaagacttttttggctagctcaaccctgtaattccagcactttgggaggccgaggtgggtggatcacctgaggtcaggagttcaacaccagcacggccaacatggcaaaaccctgtctctactaaaaatacaaaaattagctgggcatggtggtgggcgcctgtagtccgagctactcaggaggctgaggcaggagaattgctggaacctgggaggcggaggctgcagtgagccgagatcacaccactgcactccagtctggacgacagagcaagactctgtctcaaaaaaaaccccaaaaacaaaaaacaaaaatcaaaacaaacaaaaagcccaaaggaggactttttcatgctgataaagaatgtaggataaacctgataccctctccaaaatctcttccaattttcctaacctctgtaccaatgaggacttcctttcctttctgactttcgatcaatgtaacaaaaataaaattgaagcagagaagggttaagtatgttgctcaaggtcttgcaggtgatttgggttagagccaatcttgaactcagccaggtgaggtggcacctggttccatgactggaccctccctgctgccctggtttgcgagaagattcttacacacatgtccctgatctccttgaagctttgattttccacctagagccccactgcagcatcctggttatctgcgcaagctctgttgttacactgaactggatggtgaatcctgggtacctgtgtggccttgggcaaaaaaaaaaaaaaaaaaaaaagcacctctctgagcttccatttctttcattctttctttccctttcccctctcctcccctcccctcccctccccttctctctctctctctctctctctctctctctctttctttgttggagtctccgtctgttgtgcaggctggagtgcagtggcgcaatcttggcttgctacaacctctgcctcctggcttcaagcaattctcctgccttggcccccctgacgagctgggattacaggcatgcaccaccatgccagctaatgtttgtatttttgtagagatggggttttgccatgttggccaggctggtctcaaacttctgacctcaagtattacgcccattttggcctcccaaagtgctgggattacaggtgtgagccaccacacacgttcttgggcctccatttctacagctattaaaaggaggccataatagtacctaactcctgggatattatcgtggctaaaatgagctaatgggccaggtgcggtggctcacatctgtaatcccagtactttcggaggccgaggcgggtggattacctgaggtcaggagttcgagatcagcctggccaacatggcgaaagcccgtctctactaaaaatacaaaaattagccaggtgtggtggcttgcacctgtagtcccagctactcgggagtctggggcaagagaatcgcttgaacccaggaggtggaggttgcagtgagctgagattgtgccactgcactccagcctgagtgacagagctagactccatctcaaaaactaataataataataataataataataataataataataataatatcataataagatgggcctggcgcggtggctcacgcctgtaatcccagcactttactctactaaatctctactaaaaatacaaaaattagccaggtgtggtggcgggtgcctgtaatcccagctacttgggaggctgaggcaggagaatcacttgaacctgggaggcggaggttgaagtgagccaagatggcgccattgcactccagcctgggaaacaggagtgaaactctgtctcaaaaaaattaaataaataaataagtaaataaataaataaaatgaactaatgcatgaagagcacttagttaaattaaataaataaataaaatttttaaaaaataaaattaattaaataataaataaataaataaaatgaactaatgcatgcaacaacttagcacagtgcctaggacataataggcactcgataagtgggctgggcgtagtggctcatgcctgtaatctgagcactctgggaggctgaggcgggcagatcacctgagctcaggagttcaagaccaccctgggcaacatggcgaaaccccatctgtacaaaaattacaaaaattagctgaccatggtgatacccacctgcagttccagctacttgggaggctgaggtgggaggatcacttgagcccgggagactaaggttgctgtgagcccagatcatgccactacactccagcctggtggacaaagctagaccctgtcacacacacacacacacacaaaagtggctatttcctcaccattccccccttggcaggtcacagcccagtccactccactcctccatggtctccattcttgtcgcctcgacaccagatggcctggattaggtgtgtaagaacatatttatgctccagttttctcttgtcaaattcctcatccttcctctccccttcccagatgttctccattctccgcaaatcctctacctcacctccatcttccacctgctctttggtcactctgtctcctactcaactaggaagaccctaggaaccctccacttggaccctaaatctctttgcattttaacctttcattcatgaattcattcattcgaaagatattattgagcatctactatgtaccaggcactaaggatactagagtaaatataataaacaggatcctggctgggtgaggtggctcatgcctgtaatctcagcactttcggaggtaaaggtgggtggatcgcttgaggtcaggagttcgagaccagcctggccaacatgacaaaacccgtctctagtaacaatacaaaaattatctgggcatggtggtggcacatgcctgtaatcctagcaacttgggaggctgaggcaggagaatcgcttgaacccaggaagtggaggttgcagtgagctgagatcacaccactgcactctagcctgtgcaacagagcaagactttgtctcaaaaaagtaaacacggtctctactcacatagagctcactggccaagagaaagggcagcaattcatcaaatatttaattacaaactcagataaatactataatgaaaaatgcagagattctgagacagtcaggggccataacctagcctaggttggtggttatggaaggcttccatatcagcatgtgtttctttctttctttttcttttttcttttcttttctttttttctttttcttttttttttttgagatggcgtcttgctctgttgcccaggttggagtgcagtggcaccgtctcatctcactgcaacttccacctcccaggttcaagcaattctcatgcctcagcctcccaagtagctggggttacaggcttgtgccaacacacctggctaatttttgtatttttagtggagtgcagtggaaccatctcggctcactgcaacttctgcctcccaggttcaagcgattctcatgcctcggcctcccaagcagctgggattacaggcgtgtgccaccacacctggctaatttttgtgtttttagtagagatgaggtttcacaaagttagccaggttggacagcacgagtttctatgcaacacactgtcctaaaacttagtggcttaaaacaacaacaatcattgatttcacccccaaatctgcaatttgggcaggatgtggcctggacagcaagtctgtgttccacatgccatgctcaacatggggcagcttgacaggggctggaggacccacttttttttggttgtctctgagatataatttacatgccataaatttcaccatgtgaaaccatacaattcaatgctttttagtatattcacaggattgtacaactattgctatctaattccacgatatttccttttccctaaaaagaaatcctatacttatctggatgtggtggcgcacacctgtggtcccagctactcgggaggctgagacagggggatcaattgagcccaagagttccaggctgcagtgagctatgatcgcaccattgcactccagcctgggtgacagaatgagaccctgtttctaaacaacaatgacaagaacaacaacaacagaatatataccattagcagtctcttctattccctcttcccctagtccctggaaacactcatctatcttctgtctttatagatctgtctgttctagacacttcaaatggaatatacactacgtggcctattgtgtctggcttctgtcactgagtacaatgttatcaagattctggaagacccactttgtggatggctcagtcacatggctggcaatttggtatttgctgtcaggtgggaactcagccagggctgtgggcagggatcccatttcttctctatgggggccccctccacgggctgcttgagcttccttatggcatggtggttgggttccaagatggagcatcctaacagagccaagtgggagcttttcatatcttttttttttttttcaattgagacaaagtctcactgtcacccaggctggtgtgcagtggcatgatcttggctcactgccacctccacttcctgggttcaagtgattcttgtgcctcagcctcctaagtagctgggactacaagtgagcgccaccacgcccagctaattattgtatttttagtagaggctaggtttgccatgttggccaggctggcatatttattaaaaaaaaaaaagagagagagagagagacagggtcttgcttgttgcccttggcaggtcacagcccagtccactccactcctccatggtcttgaactcctagtctcaaatgatcctcctgcctcatccttccaaagtgctgagattacagatgtgagccacgatgtccggccagcttttcaccttttatgaccagtttcagaagtcacaccatgtcacttccacagtagcctcaagctcgtctggattcaagggaagggaacacagaccacccttcacaacaggagtgtcaaagtcaccttgtttgcgttttaacttttcattaatgcattcattcattcaaaagatattattggccaggtgcagtggctcaaacctataatcacagcaccttgggaggctgaggcggatggatcacctgaggtctggagttagagaccagcctggccaacatggtgaaaccccgtctctactaaaaatacaaaaattagctgggtgtagtggcatgcgcctgtaatcccagctacttgggaggctgaggcaggaaaatcgcttgaacccgggaagtggaggttgcagtgagccgagattgcgtcattgcattccagcctgggtgacaagagtgaaaatccatctcaaaaaaaaaaaaaaaaaaaaaaaagtcacaccatgtcagttccacagtagcctcaagctcatctggattcaacggaagggaacacaggccacccttctcaataagagtgtaagatcactttgtttacattttaaccttttattcatgcatgcgttcattcaaaagatattattgagcatctactcatgaatgaataattgtggccacttttggaaaatacaagtgctacagcttccctgagaagatgatgttggggctgacagctgaaggataagcaggtgttacttaggcacaggtatggaagagcattcaaaaaacacagaacaacgtgttcaaaagacccgggggaacaattagcacactggaggaacttaaggcggccttgagtggcagaggcagagagaaaggcacttgtctgttgtgtgctttccatgactgctgtttccactcagccttcattgtccattttttcagaaacagtaccctaaattccctttggggaaccattgactcacccgccctcagccctctcagtggggctggctgcaggggtgggtgttaagacccaggtctagccattcaagacagttcacccagcctcgccagtctcactgattggttcgggtgtggtcatgtgacactcagaagggccaatgaggctcaaacccaagacatctgctgcagctattggacaagacagagtgtattgccttggggttgctaggtaggatagaggcaggagtggttgggtgtcacctttgcctctgccagagaataacctgttgaaatgacaccaacaaagagaaagtagaacgaagtgacacagaccattgagctcctggactatgaccaaagccagctctgccactggacattttagattcatgggccaatacatgatggtttaggctaatttgaatttctgtcacctggaatcaagagtactgtttaaaggcaccatcggtgggcgcagtggctcatgcctgtaatcccagcactttgggaggccgaggcgggtggatcacccgaggtcaggagtttgagaccaccttggccaaaatggcgaaactccatctctactaaaaatacagaaaatagccgggcatggtggcacgtgcctgtaatcccagcaactagagggtctgaggcaggaggatggcttgaacctgggaggcagaggttgcagtgagccatgattgtgccactgcactccagcctgggcaacagagtgagactccatctcaaaaaacaaacaaacaaacaaataaataaataaagacactatggttaggatttttctcttcctgtccctaactacacattctccattcctggttcttacgtaccacttcagaagcctccagcacttcatctggcctctcttccttctctctctctttcatttcttattttttttgagacagagtctcgatctgtcacccaggctggagcgcagtggcgcaatcttggctcactgcaacctccacctccaaggctcaagtgatcctccagcctcagcctcctgagtagctgggattacaggcacacaccaccactccaagctaactttttgtatttttagtagagactggtttttgccatgttgcccaggctggtcccaaacttctggccccaaacttctggcagatcaagtgatccacctacctcggcctcccaaagtgctgggattacaggtgtgagccactgcatctagccttctctcttttttttgtgatcaataaatgtttgtttattgcatcttggtctgaatgtcatattaaatttggggttccaaaaaactctagaaaacatttatgagaacttgggaggtggaggttgcagtgagccgagatcgcgccactgcactccagcctgggtgacagattgacacttcgtctcgccaaaaaaaacaaacaaacaaaaaaaaaaaacaaaaaaagaaaaaaagaactaaatgtccctgaatataaaatggtaggtaagaacagtaattggcttgtcgatcaatgatgaatcaaacagaaaatgcgtgacagattatggggaagtttaaaatgtccaaatattatgtcccagaagaatttgtctagataatagatcttcctcagtccctttcaggggatggatggatagtggacatacttgggcaggtttattcagggtaagctggaggaatgtgtcaaataggtagctacctatctgatttactttcatcctattttttctgctcttaaaacaaaataacctcctattggttaaacttttttttttttttggttgcaaatcaaactctcttactggttttaaaatatcaatttcttttctttttctgtttctttttttttttgaggcggagtctcactctgtgacccaggctggagtgcaatggcatggtcttggctcactgccacctccgcctcccgggttcaagcgattctcctgcttcaggctcctgagtagctgggactagaggcatgtgccaccacacctagctaatttttgtatttttagtagagacagggtttcatcatgttggccaggctggtctcgaacttctgatcttgtgatctgcccgccttggcctcccaaagtgctgggattacaggcgtgagccaccgtgcctatcctattttttttctttttctttttctttttttaagatgaagtcactctctgttgcacaggctggagtgcagtagcacgatcttggctcactgcatcttttgcctcctgggttcaagcgattctcagcctcctgagtagctaggactataggcgcgcgccaccacgcctggctaatttttgtatttttttacagagggggtttcactatgttggccaggctggtctcgaactcctgacctgaagtgatccacccaccttggcctcccaaagcgctgggactacaggcatgagtcaccacgcctggccaaaaaaaagattaatcttaaacataaccagaagtctagatgtttgacaggtttatttatttattgagacaaggtctagctctgttgcccaggctggagtgcagtggcgtgatctcttgggtcactgcaacctccacctgtgggttcaagacaccctcccatctcagcctcctgagtagctgggactacctgcctggctaagttttgtatttttagtagagaccaggtttcaccatgttgcccaggctggtcttgaactcctggcctcaagtgatccagcacctggcctcctaaagttctgggattacaggcgttggccaccatgcctggtcagtttggcaggtttaagggttgacttatgcctgtgactgtggctatctttctttatattctcatggcttaccccaggctggccacttgtaatatatggtcatcttaaccaaattagaaaaaggtattccagttgatgtggtggctcacgcctgtagtcccagcactttgggagaccaaggtgggtaggtctcttgagcccaggagtttgagatcagcctgggcaacataacaagacctcgtctctacaaaaaatacaaaaattagctgggcatgattgtgcatgcctgtagtcacagctactcgagaggctgaggtggagcccagaaggcagaggttgtagtgagccaagatgggaccactgcaccccagcctgggcaacagagccaacctgtcttaaaaaacaaaaaacaaaaaacctgacatgggactttgaatattctagtattgaatgaatgaggaataaagagatggatgggtggatggatggacggacagatgaatgaattgatagatggatgagttgaatgggtgatggaaggatggatggatggacaggtggatgaatggatggatgggtggtggatgaatggatggacaactgaatgaatgaatgaatgaatagattgacaagtggatgggtgatgggtggaaggatagatggtcagatggatgggccatggacggatgaacggacagatggatgagagagagagagagattcctctgggcagcagacaatttccttaaaaacaaacaaacaaaatctcctttttcgggaagatacaaccacacatacgggctgaatgtcagcccccaatcatctactcggcacttccatagcacagggcacaattttgggcaagtgctcatttcgtgaggaccacagacaggcaccatttttttaagggttggtgggatgatcaccactgtttgaggccttatattcaaggattacaatgttcagaggagaaaatagaacgacttccaggatctctgccagagcgccaggaagaacttcctcggaaacatttaacaaaactctcctcgtatctcattggcctgatttgagttacatttcctttcttttctttcttttttctttttctttctttctttctttctttctttctttctttctttctttctttctttctttctttctttccttccttccttccttccttccttccttctttctttctttctctctctctctctctttttttctttccttccttctttttttttttcttttttttgagacatggtccagctttgtcgttcaggctggagtgcagtggcacgatcttggctcactgcaacctccgcctctgggttcaagcaattctccccgcctcagcctcctaagtagctgggattacaggcacccatcaccacgcctggctgatttttgtattttttagtagagatggggttttaccattttggccaggctggtcttgaacccccgaccttaggcgatccgcctacctcggcctccgaaagtgttgggattacaggtgtgagccaccgcgcccggccttctttctttttttgaggtaagattcacaaaacatttttaaaatcaccctttggggccaggcatggtggtgtgtgcctgtagttccagccactagggaggctgaggcaggaggatcacttgggcccaggagcctgaagtgcgctatgatcactccactgtacttcagcgtgggtgacagagtgataccctgtctcaaaaaaaaaaaaaaaatcaccatttaaagtgaatagttcactgttttttgtcacattcacaatgttccacagctatcatcactatctagaacatttttaccacagcaaaacaaaagaaaaaaacaaaaagcaaaacaaaaaacaaaaaaccataaccattaagcaaacattctccattccgcccctcctcctaggccctgagaaccacaatctacttcctgtctctccggctttgcttattccgtgtgtttcatcccatataaatatattcataaaatatgtggtcttttgtgtctgtgtctgtttccttcctctccctttctttctttctttctttctttctttctttctttctttctttctttcttcctttttctttctttctttccactttctttctttcttcctttctttttctttttctttcctcttttctttcatatcatggctcactacagccttgacctcccaggttgaagagatcctgccacctcagcctcccaagtagctgggactacaggtgtgcaccagcacccctggctaatttttgtatttttttgtagaaacgtgctgttgccatggtgcctgggctggtctggaactcctgagctcaagcaatctgcccaactcggcctcccaaagtgctaggattaccggtatgagccactgcgcctgactggggttcttttttgtagcatgatgttttcaaggttcatgccagttgtagcatgcatcagtattttcttccttttcatgtctgaatgatattccactgcatagataaactaaatattatttatccagtcgttaattgatgggcatttgatttgtttccactttatggaccgttacgaatagtgctgctatgagcatttgtgtgccagttaatgtttgaacacctgtatactagtatacacccaggcattaaattgctgggtcatattgtaattctatgttcaactttttgaggaactgccaaactgttttccatagaggctgtaccattttacattcctagcagcaatgtacaaggcttccagtttctccatatccccatcaggcttgtaattttccttttttttttttttttttttttttgacacagagtctcactctgtcgcccaggctggagtgcaggggcgtgatctcggctcattgcaacctctgccccctgggttcaagcgattctcctgcctcagcctcctgagtagctgggattacaggggcctgccactgtgcctggatgatttttttgtatttgtagtagagatggggtttcaccatcttggccaggcttgtcttgaactcctgacctcgtgagccatggcgcctggctgtaattttccatttttaaaaattataaccattctattgtgtgtgaagtggcatctctttgtggtttttatttgcatttccctaataacgaatgatgttgagcatctgttcacgtgcttgttggccatttgtagatcttctttggagaaatgtcttcaaatccggggcccatttttaaaaactgggtgctttgctttttttgttgttgagttgtaaagttctttacatattccagacagtagagccttatcaaatatgtgatttgcaaatattttctctcattctgtgaactgccttttctgtccttcgatactgttctttgatgcataaaaggttttaattttgatgaagtctagtttctcaacctttgctgttgtcacttgtgtttttggtgtcatatttaagaaaccattgccaagccaaagataatgaagatttccctctgggctctcttttaagtattttatagttttaacttttataatttagatgttaatattatggcgtgagttcaaagtccaatttcattcttttgcatgtggatatctcatggtcccagggtcatttgttgaagagactgttctattaaattatgtcttttaggctgggcacggtggctcatgcctgtaatcctagcactttgggaggccaaggtgggtggatcaccagaagtcaggagttcaagaccagcctggccaacatggcgagaccctgtctctactaaaagtgtaaaaattagccaggcatggtggtgtgcacctgtagttccagctacttgggaggccgagacaggagaattgcttgaacccgggaggtggaggttgcgtgtgccgagattatgccactgcactccagcctggatgacagaacaagactccatctcaaaaaaaagaaaaaaaatatatgcctttttcagcaatttggatggagctggaggccattaatctaagtgaagtaactcaggaatggaaaaccaaatattgtatgtcctcacttataagtaggagctaagctatgagtacccaaaggcatacagagtgatataaaggactttggagtctcagaagggggaggatgagaggagggtatggatgaagactacatgttgggtacatgtgtaactacttgggtgatgatgggtgcattaaaatctcaaaatttaccactatataattcatctatgtaaccaaaacccacttgtaccccaaaatctattgaaatttttaaaaaaagagagagagggaaactgttctttcgcctattgaatggccgtggcacgcttgtcaaaagccgattcactggctgggcatggtggctcacacctgtaatcccagcactttgagaggccaaggtgggtggatcacctgaggtcaggagttcaagatcagactggccaacagggtgaaagcccgtctgtactaaaaatacaaaacttagccaggcgtggtggtgggtgcctgtagtcccagctactcgagaggctgaagcaggagaattgcttgaatccaggaagtggaggttacagtgagtcaagaattcgacactgcactccagcctgggtgacagagcaagactccatctcgaaaacaaacaaacgaacaaacaacaacaaaaagccaactgaccacactgggtgcagtgggtcacgactgtaatcccagcactttgggaggtcaaggtgagaggattgcttgagcccaggagtttgagaccagcctcagcaatatggcgagacttcatttgtactaaaaacaaaaaacattagccaggtgtggtggcacgtgcctatactcccagctactagctatgtgggaggctgaggtgggaggattgcttgagcccaggaggtagtggttacaatgaactgtgattgcgccactgcactccagccagggcaacagagaaaatgctgtctcaaaagaaaaaatcaattgactatagatgtatgggtcatttccagactttcaattctattccactaatctatatgcctatcctcataccagtatcacaccttttgattattgtggctttgtagtaaattctgaaatcaccaagtgtgagtcttccaactctgctcatttttcaagattggctcttgggtgcaataccatgtgaatattaggtttgaattttccaggtctgcaaacaaggacgttgggattttcatagggattatatcaagtccatagatcactttgggatagtattatcatcttaacaatattaagtcttctaattcataaacacgtgtattagtctgttttcatgctgctgataaagacatacccaaggctggggagtttacaaaagaaatcggtttaatggtcttacagttccatgtggctagggaggcctcacaatcatggtggaaggcgaaaggcattttctacatggcggtggcaagcgagagaatgagagccaagtgaaacgggtttctccttataaaaccatcagatcttgtcagacttattcactaccacaagaacagtacgggaaaaactgcccccatgattcaattatctccccctgggtcccttccacaacacgtgggaatcatgggagtacaattcaagatgagatttgggtggggacaaagagccaaaccatatcaacatgtgacgtcgtctttctatttatttaggtcttcgtatttgctttcagccacgttttgtagttttcagggcactagtgttactcctacttggttaaatttatttatttttattctattggaagtgaaattgttttcttaattttactttctgattgtttattgctagtttatggaaatgtggctgatgtttgtgcgttgatcttcttttttttttttttttttttgagatggagtcttgctctgtcacccaggctggagtgcagtggcatgctcttggctcacagcaacctctacctcctgggttcaagtgattctcctgcctcagcctcccaagtacctggaactacaggtgccctcaccacgcccagctaatttttgtattttttactagagacaggctttcaccatgttggccaggctggtctagaactcatgacctcaagtgatccacccacctcggcctcccaaggtgctgggattacaggcatgagcaaccacgcccagctgcaaactaccttttcaatgacagttgtctcctaatttgttggcctcagcataggtagataataataaaacctacattttaaaacattaaagggcaatgttcagccaggcacagtggctcacgcctgtaatttcagcactttgggaagctgaggtggacagatcacctgaggtgaggagttcgagaccagcctggccaaaatggtgaaaccctgtgtctactaaaaatacaaaaattacctgggcatggtggccgacacctgtagtcccagctacttgggaggctgaggcaggagaattgcttgaacccaggaggcagaggccacagtgagccgagatcgtgccactgcattctagcttgggtgacagagagagaagcggtctccaaaaataaataaataaaaatagatgagtcacttccaagatggccaaataggagcagctccggtctgtagctcccagcgagatcaacacagaagacaggtgatttctgcatttccaactgaggtacctggttcatctcactgggactggttggacagtgggtgcagcccacagaggtgagctgaagcagggcagggtgtcgcctttcccaggaagtgcaagggttcaggggatttccctttcctaggcaagggaagccgtgacagactgcacctggaggaacggtacacttccatccaaatactgtgcttttcccacggtcttagcaactggcagaccaggagattctctcccgttcctggctcggcaggtcgcacgcccacagagccttggtcactgctagcgaagcagtccaagatcaacctgtgatgctgcagcctggtcagcaactatcatcagactgaacaggcaatctacagattgggagaaaacttttgcaatctgcccatttgacaaagggctagtattcagaatctacaaagaacttaaacaaatttacaagaaaaaaacaaacaaccccatcaaaaagtgggcaaaggatatgaacagacacttctcaaaagaagacatttatgcagccaacagacacatgaaaaaatgctcatcatcactggtcatcagagaaatgcaaatcaaaaccacaatgagataccatctcacgccagttcgaacggtgatcattaaaaagtgaggaaacgacagatgctggagagggtgtggagaaataggaatgcttttacactgttggtgggagtgtaaattagttcaaccattctgcttaatagccacacactgtgtggctattcctcaaggatctagaaccagaaataccatttgacccagcaatcccttcactgggtatatacccaaaggattataaatcatgctactataaagacacatacacacatatgtttattgtgccactattcacaatagcaaagacttggagccacccaaatgtccattaatgatagactggattaagagaatgtggcacatctacaccacggaatactatgcagccataaaaaaggatgagttcatgtcctttgcaaggacatggatgcagctggaaaccgtcattcttagcaaactatcacaaggtcagaaaaccaaccaccacatgtttcactcataggtgggaattgaacaatgaaaacacatggacacagggcagggaacttcacatattggggcctgttgggggtagtgggggcggggagggagagcattaggacaaatacctaatgtaaatgtcgagttgatgggtgcagcaaaccaacatagcacatgtatacctatgttacaaacctgcacgtcgtgcaacgtcgtgcaaatgtattgtagaagttaaagtataataaaaaaagaaaaaaaatccattcatatatcaataaaaaatagatcaatcaatcaataaaacattaaagtgcaatgtcgacaagaggtggtaaaagcaggcatccttgtgttgttcctggtctttgtggggaaatctttaaatttgtaagcctttcactgttgcatatggtgtaagtctcttcctttctttctttctccttccttccttctttccttccttccttccttccttctttctctcttccttctttttctttctttctataaatagaaacagcaggccgggcacgctggctcagcctgtaatcccagcactttgggaggccgaggcaggcggatcacgaggtcaggagatagagaccatcctggttaacacagtgaaactccatctctactaaaatacaaaaaaaaaattagccgggcgtggtggtgggcgcctgtagtcccagatactcgggaggctgaggcaggagaatggcctgaacccaggaggtggagcttgcagtgagacgagatcatgccaccgcactccagcctgagcgacagagcgagactccgtctcaaaaaataaataaataaaaataaataaataaatagagccagcgtctcactatgttgcccaggctggtctcaaacttctaggctcaagcaatcttcccaaagtactggggttacaggagtgagtcaccttgcctggcctggtgtaagttttttatatatgccctttatcctgttgaagaagttctcttctggtctttattatttcagtattctttgttgttgttgttgttgttttgttttgttttgttttaaatcctgaaaaggtgttgggttttgtcaaaggctgttttctacattatcccttaattctattaatgttgtgaataacatttatttatttatttatttatttatttacttattttgagatggagactcactcagtctcccaggctggagtgcagtggcatgatctcggctcactgcaacctccatctcctgggttcaagcaattttcctacctcagcctccctaacacctggcattacaggcgtgtgtcaccacgcccagctaatttatttttattttttgtatttttagtagagacggggtttcaccgtgttggccaggctgatcttgaactctttacctcaaatggtccacctgcctcggtctgccaaaagtgctgggaatacaggcgtgcactaccgtgcctggctgagttttttcttttttgagacagggtctcactttgtcacccagggtggggtgcagtggcacaaacatggttcaccgcagcctcaacctccccagctcaagtgattctctcacctcagcatgccaagtagctgggactacagttgtgagccactgcgccctgccctgattttcttataatgaatcacccttacattcttgggataagtctcatctgttaacacatatgtataatatgtttctatgctgctggatttgatttgctagtattttctttaggatttctgcatctatatttataagggacattggtctatagtttccttttcctgtaatgtcattgtgtggctttggtatcagggtaatgctggcctcatagagtgggtcagaaatgttgcctcctcttctagttttgggaagattttaataagaattggccttaattattcaaatacctggtagaattcaccaatggagccatcgggtcctgagcttttccttacggaactttaaaaaattgttaccaattccatctctttccttgttatagatctattccgacttcctagtttttcttgggttagtcttggtaatttgtgtgtttctagaaatttgtacatttcttccaggtgtattcaattaattgacatgtcattgtttatagtattctcttataatcttttatttttgtaagggttgtagtaatctttggttcctgattttagtggtttgggccatctccattcttcttctgggggcatcagtatttccaaaagtttagcaattttgctgatttgttaaagaaccagtttttggttttgttgactctattgcttttatagaatactatattttatttatcttcactgtaatttttattgtttttttgctgctgcttgctttcggcatagtttgatctttttctaatcccataaggtggaagaatgtattatttatttgagatctgtctttctttttttgcttgagacaaggtcttgctctgttgtccaagctggagtgtagtggtgcaatcatggctcactgcagcctcaaactcctgggctcaagtgatcctcctgcctcagcctcccaagtagctgagatcacaggcatgtgccacgatgcctggctagattttttatttgtatttttcatacagatagggtctcgctatattactgaggctggtctcaaactcctggcctcaagtgttcatttttttttttttttttttgagatggagtttcactcttgttgcctaggctggagtgcaatggcacgatctcagctcaccacaaccttcgcctcatgggttcgagtgatccacctgcctcagcctcctaggtagcaaggactacaggcatgtgccaccatgcccagctaattttgtctttttagtggagatggggtttctccatgttggtcaggctggtcttgaactcctgacctcaggtgatccacccgcctcagcctcccaaagtgctgggattacaggcgtgagccactgcgcccaccctctttcatttttgatgtaggtgactacagctataaatttccctctgagcattgtctttgctgcatctcataagttttggtaagttgtactgctttttcattcatctcaaaatatttaaaaatttttttatgatgtcttattttactcattgtttatgttaatttctacataatcgtatatttgtgaatctaaaaattttctttctcttgttgatttctagttttattctgttgtggttgaagaaattactttttttttttttttttggcagggtctcactctgtcgcccaggctggagtgcaatggcctgatctcagctcactgcaacctccgcctcccgggttcaagcaattctcctgcctcagtctcccaagtagctgggattataggcacccgccaccacacccagctactttttgtatttttaatagatatgcggtttcaccatgttggccaggctggtctcaaactcctgacctcaggtgatccgcctgcctcggcctcccaaagtgctgggattacaggtgtgagccaccgcacccggccaaaagtactttgtatgatttcaacttttttttttttttttttttttttgagacagggtctctctctgtcgctcagtctggagtacagtggcgtgatctcagctcactgcaacctccacctcctgggttcaagcaatcctcctgcctcagcctcctgagtagctggaattacaggtgcccacaaccatgcccagcaaattattgtacttttagtagagatggggtttcactgtgttggccagggtggtctcgaactcccgacctcaagggacccacctgccttggcctcccaaagtgttgggattacaggcgtgagccaccgcgcccagccgataactcaaaaattttcaagaggcaaagacttattttttaacagatgtgagactcagtgttttaaacaagacccaataaagacagtatgaggctaactgaatctgtccctcctgcaaagaaacatttttttactgttttttaatattacatgaaaattttgtttaaaaaactaaattttacctttgtatgtaaaattgttcctttagtagttttaattacatatattataatgttaactcttaggcagtctccgcctctcgggttcaagcaattctcttgcctcagcctcccgagtacctcagactacaggtgtgcaccaccatgcatgcccagctaatttctgtatttttagtagagacagggtttcgccatgttggccaggctggtctcaaactgctgacatcaggtgatctgtccgccttggcctcccaaagtgctgggattacaggcgtgagccactgcatccagccattactgacttttatttttaatgaaaaactaaggaggtaggcaattttaattatgtaccaggtacagagtctaggacagtaataatatatgtcaataatatatgatgctttttaggataggcaggggacatggttaattctacacatccccaggccttatctacaatctaagggctttaaaatagacaagtccaacaattatttaaaatattatagaagggccaggcatggtgcctcatgcttataattctagcactttgggagcagaggctggtggacgccttgaacctaggagttagagaccagcctggccaacatggtaaaactcgatctccactaaaaatacacaagtgagctagacatggtggtacgtgcttatagtcccaactacttggaaggctgaggtggaaggatcacctgagcccagggaggttgaggctgcagtgagcatgccactgtactccagcctgggcaacagagtgagtcccagtctaagaaaaaaatttataaaagtagtttaggacctgaaaggtcttagtaaagacaataccagacttgtctaatttacaccaaatgttcacattctgaagatgtttttattttactaataattgaaaaactgtctttatttactaaagattattaaagtcatgtgaactaaaagatacttaaagtttttattttttgatgaaatattcaatttaagtggttaagtcaactgattagagcttttaaaaatatatttcagtagtgaaatattatatattcatggcacatataaacatagacataacagacagaagtagatcttatagacttgtaagactttctgtcaattttaaaatttttattaattaattaatttattagagacaaggtctcactctgtcacccagactggaatgcaatggtataatcatagctcactgtagcctcaaattcctgggcttaactgatcctctcgcttcagcctcctgagttgctgggactacaggcatgcaccaccatgcccagataattttaaaaattttttatagagatggtgtctcactttgttgcccaggcaggacttgaactcctggcctcaagtgatcctcatacctcagcctcccaaagtgttggaattacaggcttaagccaccacatctggctggttttaattattaaacaataacaaaaaaattcattttctaaaaaaaagagtactgtggcctctatacaaaaataaagaaaaacaatttagcatagtgaaaacaagatagagtcaataatattaaatttgtatttttgagacagagtctcactctgttgcccaggcttgagtgcagtggcttgatctcagctcactgcagcctctgcccccctggttcaagcaattctagtgcctcagcctccggagtagctgggactacaggcttgcaccaacatgcttggcttatttttctatttttagtagagacagggtttcaccatgttggccaggttggtcttgaacccctgacctcaagtgatctgcccgcctcagcctcccaaagtgttgagattacaggcgtgagccaccgcgcccagtcaattatgttaaattacccttattactatgatttttataaaagtggtttcaagcatataaagaatgtttgttattactattatgtattattttctttatcatgatacttcagtcaaaaggaactgcttaggacagcttgaatatgtcccatagttacagcctgcaagcctttttctttgctgtgccatgtgcctaagacaccatccttcgtttgtgtgtgtcaaaaccccaccagtctgtcctcttaatcccaacaccaatgtcctgggtgccaataaaggctttcctcacctccaaattgagattttattgacctctcttggggtgcttatactggctttgggttgaaatctattttttctcctctcccttgaagaagcacgtctctttgcttaagggaacgtagaagccacagcagatcctagcagatatctgttaccctgaagaagaggtcagggcccaggcacggtggctcatgcctgtaatcccagcatttggggaggtcgaggtgggcggatcgcttgagcccaggagttcgagcccagcttgggcaatatggcaagacaccgccccccgactctacaaaaaatacaaaaattagccaggcgtggtggtgagtgcctgtagtaccagctacttgaaaggctgagttgggagaatcagctgagcccaggaagttgaagctgcagtgagccgtgatcgcaccactgcactccagcctgtgcaacgtggcaaaaccagagtggggccttgtctcattttaaaaagtaataagagaccgagcacgggaactcaggcctgtaatcccagcactttgggaggctgaggcggccagatcacttgaggccagagagttggagaccagcctggccaacatgggaaaaccctgtctctactaaagatacagaaattagccgggtgtggtggcaggcacctgtaattgcagctactgggaggctgaggcaggagaatcgcttgaatctgggaggcggaggttgcaatgagcagagatcgagtcactgcactccagcctgggccgcagagcaagaccctgtctcaaaaataaataaataaataaataatttaataaataagaagaaagggtcagggccatttttaaaaggcactagataaggcctggttgcaatcagggagtgcgggcaactgatttctttgaagcctcctcttgttctgtttccgtgacattgacagggaccagctcccatggttcaggagctgctgagggttaacatcctgtcccaggagggatctgaccacaccaatggctttatcgttgcctaattggggaggccctgtgggggatgtttcaaggactgagagtgcagaggagcctcccgcatgcagttacgctgatggaaacacaatgggtggattgccacaggggcccgcaggctcgctggcaaacagagcgcacaggtggaaaccttccccgctgaccagatactttgtttcctttctggggaggcagataaaacagttaccataacccaaaccctgcccactcttcatttgcaaactgcaatgctcttagacatcttccttaggtaagcgctttgagagctcctgttcatttcaggactaaaatgaacaataatagcgaccgtccttcagagcctgctggatgccaggcacctcacaagtgtctcccagtgctgggtgcagtgattcacacctgtaatcccagcactttgggaggctgaggtgggtggatcgcttgagctcaggagatcaagaccagcctgggcaatatagtgagaactctgcctctaaaacaaagaaaaaggaaaaagtaactcctggtgaatttccaccttagaacaagagtgggaggtgtcctattcatgatctttaatgctttgctcaaatatcaccttctctgtgaggcctaccctgaccactctgcttaaaattgcaaccctccaccacctccaccccgcatcgcaagttctcgtcacagcctttctcacctgctacccactccatgatttacttattaagtatgtttgttaggccgtgtgcagtggctcatgcctataatcccagcactttgggaggctgaagcaggtggattacctgaggtcaggagttcaataccagcctggccaacgtggcgaaaccccatctttacaaaaatacaaaaaagttagccaggtgtggtggtgcgtgcctgtagcccagctactcgggaggctgaggcaggggatttgcttgaacctgggagggaaggttgtagtgagctgagattgcaccatcgtactccagcctgggcggtagagcaagactctgtttcaaaaaaaaaaaagtattgctaagtcaaaaagtataaacagtctaattttttttttttgagacaaagtctcgctctgttgcccaggctagaatgcaatggcacggtttcggctcattgcaacctctgcctcctgggttcaagcgattctcctgcctcagcctcccgagtagctgggattacaggcatataccaccatgcccagctaactttttgtatttttagtatagatagggtttcaccatattggccaggctggtctcgaacttctgacctcgtgatccgcccgccttggcctcccaaattgctgggactacaggcaagaaccaccgtgccctgcctgaagagtcgaaatttttttttttttaaacagtttcactctgtcgcccaggctggaatgcaatggcacattctcagcccactacaacctccgcctcccaggttgtagccattctcctgcctcaagcctcccaagtagctgggattataggcacccaccactatgcctggctacattttgtagtttttttttttttctttttgagacggagttttgctcttgcttcccaggctgtagtgcaatggcgccatctctgctcaccacaacctccgcttcccagattcaggtaatcctcctgcctcagcctcccgaatagctgggattacaggtatgcgccaccacgcccagctaattttgtgtttttagtagagatggggtttctccatgttggtcaggctgaacaaccgacctcaggtgatctgcccgcctcagcctcccaaagtgctggaattacaggtgtgagccaccacgcctgggtctactttttgtagtttttagtagagacagagtttcaccatgttggtcaggctggtctcgaactcctgaccttagtcgatctgcccgcctcagcctcccaaagtactgggatcacaggcgtgagccactgcgcccggcccaaatagtctaaattttaataaatactgccaaataacactttcaaaagagtatccattcatactcccaccaatggtacataaaaagtctcaataacaattggtaaaattggtttggtggggaattcaactctacactgctgagctgctgctatttgcaaccatagaatcttttttttttttttcttctgagacagagtctcgctttgtcaccgagactggagtgcaatggcgctatcaaggctcactgcaacccttgcttcccggctttaagtgatcctcctgcctcagcttcccgactagctgggattacaggagtacgccaccatgcccagctaattttgtatttttagtagagacagggtttcaccatgttggccaggatggtctcgaattcccgacctcaggtgatctgcccgccttggcttcccaaagtgctgggattacaggcgtgagccaccgtgctgggccctgcaaacatagaatcttagagttgaaagggacataaaaatccatcgaattcttgtccaactcccctcccaaggcagcaatcccctgcaatacagccttgtttacaacgctgttgtctgtgactggggtcaaactccacatctttgatcttaagaataaaccaccactgacagtgggcttatcacatccagtaagtttgttatatcactgggccaaaatctactttcctggtggggcccggtggctcacgcctgtgatcccaggactttgggaggctgagtagggtggatcacctaaggtcaggagccagagaccagcctggccaacattgcgaaaccccatctctactataaatacaaaaactagctgggtgtggtagtgcatgcctgtagtcccagctactcggaaggctgaggcaggagaatcacttgaacccaggaggcggaggttgcagtgagtggcgatcactgcactgcactccagtctgggtaacagagcgagacacacacacacgcacacgcacacgcacacgcgcgcgcgcacacacacacacacaccctacctttcctgcaacacaccccacctatcctagctcagctctgggaagtaacacaaaagagctaatccttttccacatgacagcccttaaaatatttgaagactgtatcacatttccccagagccttctttttgtggggtacaacttcccagttgtgaccaaacacgtcccttccataggaaagtgctgactggagtctcttcagctgagtggcccagcataagagctttagagtcactaggcttgggttcaaggccatgttcccaccccttccagccacctgacctgggctaaatcacttctcagactagtttcctcccttggataaactgcatagcaataatacccatgtcatagggttgctggtttggccacattatgattttttttctttttgagacagagttttgctcttattgcccaggctggagtacagtggcacagtcttggttcactacaacctccgcctcctgggttcaactgatttttcctgcttcagcctcccgagtagctgggattacaggcacctgccaccatgcccagctaattttttgtatttttagtagagtcggggtttcaccatgttggccaggctggtctcgaactcctgacctcaggtggtccacccgccttggtctcccaaagtgctgggattacaagtgtgcgccactgctggccttttttttttttttttttttttttttttttgagacagagtcttactctgtcacccaggctgaagtgcagtggcatgatctcggctcactgcaacctccgcttcccaggttcaggtgattctcttgcctcagcctcctggtagctaggactacagacacccggcaccacactcagtcacatggatttttttggtgggttccttcctccataagaaaaaaagtgttttaaatcatattttatgactgtgttagtataaggatgaatataacaaggcctggtgcagtggctcatgcctgaaatcccagcactttgggaggccaaagtgggagaattacttcatcccaagagttcaagaacagcctgggcaacatggcaagaccctttctctacaaaaaataaaaaatataaaaattagccggaagtggtggcatgtacctgtggtcccagctcctcgggaggctgaggtgggaagactgcctgagcccagggggtcaaggctgcagtgagccatgattgtgccactgcactccagcctgggcgccagagctcctgctcaaaaataccaaaaactaaaaactaaaaataatatatatatgtaataaaggcagggttatgtttattttttcttctgattttaaaagaagtaaaacattttcatggggccctaaaagtattgtgggccttaggcatcatgccttctgtaagttcataggccctggctgctggaaggagtaaaaaagaaaaaacatgccaaatatgtaaagtgcttagcgcagcactgggcctggctctttgtaacttaataaatggtgatcaaaaattaaaaagtgcaatgcaggccgggtgcagtggctcacgcttgtaatcccagcactttgggaggccaggtgtgcggatcacgaggtcaggggtttgagaccagcctggccaacatggtgaaaccctgtctgtactaaaaaacacaaaattaaccaggcatggtggcacacacctgtaatcccagctacttggaaggctgaggcaggagaattgcttgaacctgggaggtggaggttgcggtgagtcgagatcacaccattgcattccagcctgggcaacaagagtgaaactccgtctcaaaaaaaaaaaaaaaaaaagttgggggtgtagtgcagagaacagagtgtaaccctggagaactctgcagagctttccttttttttttttttttttgagacggagtctcgctctgtcgcctaggctagcacaatctcgactcactgaaacctctgcctcccgggttcaagtgattctcctgcctcaccctcctgagtagcggggattacaggtgcatgccaccatgcccggctaattttttgtatttttagtagagacatggtttcaccatattggccaggctgctcttgaactcctgacctcagttgatctgcccaccttgacctcccaaaatggtgggattacaggcatgggccaccacacctggcctgcagaactttctttattggcatgcattgggacttgcagactcagcttcagctgaatgtaaggaacagttcctgggtccatgttttctcactgtgttcacagagtcttgcaagagattctgcaaaaagacacacagtctatggcatttatcttgagacgagagaaagtatacatttaaggacatgtgcgtgaagaattctggaaggataaagaagatattaatttatagccattacctattgagaaggaaggattgggaatattgtgaataggtccaggagtgggagagagactttccactgtatgcctactgatagttttgatgtgtaaacaatgataatagagtgctgattcaaaaatgttaataattttttttttttttttttttgtgatggagtctcactctatcacccatgctggagtgcagtggcgcaatctcagctcacttcaacatctgcctcccgggttcaagcggttctcctgcctccacctcctgagtagctggaataacacttgtgcaccaccacacccagctaatttttgtatttttagtagagacagggtttcgccacgttggccaggctggtctcgaactcctgacctccggtgatctgccagcctcggcctcccaaagtgctgggattacaggcttgagccactgcacctggctcaaaaatcttagtaatttttttgactgtcctaaattgtttattaggtatgagttttacaaactttacttatattagtggtaacagtggagattgagagtattgcgccttctccaagctgcccggcaagaaccaccaatagtgtggtggaacttacggccctttccaaggccatggctcttttggcctgcacatgccagcccacgcatctccttgtgcttgtggactggtttggtgatccactgggtgtcaggatttcttccaatagctttatggaatggatcaatgaggataacctcaaaaaatttgtgtgtggaatcttcacccatccagtaagaattcaggactcttagagccccacagtggcgtccaactcactcctctgcaatcaactgtaggcttcagttaataccatgatggacaggcttgccgtaagttgcacccttaggaactgagcattttcggccatcacggagaatacgaatcccgtagataacataaccttgcttgatcttgtagcccagttggtgcactttatcgggccgggtggggcggggagccctgtggagagcagagagctggcggtactgccagcagcggaccctcagaagaaagctcatgacatcagactgcttcttcctccacagctcgtggatgtacttgtatgcacccatcttggcttacctgattgctgccgccagacagaagggccaaaaatcttaataatttttattttgaaaaatatatgcatgtggttagaaaaaacttcaaacagttcaaaagggtgaaaagcaactctccctcttgtacccagggagtacctggtaagatataacatctcatacaggacttacagaacctctataaaaactattaaaaaattttgttgagagacagtaaagaagacctaaataaatggagagatatacatgttcattgattggaagagcctagatttgaaggcgccaactcttgtattgattcatagatcaaatttaatcccaatgaaaagctcagcctttttttttttttttttttttttgcagaacttgacaatctgattccaaaactgataggggaataaaagggagtcaaactacccaagacactcttgggaggaaaaaacaaaaccaaaaatgaactgtgggctgggcgcagtggctcacgcctgtaatcccaacactttgggaggccgaggcaggtggatcatctgagatcaggagtttgagaccagcctggccaacatggtgaaaccccgtctctaataaaaatacaaaaattagctgggcatggtggtgggtgcctgtagtcccagctacttgggaggctgagggaagagaatcgcttgaacccaggaggcaatggttgcagtgagtcgagattgtgccactgcactccagcctggcaacagagcgagactccatctcaaagaaaaaaaaaagctagacatcaagttagggagaggaagacaaaccagaacccacattcctttttgacgctgttgtttacttttccattatagccattctagcacaattagagtaatatcttattgtggtctgttgaaatactttagaggaagttacacagatcatgatagattactttaaatgccatgccatatatctctaaaaatacacgtttatgtattggaagactcaatattgttaagatggcgatactactccaaagtgatctatagacttgatgtaatctctatgaaaatcccaatgtccttgtttgcagacctggaaaattcaaacctaaaattcacatggtatcgcacccaacagccaatcttgaaaaatgagcagagttggaagactcacacttggtgacttcagaatttactacaaagcaacaataatcgaaaagtttggtattggtaggaagataggcatatagattagtggaatagaatcgagagtctggaaataacccatacatctatggtcaattgttttgttttgttttgtttttttgacagagtctcaccctgtcacccaggctggagtgcaaaattatcacacctgtaagttccgaaattttttctcttattatttcatctacagctttttttcctgtgttttgtcagttttatttttctgaaatgcttattatttagatgtgggatctttttgtgtgaccttctaatgttctccattttctctgatctctgcaagatttcagcaatttctttcttcttcccttttctttttttacttcttgctttcttaatttctgagagctcctttttgttccctgaatgtttcttttaaaagatatactggtcgggtgcagtggcttacacccgtaataccagcactttgggaagccaataggaggatcgtttgaagccaggaatttcagagaagaattctgcaatctcctcattgaaggttgtggtagtcatacctgaccctgtgaataattctaaccaaggctgggcatggtagcttatgcctgtaaccccagcactttgggatgctgaggcaggtggatcacctgaagtcaggagtttgagaccagcctggccaacatggcgaaaccccatttctactaaaaatacaaaaattagctgggcatggcagtgcatgcctgtaatcccagctacttgggaggctgagggaggagaatcgcttgaacccggagctgagatcatgccattgcaccccagactgggcaacaaaagtgaaattccatctcaaaaagaaaataaaataaaaataaaaaaattctaaccaatgaggtatgattgaaaatgacacacgtctttgccaatcatacttcattggttagaattattattattatttgagacagagtctcactctgttgcccaggctggagtgcagtgttatgatctcggctcactgcagcctctgcctccctggatcaagagattcttctgtctcagcctcccaagtagctgggattacaggcatgcaccatcatgcccagttaattttttatacttttagtagaaatggggcttcactatgttggccaggcttgtcttggactcctcacctcaggttatccacctgccttggcctcccaaagtgctgggattacaggcgtgagccaacatgcctggcctggttagaattattcagagaataattgaacaattattctgtgaacaacctgtaaacgaacaacctgaaaattaaactaaggaaagaaaattaagacaatccacttgcaatagcaccaaaaacaataaaaatacttggtaataaatttaacaaaagatgttcaaaatttgtacactgaaagccatgaaacattgctgaaagacattaaggaagacctaaacaaatagaaaaacatcccatgtgcatggattagaagactcaatattgttaagatgtcaatactacccaaagcaatcaacagatttaatgcaatttcattggtcttttctgcagaagtggaaaggctgattctcaaattcacatggaattgtaaaagactccaaacagccacaacattcttgaaaaaaagaagaacaaagttggagggctcatatttcttgattttaaagcttactacaaagctacagtaatcaaaacagtgtggtattagcttaagaacagacatataaaccaatgaaatagaattgagagtccacaaataaacctatacaattatggtcaattgatttttgacaggtgtgctaagacaattcaatgggagaaagaatagccttttaaaaaaattgtcctaggaccactggataaacatgtacaaaaggatgaagttggaccctaaccttgcaattaccttaaaaattattataaatataagaactaaaactataaaactctcagaagaaaacacaaggatgaattttcatgatcttggacttggcaattaattcttagatatgacaccaaaagtacaagccaaaaaagaaaaatagacaaattagacttcatcaaattaaaaacttttgtgcattgaaggatattattaagaaagtaaaaagacaatgtacagaatgggagaaaatatgtgcacaccatgtatctgataaaagtctatgttttaatgtaattaaaacatgaacaaagttaatttgtgcggcagcaataaaaaagggaaacaaatatgaacaaaggacttgaatagacattcctagaagatacgtaaatcaccaacaggcacataaaaagatgttcaacatcattagtctttagagaaacacagacaaaaaccacagtgaggtctcaattcacacacactaggacagctacaatttttttttaaagtgtgtgtattggggggtgcagctgggaacagtgactcatgccagcactctgggatgccaaggcaggaggatcacttaagtccgggagtttgagaccagcctgggcgacatagcaagactgccatctctccaaaaaattaaaaaattagctgggagtggtggcacacccctgtggttctagctacttgggaaactgagtcgggaggattgaacccaggagtttgaggttgtagtgagctatgatcatgccactgcattctagccagagcaatagggtgagatcctatctctaaattacataaataaataaataagtaaatatgcagaaaataacaaatgctgacaggaatgtggagatattggaacactcatgcattgctggtggaaatgcaaaatggttcagctgctgagaaaaactgtttaatgattcgtcaaaaagttaaacacagaattaccatatatctcagcaattctactcctagaatattcacaaaataaatgaaaacatgcactcacatagatgcacatacacacatgtcgacagaggcactattcaccgcgccggacccaaaacatgtattttcttaggaacaccagatagcacttcagtgctatgcttgggggccatttcaaacagcaaaatcaataataaataccacagaaatgtgaaacctatggcacacaaatgctgcaaaaaggacatttgtggcctggcgcagtggctcacgcctgtaatctcagcacattgggaggccgaggtgggtggatcacctgaggtcaagagttcaagaccagcctgaccaatatggtgaaaccccgtcgctacaaaaaatacaaaaaatagctgggcgtggtggtgggcacgtgtaatcccagccactcgggaggctgagacaggaggattgctcaaacccaggaggcagaggttgcagtgagctgagatcgagccactgcactccaacctggaagacagagtgagactccatctcaaaaaaagaaaaaaaaaaaaaggacatttacaataggacagctgaaacaagaagtcagggtgtggcctcattcaacctcagataggaacatgtgtgttgagcaactcaaattttcttcttttttatttgagacgcagccttgctttgtcacccaggcccaggctgtcccaggcccaggcagtgacgtgatctcggctcactgcaacctctgcctcctgggttcaagtgattctcctgcttcggcctcttgagtagctgggattacaggcacccaccactatgcccaactaatttttgtatttttagtagagactgggtttcgccatgttggccaggctggtctcgaactcctgatctcaagtgatccgccagcctcagcctcccaaagtgctggggttacaggcgtgagccaccgcacccaacccttttttatttttattttcatttttttgagacagggttttgctctgtcacccagactggagtgcagtgatgccattgtggctcactgcagcgtcaacttcccaggctcaagtgatcctcccagcttccaaagtagctgggaccaaaggtgtgcaccaccacagctggctaattttttttgtctatttttggtagagacggggttttgccatgttgctcaggctggtctccaactgctgagctcaagtaatccacccacctcagcctctcaaagtgctggcattccaggtgtgagccatcacgaccagccagggatctcaccattcttaagtgcctctcattgaattctcctgttgatagttgcattgatttctcactccttcttctactctgtctcttgctacatctggaccctctctcattcattttctcaaagacattcatctagaatgtctaatttttgtggttgggatcaatacagttcacttgctttatggggtgggaggagtgtaacttttctttaaactgaattctaagcagttttcagttttaactcactacagtctccatgctatattctgaatgtttatatcccccaaaattcatatgttgaaatcctaacccctaaggtgatggtattaggaggtgagcctttgagagatgattaggtcttgacagtggagttctcatgactgggattagtgcccttataaaagggaccccaggctggatgtggtggctcacgcttgtaatggttcagctaccaaggcccccaaagtgttgagatcgcttgagcccagtggtttgagaccagcctgggcaacatagtgagacgacatctccacttaaaattgaaataataataaataaataaaaaggaccccagagagatcccctgccacttatcataggaaggcacagtgaaaagacagctatctagaaaagcaggtcctctccagacacttgaatctaccagcattttgatcttggacttcggtaccatgttacaacagccatacattgtgctactgatattccatatataattgacattttcagggttttttgttttgttttttgtttttttgttttttttttttttgagacaaaggctcgctctgtcgcccaggctggagtgcagtggcacgatcttggctcactgcaacctccgcctcccgggttcaagtgattatcctgcctcagcctgttgagtagctgggactacaggcatgcaccaccacgcgcagctaatttttgtatttttagtagagatggggttttgccattttggccaggctggtctcgaatgcctgacctcaagtgatctgcccaccttggcctcccaaagtgttgggattacaagagtgagccaccactgcacctggtctcttttctattcgttttgttttttgtttaaataaagacaggggtctccttatgttgcccaggctggtctggaactcctgacctcaagtgatctgcctccctcaccctcccaacgtgctgggattacaggcatgaggcactgaaactggcagaatttgaaggtgaggatttgggcttggcagggaaagtccacgcagagcagagctatgaggaagactgaagcccaagcccaaggtctctcatgacagttaggccatttttggtaaaagatctgaaagtctgaatttggggatcctgtaaataaaacgttcatgggtagggctgaatccaggatgcaaatgaagccatcatgagtctgtttttctccctttcttgacttctgcttgccgtttgttggccccagcctcaggcttcatgtagcagggacacgatggatgtcattcaggtacctgggtcccctcagacttccagtgagaggagtcagaagcaagactctctttccccatattctttttttttttttaaagacgaagtctcactctgttgccccaggctggagtgcattgacaccatctgggctcgctgcaacctctgcctcctgggttcaagcgattctcatgcctcagcctcccgagtagctgggattacaggcatgcgctagcacgtccggctaatttttgtatttttaatagagacggggtttcatcatgttggccaggctggtctggagctcctgacctcaggtgatctgctcgccttggcctcccaaagtgctgggattacaggcgtgagccaccgcacctggcttctttccccagattcttagcccaaattacattgtgactcttgggctgtgactaggtcacatgatctctttgaaccaatcactgtgtccagatgaatgcaatgcactcattgtctaaggctgggaacacattttgggcacagggaatggcctttcaaaactgtacatcaaatcatgtccctttccagtctgaggtcctatccagcaatgattctcaaccaggtcgagtttgccctcccaggggacatttggcaacgtagggaggcatttttggttgtcacaacgtcagggtgtgtgtgcaggtacattcctggcatttggtgggtaggggccaggaatgaggctaaaacatcctgcaatgggtcaggtatgttggctcaaacctgtaattccggagctttgggaagccgcggcaggaggattgcttgagcccaggagtttgacaccagcctgggcaaaatgacaaaacaccatatctacaaagaaaaatacaaaaattagctaggcatggtggcacgtgcctgtggtcccagctactaggaaggttgaggcaagaagatcccttgatcccaggagtatgaggctgtcgtgagctctgatcatgccatgccactccagcctgggtgacagagggaaaccctgtctcaaagaaacaaacaaacaaacaggccaagcatggtggctcacacctgtaatcgcagcactttgggagcctgaggcaggcagatcgcttgagccaggaggattgcttgagcccaggagttcgaggctgcagtgagctatgatcacaccactgcactctgcactccagcatgaacaacagagcaagaccttctccagaaaaaaataaaacccctcaaaaccagacaaagatatctgcaaagataacaggaaataatatttctcccaaggacactgcagctgtcaagtgccatggtgacttcctactgtgaaccactgctttctgacttgctgagaaactttgttccaggaaatcatagataatttgcagtttgaaaatatatcagtgcaggccgggtgcagtggctcacgcctgtaatcccagcactttgggaggccaaggcaggtggatcacctgaggtcaggagttcgagaccagcctgaccaacatggtgaaacccccgtctctactaaaaacacttaagttagccaggcatggtggcgggtgcctgtaattgcagctacttgggaggctgaggcagaactgcttgaccctgggaggtagaggttgcagtgaactgagatcgtgccattgtacttcagtctgggcgacaagaccaaaactctgtctcaaaaaaaaaaaaaaaaaaaaaaaagaaaagaaaaaagaaaagaaaagaaaatatgtcagtacaaatgaaattttttcttcttgcttggaggatctgggcagttggatacccaggcacagcaattcagataagggttccctgaacaaagtggtccacatttactaaactttagaagttaatttttgcctttgtttggtgaagcaacccacagctgctcagttgctctggtgtccctctccctccttttttttttttttttttttttgagacagggtctcactctgttgcccaggctgcagtgcagtggtgcaatcacagctcagtagaacctctacctcctgggctcaagcaatcctcccacctcagcctcccgagtagctgggaatacaggcatgtaccaccatgcttggctaatttttgtattgtttgtggagatggggttttgccatgttgccccagctggtcttgaactcctagcttcaagtgatcccccagcctcggcctcccaaagtgctgggattataggcgtgagccaccatccagcctttccttgttttcaataaatgaataaacctgactttctcactaaaggttagtccctggtggccaggctggtctcgaactcctgggctcaagcaatcctcccacctcggcctctcaaagtgctgggattatatgtgtgagccatcacgctcagcctcatttatgtatttgttatggctgcctttgcactcccatgatagatgtgagaaatggtggcagagactgcagggcctgcaaagcctaaaaaatttacaatctggctctttacagaaaaactttgctgacccctggtctaaatgttctgagtacataagtgagcaaaacatagctaaatccctccatcatggagctgaaattctagtgggaaaaagaaaaggatttacatacttacaagacaccataaatacatctagtatatgacttgtatataacttagggtaattaaatggtaagaaaagaagtggccgggcatggtggctcacacctgtaatcccagcactttggggggccgaggtgggcgggtcacctgaggccaggagttcaagaccagcctggccaacatggcaaaaccctatctctactaaaaatacaaaaattagctgggcgtggtggtgccaacccgtaatcccagctgctcgggaagctaaggtgggaggaagcaccatgcccggcctgcttccactttttggctactgtgaataatgctgttgtgaacatgggtgtacaaatatctgttcaaacccctgctttcactacttctttttttttttttttgagacggagtttcactcttgatgcccaggctggagtgcaatggtgcaatcttggctcaccacaacctctgcctcctgggttcaagcgattctcctgcctcagcctcctgagtatctgggattacaggcacgcgccactgtgcccggctaattttatatttttagtagagagaggatttctccttgttggtcaggttggtctcgaactcatgacttcaggtaatgcacctgcttcgggatcccaaagtgctgggattacagacgtgagccactgcgcccggcctctcttattttggttatatacctagaagtagaattgttgtatttttttccagcaggattttataccaaggacaaagggaggccatgggaagctgcatgcagggtgctttactaggtcccctggggctgctgtgaggcattctgattgtagtggggaaagaaaggaagtggggagaccaaggaggaggtaggtacagaagttcaggtcacaggtagcagcagcttcaaggtcccaatctgggccaggcgctcacgcctgtaatcctagcactttgggaggccaaggcgggcggatcacttgaggtcaggagttcaagaccagcctggccaacatggtgaaaccccgtctctaccaaaaatacaaaaattggctgggcgtggtggtgtgtgcctgtagtcccagctacttaagagactgaggcaggagaatcgcttgaacctgggagatgcaggttgcggcgagccaagatcctgccactgcactccagcctgggcgacagagcgagactctatcttaaaaaaaaataaaaataaaattaaaaaaatgctctcagtctggcaggggaggccatatggagcaaataaataaatgaatgattacaaatagtgaaaagtactcctaaataaatgaacaagaacagagtgctgtgattacaggaaataaaaagaggaactctggcattctctgtgctacctatcagtttagtgatgcttgaaatccaaaattcaaatcttgcattttaatcatgaatcactttgctgccagttgagtgggtttgatgcagggccgagtctgttggtctaagggtttgttacattgtgagagcccctaatggggaggaaggggcttagaaataaggcaaagggggtggtttgagcctgtggctgaaagagttgcacagagaggcttggtggttaggagcagagctgagccttatctctgccacatcccagctgctggatctgcaacaaattacttcttccctctaaacccagtttccgcttttggaaaatggtagactaattggtttggtctataattacttccttctttgttttggtcactcctgtgtctacagcacctaatacagtatccggcacacaggagactcgcaataaatttctttcttgcttttctttctttccttgtctttccctccttccctccctcccttctttctttctcgctgtctgtctttctcgctctttctctttctttctttctctctctctcttttctttctttctctctctctctttctttcctttcttgatggagtctcactctgtctctgagactggagtgcagtggcgccatctcggctcacctcaacctctgcctcctgggttcaagtgattctcctgcctccacctcctgagtagcttggattacaggcatgcgccaccatgcctggctaatttttgtatttttagtagagacggtgtttcaccatattggtcaggctggtcttgaactcctgacctcaggtgatccacccgcttcggcctcccagagtgttgggattacaggcgtgagccaccgtgcccgactctcgtttatttattttctattttaaaaattttaattgaggctgcgcacagtggctcatgcctgtaatcccagcgctttgggaggctaaggcaggagggtcgcctgcggccaggagttcaagaccaacttgggtaacgtagtgagatcccattttacataaatattgcaaaaaatgttagtcaggcgtggtggtgtcccccatagtcacagctacttggggggctaaggcaggaagattgcttgagtccaagagtttgaggctacagtgagcacccactgctctctagcctgaagaacagagcaagagcaagatcatagctcaaaaaaatttttttaattgagtttaactttcatagagcaaagtacagcaactttaaatgtcctcttgatgaagttttttttttttttttgagacggagtctcactctgttgcccaggctggagtgccgtggcacgatctcggctcactgcaatctctgcctcctgggttcaagtgattctcctgctgcagcctccagagtagctggcattacaggcatgcaccaggacacctaatttatgtatttttagtagagatgcgggtctgccatgttggccaggctggtcttgaactcctgacctcaagtgatccacccaccttggcttcccaaagtgatgggtgggattacaggcatgagccactgcacctagccaagctcaatgaattttaaaatataaatgtgtgtgtacgtgtgtgtgtgtgtgtgtgtgtgtgtgtatatatatatatatatatatatatgtttaaaaccacataactaccaccaaatcaagttatagaacatttacatctccctaggacatttcttcctatcttgactttgatcaacatatgttgttgttattattattattattattattattattattattattattcagagacagggtctacctctgttgcccaggctggagtgcagtgttgcaatcgtacacaattcaccgcagtctggaactctggggctcaagcaattctcctatctcagtttcctgagtagctaggaccacaggtgtgtgccaatatgcccagctaatctttaaaattgttttgttgaggcaggcatggtggctcacgcctgtaaccccagcactttgggaggccgaggcaggtggatcacaaggtcaggagtttgagaccagcctggccaacatggtgaaacgccgtctctactaaagatacaaaaaaattagccaggcaccgtggcacgcacctgtaatcccagctacttgggaaactggggcaggagaatcacttgaacccggaaggcagaggttgcagtgagctgagatcatgcctccgcactccaacctgggccaaagggagagagtctgtctcaaaaaataaaaaaaaaaaagaaatttgttttgtagaaatgaggtctcactatgttgcccaggctggtctcaaacttctggcctgatgagcaatccgcctgcctgggcctcccagattgctggtattacagacatgagccacagtgcctggctcttgaataatgtatattagttttgcctattgttgaacatcgtgtaaatgagatcatggcaaatatgctcttttgtgtctgccttgttttgctccttgttgtgttttgtgggattcatacatattgttgctattatgaacattttttgtagatgtgttttggtggatgtaagctcacctttcttttggaggcgagtggaatttctgtgtcactatgtaattgtatgtttcactttagcacgaattattagttttctttcttttttggagatggagtctcactctgtcacctaggctggagtgaagtggtgcgatcttggctcagagcaacctgtgcctcctgggttcaagtgagtgttgtgcctcagctccccaagtagctgagactataggcatgtgccacaacgcccagctaattttattttattttattttacttttgagacagagtctcactctgtcgcccaggctggagcgcggtggcgcgatcttagctcactgcaacctgcgcctcccaggttcaagcagttctcctgccttagcctcccgagtagctcggattacaggcatgtgccaccatgcctggctaatttttttgtattgttaatagagatggggtttcctcatgtcagccaggctggtcttgaactcctgagctcaggcaatccacccaccttggcccacctttttgtattttttgtagagatggggtttcaccatgttgctcaggctggtctcaatctcctgagctcaagagatccacctgcctcggccacccaaagtgctgggattacaggcatgagccactgcacccagccaaattgttagttttccaaagtagttaagccaatttatatacctcccaacagagcgtgccttttccagttaatccacgtctttgtctgcactcgtaattttcagtctttgtttccagtcactctggtgggtgtatgatggtatttcactggggttttatttgcatttccctgatgactaatgaagttgagcatgttttcatgtgcttgctcaataaatatttgttgaaaggatgaataaagagtgaatgaataaaacatggaaagaaatccaactctgtcttgtgccctgcctaaaacccaccagtggttcccactgcccctcctttggccgacgggtacctgcctgccctggctccttctgaccccacctgctccggatggatttcttttgcttcttctctgggttcctgccatccaggctgtcttcagtttcctccaaggaccctccctgcttcataactttgctataaactgttttcttctgcccagaacacaacccaggcccaaggaacccagacgcgttccttgtatctcagtttgaaagcctcttcctccaggaagccttctctgacttccaccccccagcaagggtggtataaattgctaacttaggcccacttttgcccactttttttgtttgtgtttttgagatggagtcacactttgtcgtccaggctggagtgcagtggggccatctcagctcactgcaacctccatctcctgggttcaagtgattctcctgccttagcttcctgaatagctgggattacaggcacccaccaccatgtccagctaatttttgtatttttacatttatttatttatttatttgagatagagtattgctttgtcgcccaggctggagtgcagtggcatgatcttggcttactgcaacctccgcctcccaggttcaagtgattctcctgcctcagcctcccgagtagctgagcctgcaggtgcctgccaccacacccagctaatttttgtatttttagtagagatggggttttaccatcggtcagactggtctcgaactcctgaccttaagtgatctgcctgccttggcctcccaaagtgctgggattacaggcgtgagccaccatgcccggccaccactttttttttctagctgtgaccatagttgtacatatctccccttccctggcttttttttttgttttttttttcctgagacaggatctcgctgtgttacccaggctgcagtgcagcggtgcaatcatagctcactgtagccttgaactcctgggccaaatgagcctcccacctcggcctcccaaagcactgagattacatgcgtgagtcactacttctggcctgtaaataccctttcaaaaatataatatttgattaacatctgccatcttaccataagaaacacttaaaaaaatcccaatccaaaaaaattccaatcctttaagctatataagagtagcaattttatcttgttcctagcaagacatctggcatatagtaaatgctcaataaatatttgttgacagtataaaggtcaagcaacagcataactggcattattacatgaaagtaattatcccttagaaactcattcacccttgggggacccgggccaataaaaaaatcacagaaaacaatcctatctaccttcctccttcctccttccctcgctaggtcctttgattggggggaggtctcaaatgcacacactgtttctgttttatttggtgcagctgttgtgtgcatgtgttatggaaacccacatcaggcaggagattaaggaggagaggagaaaagaaaggcatcgctggtatcacagtgaaatttacactctgcggcctcgccctagctcctctgtctctacctgtctgcctatgaaacagttcaaaactaatatggcgcaatggatggtattatagacttcccacctccctggccagacttcttgggttcaaagtttggcttaatcacttaccatctaaataatccctgacaatgtactctgtctttctgggccttagtggcctcatctgcaaaatggggataatactacttcttacctcatggggttgtgaggattgcacaagttaatttgtgtaaattgctaagaacacagccttaggaagccttgtcactgtgaatgcatattaattttttttattattattttttgagacagagtcttgctctgttgcccaggctggagtgcagtggtgtgatctaagctcatttcaacctccgcctcccaggttcaagtgattctcctgtttcagcttctcaagtagctgggactacaggtgcccgccaccatgcccggctaatttttgtgtttttagtagagacagggttttgctatgttggctaggctggtcttgaactcctgaccttatgtgatcggcccgcctcggcttcccaaagtgcttgattacaagcacgagccaccatgcctggcctacgattatcatgtctccaggcttcagtttccttacctctgaggtgaggatcaataacctggttatttctaagtgatgcttaaagaggttgagaagaagcaaaggcgctctgcacacaggtgaggtcaacagctgttagtgatggagactggcgccgtctgggtcatcagtgctccggaatcaggctgctcacgggtttgaatctcacttccactttcactccttattaactgtgtgacctcgggcaagtcacttcgcctttctgaacctcagtttccccatctgtaaaaggtaggtgaataacagtattcacctccttctgtgtgactcagctttggagtcagcggaccgggttcaaatcccagccctgcaagtgattagccaggtgaccctgggcagagggaatcactcaacctctctgcacctgggtttcttccttcatgaacgtggagactttacaggatgaaatgagggcacagttaaggcgcccggtacactccaggcaggtagggggctccgttcacgttattttcccctggtgacggatactgtccttaaacagcatttgaaaagtggtcgcagggtgtgtggccccaaagatcccaggcgcttccggaaggcgagccaacgctccccaggcccgtccgcgagcgggtgggcctaagccttggaggatctggggtgggggtggcgcggggtccaggcccggggcgccgagaggtggctggtccggctgcccacgccgagacgcgcgaggtgagcgggcgccggggcggggcggggtggggcggggccgccgcatccccgtgacgcgcgggccaaccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggtacgtgccgggggccgcgtgaggccggcgggacggagggaggccggcggggagggaaagcaccgggcccgcagccgcccggggcaccccgctccccgctctgctgccggcctcgggggcccgggaccctcacgtcgcccgcggcccagcccctttcgggggtgcaaggcatgggggaaacttgggtgactcagttcctgcggagcagagcgtggggggccgcgtgcccagccctggggttttggagggtcgggtcgggtcagagccgccgtgaggaggccttcctgttttggggttcccgtctgtaaaaacaaccttccagggaaggggacgctagagatggggggcgggaagaggggtgtctctctgcttctgttttcccatcttttttgtggttagggtccccccttttcacgaaaaatactccgtgaccaacggggtgagctggggaggggcttagattgtagaaagggactttcattgtctccccaaagttgtcgtacaagccacattactcttctgtggttacctagctttgttttttttgttctttctacttagatactgcgggggaagtttgggggaaccagggaagaagggggatgtccacccttgatgtgccctacctgaccctcggctcggggcagacttggggtgcagctgaggacgcccaggaccctggtagctgtggtcctgccctcccttccctgcaacacgtggagctcctctctggggatgccccttagatttaaccccggcaagttttcttctgtaacgtggcctgcggagcctgactgggtgtctggagtccacttgctgtggtttaagccccagtcttttgggcttcagcttctccgtaatgcgatttgcctctttgttccaggaaggcaggcacttctgtctcgtgctgtcttgattgttggtgaacgcagtaggcaaatctggacacgactgtttctctctcctcttttgtttaggaatcaggagaaacagccttggttcttaggagctggtgatcagcttccaaaaatactttcttgtcctgttttgccggcctttcctcgagggttgcatttggagtgttgaaaagtcatcctccagggccccattggagggtttggttttgtttgtttgttttttttagtagggtatcattgtgtttaataacctaccacactttgatatatctcccattttaagccagtggggttggagagtaaccccaggggtggaaatagaacacagactttgccttgagggtctgggggtgattggagcctctttgcagatggactttctttagcaggggaaaacctgtggcttccttgttgccaggtgtagtaacagcaagattattttttgcaaagattcacatggtgatctgggtttgtgttgctgtgaattccagaatattctcttgtttattttcttctgaattgaggagggggcaaaacagggtgaacatccatgaggttttgtatcaggacgtattttattgatggcaattggtagttgatggctaatgagtatgtttggggtgcgctttgtttatcttaagaaactcattcacgaagtccagttgtaatattttttaaaatttttattttcttttttctttttattttttccttcgttaaggactttctgccacagaaattgccaggtggttgggttttgcttgggggtaattgtagctgatctctgcctctggtaggtaccccatccccgtgtttgaccttgcgtatttctgctgtctggattccaagacttgttggaggtgccttggaaccagaatttgagaggaggcaactggggcctgagtgggaaaattgaaatataattaactgaaagctagaaagtaggtagttgttgcttttttcttttcttttttttttctttttcttttttgagacagagtcttgctctgtcacccaggctggagtgcagtggcacgatctcagcttactgcaatctctgcctccccggctcaagtggtcctcctaactcagcctcccaagtacctgggactataggcgtgtgccaccacgcccagctaatttttgtattttttatagagacagattcgcactatattgcccaggctggtctcctactcctgggctcaagcgatcctcctgccttggcctccaaaagtgttgagattacaggcatgggcctctgtgcccggctgtttttgtgtttttcaaggtagcgtgtccgaggccaggagcgactggcctcccaggcagtcagataactgtgtgaccttgagcaagccactttccctctgtgtgcctcactttcctcatctctaaaattggacaggagccaaaaatgtggcagccttcttgggttgttgcgaagggtcaatgagttaatcttgtaagtggctcagcttgtgccctgcacggagataaacaatggttagtattaaatattattttttccaaagatgaagttgtgtgttttaagctccttgttcttcctttggattccccttttcttcagctggtggagatgggattgggctgtgaaaaggcagtgaggcacccgtgcctggctcctgttgtgaccaaggtcatgtgcttagaagtcaaggtcagtgggcctcgggtgactctgtcagagctttgtttctgggctactgtctgcctctgagccgcaggaaatgtccagaaaacccagaagatggaaatggcccatgataagtgttctgttgacctttactcagacagatgctctgggaagagaaaaggagaactttgctatcaaaacggaaaatagggcctgaggacaggtcacagcagcccttggctttcttttctcatgggggtgggactggtaggaggcgctgctttgtggttgatattggcatgatggttggaaaaatgggcctgggactttttgtgagttcattaaaaaaaaaaaaaaaaaaaaaaaaaaaagcaggccgggtgcagtggctcacgcctgtaatcccagcactttgggaggctgaggcaggcggattgcttgaggtcaggagttcgagaccagcctaggcaacatggattgacccccgtctctactaataataccaaaaaaaaaaaaaaagcctggcatggtggtgtggcacctgtggtcccggctactagggaggctgaggcactagaatcacttgaaggctgtgggggtggaggttgcaatgagctgagatcacggtcactgcactccagtctgggccacagactgagaccctgtctcaaaaaaaagagggccgggtgtagtagatcatgcctgtaatcccagcactttgggaggccaaggcaggcggatcacctgaggtcaggggttcaagaccagcctgaccaacatggcaaaaccccatccctactaaaaatacaaaaattagctgggcctggtgattcacgcctgtaattccagctacttgggaggctgaggcaggagaattgcttgaacctgggaagaggttgcagtgagctgagatcacatcactgcactccaacctgggcgacagagagactgtctcaaaagaaaaaaaaaattgtgcttcaggccctgtgtagaaaaattggaaattatggaaaagcagaggaaacaacttggtattaagcagtatagtgtggtggctcagagcaaattcgcctctgctgctgaggcaggttacgtcatctctccgtgcctcagtttccctatgtgggataacgtagtacctagtgaatagcggtgacttgaggaataagtgagttaatccttagcaaggacttaaaatgttgctgcttggcacacagcgctcagtaaagatcagtggtcgttgccacctggaattctccagttaatttttgctgttgcaccaactgccactggagaagaccagaaggaagctgcaggtgtgtgtcaccgtcgatggagtgagctggtcccagggttgatgtgcacctctgagatgctctgtggcatccaccaactcagtaaccccctgaatatctgacttagccgccaaggaagaatatcttagaagctattaggaattcctcttggggctaggtctgggccttggagtcagtctgatccctggtttaattcttccccttggctcaacagcagtgtacgacgagccaatttttcccctcctccaagtgtggctttggttttcaaatccatcccttagccttctcctacttcctctgttttcccctccccaccctttttttttttttttttttgagatggtgtcttgctgtgtcgcccaggctagggtgcagtggtgtgatctcggttcactacaacctctgcctgctgcgttcacatgattcccctgcctcaggctcccgagtagctgggattacaggcgcacagccaccatgcctggctaagttttgtatttttacaaaactttacaaaacccccatagagacggggtttcatcatgttggccaggctggtcttgaactcctgacctcaagtggtcaacctgcctcagcctcccaaagtgttggggattgcaagcgtgagccaccgcgctcagcctgttttccccctttttggctgcccctccttccagacccttcctctctcccttccttatggagtgttagagtggaaagggatgtcagatcttggggggccctcctctccacccaccccatttcgtggatgtggacactgaggtccaggatggtgacatgacagggtgcaaggtggcaaggtgaatggctttgggaggagatgagggtgacccgggagaggcctgggcaggagtggactcaggggttcctggtccaaatgggttcgtgattcaggccaatcaggagcggattcagggttccttggccaaatggagccactgcagccacaggggccctgcagaaggcagctgcagccggtccctttggccaagactctcctgaagggtcgtgttctctttctccgaggacaagttccatttgtgatagcctggagggggtgcctcgcctttgggacctggtggtagatgggggggaagaaaaccttttctgtttgtggacacaacttttaggaactgatctctctatgtgggtgtctcccactgaccatgttcctaaagaacgtgagcttcctcttcccatgtcagtctccagctttgacttctctttttctcctcccattcctatcacatctgtcagcaaatcgtgttgcccgttgcctcaaacgggctgcttttcatggcttccccgacttccactctggctcgagtcatcgttggccagtttctggatttgaacagtcacctcagtccaggcgccgtggctcatgcctgtaatcctggcacttcgggaggccaaggcagacggatcatttgaggccaggagtttgagaccagtctgggcagaatggtgaaaacctgtctcaactaaaaatacaaaaattagccgagcctggtggtgggcgcctgtaatcccagctacttgggaggctgaggcaggagaatcgcttgagcccagtggggttggaggttgcagtgagccgagagttcgccactgcgctccagcctgggtgacagtgagactctgtctcaaaaaaaaagaaaacagccacctgttcgctgctgtgcctactctgcccttgacccctacagtctagtcttggcccagctgtccctcttctactaaaaccctgcagtagttccttgagggtacaagccaaagggcttacagtggcctcgaaggctgggcagcatctgtccccttggcctccctgacctcttctctggctgctttctgtctcactctcctccagccacacttgtggccaggcctgtccctgcctcagggcctttgcacttgctgtttctcctacctactatgtccctcaccttcaaactttgttcaggtgtcacctcaggcatcccgttctttccctccactagcaaatctctgtcccccatctacacccccagtagcacttactgccttctaatacacgtaatattttgcttaagtattgtgcctactctgtaaactcctaccaaaagatcggctccataggggcagggattttggcctgtgtttgtttacggctgtaatcccagcacctagaactgtgcctggggcttagtaaataacagttgaccttggaacaattcaggggttaggagtgctgatgccccatgtagttgaaaatttaggatgcagcgcggtggcttacacctgtaatctcagcactttgggaggccgaggcaggtggattacctgaggtcaggagttccagactagtctggccaacatggtgaaagcccatctctacaaaaattagccaggtgtggtggctcatgcctgtaatctcagcactttgggaggccaaggcaggcagatcacttgaggtcaggagtttgagaccagcctggccaacatggtaaaaccctgtctctacaaaaattagctgggtgtggtggcgggtgcctgtaatcccagctacttgagaagctgaggcatgagcattgcttgaacctggtaggcggacactgcagtgagccgagatcgcgccattgcactccagcttgggtgacagagtaagactctgtctaaaaaaaaaaaaacacaataaaggaaagaaaattcaggtctaactttcaactccctaaaagtttaactactaacagcttactgttgactggaagccttaccgagaacataagcagttgataacactaattctgttgttgttggttgttttttgatagagatggggagcttgctgtgttgccgaggctggtctcaaactcctggcctcaagctattcacctgcctcggcctcctaaagtgctgggattataggcgtgagccactgcacttggcctaactcataccttgtatatatattatatactgtatttttacagtgaagcaaggtagagaaaagaaaatgttaagattaattcataagagagatttttactatttattaagtggaagtggatcatcataaaggtcttcatcttcattgtcttcacgttgaggaggctaaggaggaggaggaaggggaggggttggtcttgctatctcagggatggcagaggcagaagcataatctgagtataagtggacccgtgcagtttaaatgtgtgttgttcaagggtcagctgtttgttgaataaatgaatgacatgaagtattacagtggcttttgggcggtgtcgaaacttctttgtaaggattttaaggatgaaataatcacttaactgtctggaatgaacactcagataaactgagtcctccagctttctcatcagatggcttgtttttttattttatttttttgagacagggtcttgctctgtcacccaggctggagtgcagtggcgcgacctcagctcactgcagcctcaacctcctgagctcaagcaattctcccacttcagctccccaggtagctgggactacaggcacacaccaccatgcccagctaattttttttttttttttttttgtagagatagggttttgccatgttgctcaggttggtggtgaactcctgaactcaggcgatctgcctgccttggcctcccaaagtgctgggattataggtgtgagccaccgtgcttggcagaacagcttctatttcatcttggaaaggtcagaacagggttttgtccacccctcttttcccaggactcagtgtctcacacacagtgggggctcaatcaacattagaatttgagtgtttgaggtatgagttccaagctaggggttagatatagctcaccactgtgctggtttggcttgattttaattataggaatgactgtgatttccaattttatttatttatttatttgagacggagtcttgctctgttgccaggctggagtgcagtggcacgatcttggctcactgcaacctctgcctcctgggttcaagcaattctgcctcagcctccccagtagctgggactacaggggcacgccaccacatccagctaatttttgtgtttttgatagaaacggggtttccagtatgttggccagcatggcctcgatctcttgacctcgtgatccgcccgcctcggcctcctaaagtgctgggattacaggcatgagccactgtggcccgccctacaatgtttattcattggcagatttcacagaaacatctggatttctggcttcccttgaaaaatcagaagttctgctagccccaggcccacatttatacatggtagcggtccgctgaggctgtccgtttctgagttgctccagtttgccgcagtccccacccctccctgttgttgctttaattttaaggccaaatgtttgttgcctttgttttattttatattatttttttgagacgaagtctcgctctgtcacccaggctggagtgcagtagtggaatctcggctcactgcaacctctgcctcccgggttccagtgattctgctgcctcagcttcccgagtagctgggattacaggcccgcaccaccacactcggcttatttttgtatttttagtagagatggggtttctccatattggccaggctggtcttgaattcctgaactcaagtggatcacttgagttcctcagcctcccaaagtgctgggattacaggcatgagccaccgtgcctggcctgttgcctttttaaaattgtgcttcctcacacctggtctgcttcttgcatggatggaacccactttggcacctgttggtatctgagttggcatctcctgctttgcaggccaaccttgaagttagcatctgattggtatgttggcttcagattttcatggcgaagtaaggcctagctttgatgatcagctcttagtgtggtcagtacaactctagctcgtgaaaacttgcccaaacattttgccaaaattaattaatggccagacatcctgaggcaagcttccccccgcttagcaagaaaactgggatagggcagcatccctgtgggtggagtggtgctggggacctgcacttacctcttagaggctgaatggttgaacggggcctttgaggaagctgtattttgcgggtggggacatggagcacagttgctcagtgtcggccccgttgacatgtaggccacatcattctttgtggcctggttgctgttctgtgcagcgtagtcttagccccaaacctggcctctaccccctagtagatgctggtagcacctcctcttgttgtgacaaccgaaaatgcctctagatgtttccatatgttccctggggtgtgaaatcacacagccactggtgtggaggaatatgggggagaaacatggagcaagaccttcctcctcatcctgcatttccctaggaggttgtgggctgtcgaaattctagtgtaattggcttactggggttgccttggagaagcttaatgagacgttaaggaggttaaactccaattagctagagaagaaacttgcggcagtttcttttttactgagggctgtgtctttttacctttttccattttcccagttggagttgtgacagttcattctcccctgggaaaacaaaaatggctttctttttctttttctttcttttttcttttgagacagggtctccctctgtcacccaggctggagtgcagtggcacaatcatagctcactgcagcctcgacctcctgggctgaagctatcttcccaccttagcctcccaggtagctgggaccagaggtgcacaccaccatacccggctaatttttgtattttttgtagagtcagggtctcaccatgttgcccaggcttgtctcaaactcctgggctcaagcgatcctcctgcctcggcctcccaaagtgctgggattacaggcgtgagccaccatgcccagccgaaaatggctttcttgagagatcagctttgaagctctactccttcattttaaagtgccccaggagaagtggacgattacaaagttgagattccacttaagtgtccccttagtttaactgtgggattcatctcctggggaggttgccaggttctggaaagtgggtgttaatgaccagggagggtgcccctaggctagcatcctgtaaccctcaggaattgagatttttatggaggttttctcttcctctctgtgagttttctctctgagaaacctgtctagggagggaggctctaggctagcatcctgtaaccctcaagtagtaattgagatttttatggagcttttatcttcctctctgtgagttttctctctgaggaacctcagtgtaccttttactggcctcctaggtaatacttgtttggagaatatgtgtgatgtctaagtcttcccagtacaagaaatttgtgtggtgtttgactgattgatggatggagtcttgttctgtcgccctagctgattgtaccactgcactgcagtctcgacctcccaggccaagtgaccctcccaactcaccctcccaagtagctgggactacaggcatgcaccagcacacccggctaatttttgtatttttttttgtagagatggggtttcactatgttgcccagtttggtcttgaactcttgagctcaagcagtctcccagagtgctgggattacaggtgtgagccaccacgcccagcctcgtgtggtctttgatacccctgggttcattgtattgttcttcccacactgcttttcattcattcatttattcagtcattattaattgagcagctactatgtgctgctgctgctctaggcactgaggatacaacagtgaacaggacagaccaggcccatgttctcatggggtttacactgagggtgacggaaatgatttcagatgctggcaagtgctgcaaagacttgaaccgggaaaaactgggtgaggtgcaaactactacggagggatgtccacagaaggcctttcggaggcggtgaggtttgaccccagagctcagtggcaaagctggccatgcaaggatgtgggggaagggagtcccagagtgggaagagaatgtgcataggccttgaggaagatcatggtgtggttaaagtattgaggagtttaactcaaaggaactgcagagcccatctcataaaaatctagcctggagcattcggcaaaatgcataaagcactaacacaatggcttgtggtcctggaatttccagggaaggcgcttaccagctcagcaaggaagtagaacaatgcatggtccctggcagaagcaagaaccttctgatctgtttatgtttgaatgaaacgcaggttttttttttttttttttttttttaaaatagatgggggtcttgctatgctgctcaggctggtctcgaactcctgggctcaagcaatccacccaccttggcccttccatgtgctgggattacaggcatgaggcactacgccctgctgaatctcaggtcttaaaaattcagtttattttgttttatgagtctcttctctttctcagaaccttaactgaaacgtttgtgatcaagaccaacttgggtttccccactccccagttgcctttgattctccgccaaaggcttgttcgtaagatgatgaggtacttttttcctgtggttaagaggactttctataggttgctagaaaactcttgttttaaaacaagatgttgttgaattgatctggctgattgcaggaggaagatcttgtactgcaactttgttgatgatgctaatactttaaggtgaatattctagaagaatataaagggaaaaataaaagttttagtatgttcccaccctgccctttgttcccagaagtagccgttattgatgatggttgttgatgatagtttcttgggtgtttttcgagaaaagtttcaagtatatgcaaatgtatgtgcaagaacgtgttcgtttgtgtgtatatgtttacatattcattttttccctccctagttgggtattttaaatactgttttgtctcttgttctcttcacttaaccagtgttgattttcttgccattttaagcccatgcaaattgaaagtaaaagccaatcaaatcaacttttttttttttttttttttaaacaagccacgcatttgcctgttaaatggctgagccatgtattcacccattcccctcttggtgtctatcaaggtcattcccagttcctggtttcttgctgtgataagcagtgctgcactgaaggcacatgtatgcaaatatatgtaaatgattcagcagaataaattttcccacaggaaattgctaggttgacagtatgtgcattttgaaatttgatagttaattgtcaggttactgcagcagtttatactcccactaatgggcccaccagcacttattaagcacctgttgttttcctgccatatcagaaaaattgagcaagctgggaagtgatcaggcccatgttgcttggctgtgtgtgagagggctttgcccagttaagttaaaccttactttccagaggtcaggagatcaaagcagaagtgtgctttggttttgttcagttttttaaaagatgtgtttaaattttaaacatctttggacttattttaaaaattgcttttaaatcaataatttaacaatgtgtaaaaacattactgatagtctcaccatgctaatgtcactctgatttttacacctaaactaatttaattgcagagttttctgatcacaagtgacatgtgttccatatgacagaacaaacaatacaaagatatttaaataaagcctgaacatggtactgatattagtttgttcatgctgctatgaaaaaatacctgagactgcgtagtttataaaggaaagaggtttaattgactcacagttctgcatggctggggaggcctcaggaaacttaaaatgatggtggaaaggaaagcaaacatgtccttcttcacatggtggcaggagacagaagtgcagagtaaagaggagaaaagccggtataaaaccatcagatcttctgaggactcactatcaggagaacagcatgggggaaccgctcccatgatctaatcacctccagtgaggtccctccaccaacacgtggggattacaattaagattacaattcaagatgagatttgtgcggggacacagagccgtgccatatcattctgcccctggcccctcccaaatctcatctttctcatatttcaaaacacaattatgccttcccaacagttccccaaagtcttaactcatttcagcattaactcaaaagtctatgtccaaaatctcatctgagacaaaatctagtctctttcacctatcagcctgtaaaatcaaaagaagttagttagttcctagatacaatgggggtacaggcattggataaatacacccgtttgaaatgggagaaattggccaaaacaaaggggctgcaggccccatgcaagtctgaaatccaataggccagtcataaaactttcaagttccatagttatctcctttgactccgtgtctcacatccaggtcacactgttgcaagaggtgggcttccacggccttgggcagctctgcccctgtggctttgcagggtatagccccgctcctggctgctttcacaggttggcgttgagtgtctccgtcttttccaggcacacgatgtagctgcaggtggatctaccattctgggttctggatggtggcccttttctcacagctccattaggcagtaccccagtggggactctgtgtgggggctctgaccccatatttcccttctttactgcattggtagaggttctccataaaggctccacccctgcagcaaacttctggctggacatccaggcatttgcatacatcctctgaaatctaggtggaggtttccaaacctcagttctttagttctatgtacccacaggctcaataccacatggaagctgccgaggcttggggcttgcaccctctgaaggcacagcctgagctgtgtaccttggctcctcttagccatgactggagtggctgggcaccaagtcctaaggctgcacacatcaggggggccctggacccagcccaggaaaccgtttttccctcctaggcctgtgatgggaggggctgctgtgaaggtttgtgatatgccctggagacattttccccattgtcttggaattgggctccttgttacttttgcaagtttctgcagccggcttgaatttctcttcagaaaatgggtttttctttttacattgtcagactgcaaatttccacactttttttttttttgagatggagtctctctctgttgcccaggctagagtgcaatggcatgatctcggctcattgcaacctctgcctcctgggttcaagcaattctcctgcctcagcatcccgagtagctgggattacaggcacccgccatcatgcctggctaatgtttgtatttttgtagagacaggatttcaccatgctggctagactggtctcgaattcctgacctcaagtgatctgcccaccttggcctcccaaagtgctgggattacaggcgtgagccactgcgcccggccaatttccacccttttatgctctgcttcctcttgaatgctttgctgcttagtaatttcttcccctagatgccctaaatcttctctctcaagttcaaagttccacagatctctagggcagggtcaaaatgctgccagtctctttgctaaagcatagcaaggatcaggagaacagcatgggggaaccgtccccatgatctaatcacctcccatgatgtcccttccctaatatgtggggattccaattcagattacaattcaagatgggatttaggtggggacacagagccagaccatatcagtaatctcttgggctaaccaataaccaatgtattcttgtattttttctttgaaattttataaatatttataaatttaaataacatttaaatcaaaatggattatgttgtaatcattactctgccagttttttttttttaatttttaaatttattttttgtagagacaggatctccctatgttacccaggctggttttgaacccctggactgaatcgatcctccggctttggcctcccaaagtgctgggatcaaagtttgttaatttgatagctaaaatatattttcatctgcatttcaattacaattagaagctatgtatcctgcaacatattttccagcaatttgtgtattttcagtgtgtctttctgagtcctttttgggtatgcctggactagtttgtctttttcctgttagtttgtaagggctcttgttattgtgggacctttcctctttgtccatcacctgtattgtataaatattttgttacaggctattgttttcctattggcatattaacatttgagtcttgttcttactagtatgtagttttgcaaggttgcatttgtagcttgcatactgtctcctatgtttttatttactgtaataagtattttcccatgtacccacgtaacctttttaattaaacctataaatgtccaatcgatagttccctgtgttggtgggctataatcacataattattatctgtggtttgacatttgggttgctgtgttttctttctccttttttttttttattattatttttgagacggagtcttgttctgtcgcccaggctgaagtgcagtggtgcgaccttggctcactgcaagctccgcctcccaggttcacgccattctcctgcctcagcctcccaagtagctgggactacaggcacctgccaccacgcctggctaatttttttgtgtttttagtagagacggagtttcaccgtgttagccaggatggtcttgatctcctgaccttgtgatctgcccacttcggcctcccaaagtgctgggattacaggcatgagccactgtgcccagcccctttctccctttttaacttttttgagacagcatcttataccatcacccaggctggagtgcattgcgcaatcttggctccctgtgacctctgcctcctgggttcaggtgattctcctgcctcagccgctggagtagctgggattacacatgtgtaccatgatgcctgattaatttttgtattttcagtagagatggggtttcaccatgttggccaggctggtctcgaactcctgacctcaggtgatctgcctcccaacgtgctgggattacaggcgagagccaccatacccagtcatttttatttttcttttaaagaaaacactgtcctgaataccacatgggtagagtgcgtattggcttatttccttagatgatgttctcaggagtggaatgaataacatctgaaaaggcttcactctagccattgtcttattttctaaaagtgagctggcccagctcaccgttctagcagggtctaaggttacttactgctgtggttattattcagagtggacgatggtgcatgttaatgtcaggcacagcagggcgcggtggctcacgactgtaatcctagcactttgggaggccgaggtgggcggatcacgaggtcaggagttggagaccagcatgaccaacatggtgaaaccccatctctactaaaaatacaaaaattagctggcgtggtggcaggcacctgtaatctcagttactcgggaggctgaggcgggagaattgcttgaacccaggaggcggaggttgcagtgaactgagattgtgccactgcactccagcctgggtgacagagagactttatcttaaaaaaaaaaaaaaaagtcaggcttttctagggttcctccatcagccttgtaaggctggagacccgtggccaggaagaaaattggagctgtctggcactgggaagggtaacccagtagttataattaggttggcttatctgcgagccctttgataaggcttcactaatttactaacccaggatcgcatgttagatcaggatctctctgagtgctgcaattgtagtttgcttttctctctctcttttttttttttttttagagacagagactcactctgttgcccaggctggagtgcagtggtatgatcatggctcactgcagccttgaactcctggcctcaagcgatcttcctgccttaccctcccgagtgtcttggattatagatgcttgtcaacatgcccagctaatttttaattttttttagagatgaggtcttgccctgtcacccaggctggagtgcagtggcatgaacatagctcactgcagccttaaacttctggcctcaagcagttctcctgcctcagccttccaaagtgctgggattacaggtgggcaccactgtgcctggcctgcagtggtttaatagggctctttcatctttaactttggtcccctgccccctgagatccgtggagtgagccgtttgacgcttggtacttgggacaaagctggcctatgtccagttctctgcatacttggtaggggagtgtttggagaaaaggctcacctctgagtcacaccctctatattctccaaagggccatggggatggggtggaggaggctggggtgaagagatgttgtagctccagagaaagccagggaggtgtatgctgggtgaagaggccaagttcaggagcctaggtttgaaaatcagtatagacgattcaggttaattcaccctgttgttatagagcatctgtctgtagggtggccaggtctgggtgagtctcttggacaagatgggtatcaggtttcagctctgaaattggactgatatgtggggagattcattctgcagttttatttgtagtttaggtttaagaaaacttggactgggcactgttgctgtcgtctgatcccagcacttagtgatgctgaagtgggaggatcacttgagcccaggagtttgagaccagcctgggcaacagaaagaccccatctctacaaaataataataataataattattattattattattagctgggcatgatgggacatgcctgtagtcccagctactcaggaggctgaggcgggaggtttgcttggtcctgggaggttgagctgcagtgagctatgattgcaccactgcactccagcctggacaacagcatggcactgtctccaaaaaaaaaaaaaacaacaaaaaaaaaacttgtttaactacctaaatcatagcatttgtgtgaagccagactatcacaactctgagaactgctgacatatacatattttggaagttccaggttttctgttactataaacatggtagagattgaattacttaaagggacgtcttttctcctactctttgtcttgtctgatgttataaggggtacagtatagaatgaaaacagtgcagaaatgagtgaaacatgaaaatcccttctagagataattttcttttattatttttttgagacggagtcttgctccattgcccagtctggagtacagtgatctcggctcacggcaacctccacctcccaagttcaagtgattctcctgcctcagcctcccgagtagctggggttataggtgtgtaccatgcaccaccatgcccggctaatttttgtatttttagtagagacagggtttgctgtgttagccaggctggtctcgaattcctgacctcaggtgatccgcctacctcggcctcccaaagtcctgggattaccggggtgagccaccatggccagcctcttctagagacaatcttattggcaggttgatgtttttaattttcagcctctcttctccacagatcctaaagatatagtaatttttttttttgagacagagtcttgctctattacccaggctggagtgcaggtggcgtgatctctgctcactgcagccttcacctgccgagtagctaggactgcaggcatgcaccactatgtctagctaatttttgtatttttagtagagatggggttttaccattttggccaggctggtctcaaactcatgacctcaagtgatccacctgccgcagcctcccaaagtgctgggattacaggtctaagccaccgtgcccagccataaatacatggtattttttaagaacaagaacgggattctacaaaaacatatatatgtgtattttgagacaggatctcctctgttgctcagggtggagtgcaggggcacgatcatggcccactgcagccatgacctctcaggctcaagcaatcctcccaccttagcctctggagtagctgggaccacaggtgcccaccaccatgcccagctaatattttttcttttttttttttgtattgaaaacagtcagccaggtgtggtggctcacacctgtaatctcagtacgttgagaggccgaggtgggcagatcacttgaggtcagtagttcaaggccaggctgtccaacatggtgaaactccatctctactaaaaatacaaaaattaactgtggtggcgcttgcctataatcccagctactgggaagggggaggcataaggatcacttgaacctgggaggaggaggttgtagagagccaagatgatggcactgcactccagcctgggcaacagagcaagactctgtctcagaaaaacaaaacaaaacatatagtctttatttttttgtttgcgtgggctggtgcatcttgattatgatgcatttttgttaattgatatttaattgcagatgaaatgtaacatggatctgagtaattgctgataattgtttcctctttaggcagctggtcagtcttttttttttttttttttctttttaagagagtttctgtcttgttgcccagactggagtgcagtagcgtgatctcggctcactgcaacctcctttgccagggttcgagtgattctcctgcctcagccccccgagtagctgggattacaggcatgtgccaccacgcccggctactttttgtatttttagtagagacgggttttgccatgttggccaggctggtctcaaactcctgacctcaggtgatcccccctgcctctgcctcccaaagtgctgagattacaggcttgagccactgctcccagcccatagtcttttttttttttaaacctctgtgtacaggtaggtcctggggaaattcgaggcaagacttgggtgagtgggtatcttagaccctctcaggagctctttgcaggaggtagaatctccgagggtcagtgcccatgaatgggtcccatggcctgactggtcccattcaggtgacagtctctgagggtcctgcatagcccttacctgggctccatgctgggaatcgagcggtatacagagcatggttccctgccttccttgagccccagtcttgttggggaaatggccaaataaatgaataatcatcaggaagtgctatgaaggggagctgcgtggtgcccggtgagtgcaatagcggggtttcatctggttggagagaaaaaaggagactccttaagtggggaacccgtttgatgatacaggtttggctatgtgtgtcaaagaccccaaatatagtgggttaagatacaagctcatttctctctcatgtaaaaatcccagctggtgtggcagctctgtccccaaaataatcagggtcccaggcccctcccatcttgttgctctgctgtcctcatctgcatggatcaagatgatgcatctccatgtccacatggcagccagtaggaaagcagagtaagggcacaacctggaggttgcctacgtctctcctcgtcacatcccattggcttgtacctagtcatgtggtgcctctagctgcaaaggaggctgggaaatgtagtttcctttctaagcaggatgtacccagctgaagatgttactcagggatgagggagagttgatactggagcgcagctagcagtttctgctgtataggcaaaagcagaaggtaagaatgttctgggcagtgggaaatgcatgtgcagaagcactggcttaatgaggaaggccactgtggctggagtcaaagagtagggaagagaaaaagaaccagaaggaggctgagaattgggcctgtaggacttggatcctgtgggaagccttggcagctttctttcccccctccttgcttaggcattagctctaagacagggatatttacaacacaattatttctttaaaattatatatatattttaatttgtacagatgaggtctccctgtgttgtccaggttggtttcaaacccctgagctcaagccatcttcttgcctcggcctccgaaagtgttgggattacaggtgtgagccattatacctggccttcaactcagtccctaaagacaactccttctcaagtgttggaaagaaccaatgactaatcacttctagtctgccttatccccatcttgcttgtgtgactttggtaagagtttgtttgtttatttaaaggagcagagagtttaataggcaagaaggggcaagaaagaagggagaataagatcccctgtatagagacggaggagggctccaaagctgagagagggaaccccagctgccacagatagcagctaggtatatgtacagaggctggaagaggcagtgtctgatttgcataggcctcaggggattggtttgactaggcatgtctttcacgtagcgcatgaaaaagctggccctcccacctagccttttaatatgcaaatgcagggtaccatgatctgcacacttggggaggtgtggtggcggccatgttgctaggaacatgtggggaaagggcaagaaggctgtgggaatcgccatgtttgggtggacccagtttctaatggcttgcatttgcatatcaaaggttgctggcctggctctaagagccggggctttacaagaaacttttccggagttgctttaaaaaccaaacatttcccaaggaccccttttcctctctatttgcctaaaataattgcttaactcctacattaccccctgtggagatgccacattaactgctgttagggggttttgggcgacgacttcttctggctacttcctggtgaaaaggggcgttgaatggggaacagcagctagggctcctcctggggtggatctaagggtcctcggaagaatggcgtgtccatgtgtgcttcaggttacagcaccattttgagtttgattgcttcagtctgatgaaataatttcctttcctggccaacacaccaaaatgatacggctccgatgagtgggggaacaccagggttcttggtcctcatgccggtttagataaaatgacacagacacacgtggagtggttttaaggagtggagagtttaataggcaagaaggaagggagaaggaagaaggtcccctgtacagagacagagggtggggggctccaaagctgagagacggaacctccaggagttgattttataaataaaataacatgcgttgaggtcactctgtgttgtgtggtatgcccagccctctctgcacataacttgtttcaggcccacagtcatgctgggtggttgctgtaatgactttttattttaaatggggaatctgtgacacagttaaacatgcgcaggatcatgtcactagcaaggagtggacacggtattcaaacccagcaggttgactcaaagcctgccctttccccagctgttttgcccctcagtcatttgagtctagtcttcaggattttgacatctatctcttaccttgtatctgttaggattgcatctggcttcaagaaacagccctacttcagcagcctaagcagaaaggtattcatttgtttattttttacatgtcaggaattccagtacctcttggagttgctggcattggattagtgatgcagggttgttaggactgacatctctgctgttttcttgtcttttcctcaaggcccctaaatggctgctacagccctaggcaatatatctgggttcaaggtaggaagagggagggattgcaccagcctcatgggttcctttctattcaggaaagtccaagccttcttcaaaggctcttctgtccacattgcagacttctggtcatgtctccttggctgaaactggattacatgaccacctctagctgcaagggaggcaggaaaaatgagcatttggttttatgcttctctaggaggaaacagcaagggagaaacttttgagtaagccagccaatattgtccaacatgtacttattttttaactttttttttttttttttttttttttgaggcaaggtctggctggctctgttgccgaggctagagtgtggtggcacaatctcagctcgctgcaacctctacctcctaggctgaagctatcctcccaccttagcctccagagtagctgggactaccacatgcaccaccatacctggctaatttttatatttgtagagatggggtctcaccatgttgcccaggctgctcttgaacttgtgagttcaagtcgtctgcccacctcagcctcccaaagtgctgggatgacaggcatgagccatcacactcagctaatgtttttctttcaatcaattcactttttaagccttaacaaagttatcgcaaaaggaagtttcatatcactttagaatgtctttgaagtcacaggttggttatatttatgtgcttactttaatagctattaaagtaaatatagcactactaagaaaaaaagatattctttaaatcgcctattatcagtggttcttaactctggatgattttgtctccaggggacatttggcaatgtctggaaacatttttggctgtcacgatggggcagggagcgcacgcctagagtctagtgggtagaggccagggggtgtgctaaatatcctacaatacaggatgggctccataatgaaaaatcctctggtcccaaatgtcagtagtactgcagttgagaaaccctggcatggacgcaatccacctgctgccaggagttatatacaagccatgttagggtaatgctgcaatatgtccatcgtgattgtgttttctcctgggtgactatcagcaatggtgtagcctgcttgttggttttcaaggtccattctcaagatactatcagatctccagcaatcgtgtgatgcagtttaaaatgttcatgtgagctgggcgtggtgactcatgcctataatcccagcactttgggaggccaaggctggagaatggcttgagcccaggagtttgaaaccagcctgggcaacatagcgagacccagtctctacacaaaattaaaaaaaaaaaaaaattagcccggtatgatggtgcatggccatggtcacagctactcaggaggcagaggtgggatgatcacctgggcctgggaggttgaggctgcggtgagccacgattgcaccaccgtattccagcttgggtgacagagtgagaccctgtctcaaaaaaaagaatgtgcatatgaattcaagatatgtcccttatagagactggtgaggacacagcttattgaccctgaagctgaagtggttgaaatgatagccctcttgccaggcaaatcctatgtgagtgcttctaaaagaacactgtaccttgcagagagtattcctgggacctggcaggaatcagggcctcttggtgaccacatgctttggaaagggctgtgctttggcaagtgggagattttattatttattttctcctgtctgcctcggtttggcaaaaacaaacctggcctgggcatgggccttgtggagacaagaaggcagcttgagattatcagagatcaggctgctggtgggtttgcctgagctggcctggtcaggtagcttgacaatgatgctcagacccccattaaagttaattgagcggttacagagtgggagtggggagtggggggtgtggtgactgcctgtctccttgagttggcgtggctaagaagtaagggaattttttaacttttccttcttaattctggaaacttagaaaaaagcctctcaccatcccttaatcattcagttagagagaccaggctgttgatatggacatgctgcgtttcatggaatcctagaggccagtatttatgacatacttcccagtttcagagatgttaggatataaaaatgtagccagcagtgtttacaggatgggctaatcgagagacacagacaaatatcaaagatagcaaaataggaagaaacagagtcttagaatcaatgcagtataataatagcttctagtttctttctgtttttctttttatgatacagagtctcactctgtcgcccaggctggactgcggtggcatgatctcggctcactgtagcctccgtctcctgggttcaagtgatcctcccatctcagcctccaagtcactgggattacaagttgtttgccaccatgcccagctaatttttgtatttttaatagagacagggtttcaccatgttggccaggttggtcttgaatgcctgacctcaagtgatcccccccagccttggcttcccaaagtactgggatgacaggtgtgagccaccatgcccagcctccccctcactcttaagcacagctcttcggcagtcagagatgttgcctgctgtatttctcgttctgcttttacacatggtttaaaaatcctcgcccaagaatgtaagccccatggctagtgctacctgctacctttaggggtggcctctcctggggtgcaggaggttgcacagttcgttttgtgacagcagggtcattttttaatcggatcatctgccccagtttgcttggctcttaggtgcttgggagttctcctggttttttgctgttgtgaaatggcccagcttgtacacgttgttccttttcttgctggagttatttcctttagactcctgtccctaaagtaggattgttgggtgaaaatggggtatgcgtggttaggcttttctctgcctgctttctggattgctcttcagatagatttaatcaccttttatttatgttttgtggtggttttttttgttttttttgtttttttttgttttgagactgagttttggtcttgttgcgcaggctggagtgcaatggtggggtctcggctcacagcaacctctgcctcctgggttcaaacgattctccttcctcagcttcctgagtagctgggattacaggcatgcgccaccatctctggctaattttgaatttttattacagacggggtttctccatgttggtaaagctggtctggaactcccaacctcaggtgatctgcccgcctcagcctcccaaggtgctgggattacaggcgtgagccgccacacctggccaccttttatttgttgaatgagtgtttaataagcatgtcctatatgcatcaggagaattaaatggacatggtcttgctttggggggaaatgacaggtaggagagaaagagacacttagaactcaacagaggccagacgcggtggcttacgcctgttatcccagcactttgggaggctgaggtgggcggatcacctgagatcaggagttcgagaccagcctggccaaaatggtgaaatcccgtctctactaaaatataaaatcaatcaggcgtggtgatggcacatgcctgtgatcccagctactcgggaggctgaggcaggagaattgcttgaacctgggaggcagacattgcagtgagccgagattgcactactgcactccagcctgggcagcaagagcaaaactctgtctcaaaaaagaaaaaactcaacagagaaaaggcggatcgttaaggcttctttggcacttcctaagtgccagggactgttgttaatgcctttgaagtgctaataatgacttaatggtgacaagttccctgtgaagcagggactgtgattgtttctaccttatgggtggggaaaggaggcagagagaggtgaagtcacccagctagtaaatgacaggactagactgaaacccaggcagtctgtctccagggcctggccggtaccccatgctccatcttgccccataaacaccctggggtgggccagagaggagtcttttccaacaggctgtgccagatgactttggctaatcttggaggctggaggattagtcagtctactaagggggcttcagcattttggcacgtggctttatgagctgtttactccaacagtgatgatgacaatagccatagtagtgataatactatggtagaagtaactgcagcaaactcaacccctaacgagtattctatcttcccaacattgtgtgcaatagccatgagagatgggtgttattcttttaatttgacacacgggaactgaaagccagagagattgggtggcttcccccaggccacacagcctggaagtagtaggacagggactcgagcccagatctgctgccccagagcctgtgcccttgaccaccaagtcatggtcactcctttcaaccctgcctgcccctgggccatctgtgttgtgatgccggctggccaggatggggagtgaggatttcagtttgtcatagggcagggagatgggtgaggcaggacactccttgagatggaaggctctggggtcgggggagagggagtggtggagactggggtgtctccgaaggagtgtttgaagatgacggtggtttttccagtttcctgttcttagctatattcaagaaaagggtaagccagaaaatttccctctgagtttcacaacttctgggagcttttgcaaagtctgggtgatgcagcattttcctggtttgaatcctaagtgaagtttcattttccttcacttaactcattctggctctggcctgtcttcccagctgtattggccatctggtcctcttctggctctttgtcccatttattattatttatttttatttttaacagagatggggtctcactgtgttgccgtctgttctggaactcctggacccaagtgatcctcctgcctcggtctcccaaaatactgggattataggcatgagcctctgtggccagcttataccccctaagcttgtgactatcttctatgtgtgtccctcttggagtgaggttccctcctgtctccatgttggcaaatcttagcaccttggcccttcgagatggaggtctgtgttgcctaggctggtcctgaactcctggtctcaagtgatcctcccatcttggccttccagagtgctgggattacaggtgtgagccactgtgtccagccaacccttcttagattttacttacttcaagaagcctgctttgacctctcaagtggaaataacaacttccaggaatagagtgatcactgggcatccatctgttgtcacatgaatgattttatccatattaaggaggcattacatgcagcagtgagctaacctgcctgtgttgaagttttcttctttttacaggctgtacaaccttgggcaagttgctttacttctctgtgccttagtctcttcctcagcaaaatggaaaaaatactacccatttcaaatggggtgaaaatgaaataatatataagtctcgtcttcacaatgtctctgatgaaaagcaggtattggttgcacatggtgctcatgcctgtaatcccagcactttgggaggccgagcagggaggattgcttgaggccaggagcttgagaccagcctggggaacatggccagaccacatctcttaaaaaaaatttagctaggtttggtggcatgcacttgtggttctaactagtttggagcaggtgaggagggaggatctcctgagctcaggaggttgaggctgcagtgagctgtgattgcacacgactgctttccagcctgggcaacagagtgaaaccccatctcaaacaaacaaacaaacaaacaaacaaataaacaaaaaacaggtattgtccttgctgtatgaatgaggaaagtgagttttcctttttgctttgtgaaactcttttctggatatttcttgccttttatgtgtatctctttggtggtactctgtgcttttaaaatcttttgtaatggccatttatggacaaatcgtatcttatattcaagattctaagctttctgagggcaggatataaatgtggttgtttctggttcaagtcctgatacaagcaaagctcagtaatttttttaaatgaatgggtgggccggtggttgggtcttcagagtcactaaatactggtggcaggagtgggaccacatagaaaaaaatattaaggcagtggatctcaatggggagtgatctgcctctcagaggacgttcattgatgtctagagacatttttgttgtcacagtttgggatgggggtgcagttggtgtctgttgggttaggatcaggaatgctataaacatcctgtgatacacgggacagacgtatccagcctaaaacgtcagtagtgttgagggtgagaaaccctgggcttattaaggcaacaagcaacatattaatagcaacaggagaaaacatgcatttaaattttttttggccaggcgtggtggctcacacccgtagtcccagcacttcggggggcccaggtgggcggatcatgaggtcaagacatcgagaccatcctggtgaacatggtgaaaccccatctctactaaaaatacaaaaattagttgggtgtggtggtgtgtgcctgtagtcccagctacttgggaggctgaggcaggaaaatcactttaacctgggaggcggaggttgcagtgagctgagattgcactactgcactccagcctggagacagagcaagactctgtctcaaacaaacaaacaaacaaacaaaaaaaaaacaaaattttttttccacaaatgtgaagtagtctagatgagatacgctcttcctgagatgataaagtgaggtctaagtgtatttattaattcttttgaggagggtgttaggtgctaaaggcagcacgtgtaaggtgaaaattgcgtatagccaaaatgaccctggggcttattctctctctctctctcttttttaataaacagcttttttgttgagatataattcacataccatatgatgcacctataaagtgtgcaactcagtttagtacattcagaattgtgcatgtctcctgtctccaggtaggcaaatcttagcacctcggcccttcttagattttattttttagagatgggggtctcactatgttgcccaggctggtcttgaacttcttggccttcctcccatcttggccttccagagtgactatattcaatattcaaagtgactgtagtcaacattagatatttttatcaccctgcttacttgtttttatttaagacctggtgtggtgtgtgcctggccttgtgatcacaaatgctagttacactgaattgacattttgctgagactcgttctgaggtccattcatagatgccctaggtacttcctgattacttgccacaccccaggaattctgcacagtgagtggggagtgacattttgagggacagcatcagtacattcactgcgctaaagaaacagtctggggagagtgagacatcgaaaaaataacatataaaataaacatctgatggagacataggaagatgccaaccttcaacaatgtttgacttggagcaggggttggcatgctttttctgtgaagggttaggtagtacatattttaggtctctcaggcccaggggcaaatagtctttcttataatatgtatttaaaaattggccaggcatggtggcttctgcctgtaatctcagcactttgagaggccaaggtgggaagattgcttgagcccaggagttcgagaccagcctcagcaacaaagtgagactctgtttgtattagtctgttctcacgctgctataaagaactgcccaacactaggtagtttataagggaaagaggtttaattgactcacaattccacagggctggggagacctcaggaaacttatactcacagcagaaagggaagcaaacatgtcctccttcacatggtggcaggaaggagaagtgctgagcaaaaggggaaaagccgtttatcaaaccatcagatcttgtgagaactcactataatgagaacagcatggaggtaactgcccccatgattgaattgtctctcactgggttcctcccacaacacatggggattatgagaactacaattcaagataagatttgggtggggatacagctgaaccatataattccatggccaaatgatatcgttctgcccctcccaaatctcatgtcctcacatttcaaaacacaatcatgcctttccaagtgtcacccagagtcttagctcattccagcattaacccaaaagtccaattccaaagtctcatctgagacaaggcaagtcccttctgcctattagcctgtaaaactgaaagcaagttagttacttcctagatacaataggagtacaagcattgggtaaatacacccattccaaatgggaaaatttggccaaaatgaaggggctgcaggccccatgcaagtctgaaatccagtggggcagtcatttcttaaagctctgaaatgatctcctttgactccatgtctcacatccaggtcatgcttatgcgagaggtgggctctagctatggccttgggcagctctgcccctgtggctttgcagggtacagcccccatcaaggggctttcacgggtttgtgttgtgagtctgcggcttttccaggtgcacggtgcaagctgtccatggatctaccattctgcagtctggaggatggtggccctcttctcacagctccactaggcagtgtcccaatggggactgtatggggcctctggccccacatttgccttctgcactgccctagcagaggttctccatgagggctccactgctgcagcaaacttctgcctggacacccaggcatttccatgcatcctctgaaatctaggtggaggttcccaaaccttgattcttgacttttgtccacaggctcaataccacatggaatctcctaaggcttttgaggcttgcaccctctgatggcacagcccgagcagcattttggccccttttagccacagttgaagcaactggaacaaagtgtaccaactccctaggcagcacacagcaggggggccctgggcccggcctatggaatcattttttcctcctagacctctaggcctgtgatgggaggggctactgcaaaggtctctgacatgccctggagacattttccccattgtcttggtgattaacatttggttccgttttacttatgcaaatttctgcagcaggcttgaatttttccccagaaaatgggtttttcttttccgtcacatcatcacccttccaatgtttcaaacttttatgctctgcttcctcttaaacactttgttgcttagaaatttcttctgacaatcatctaaatcatctctctcaagttctaagttccacagctctttagggcaaaggcaaaatgctgccactctttttgcttaagcatagcaagagtcaccttggctccatttcccaagaagttcctcatctccatctgagaccacctcagcctggacttcattgtccatatcactatcagcgttttggtccaagtcattcaataagtccctaggaagttccaaactttcttacatcttgctatactcttctgagccctccaaactgttccagcctctgcctgatactcagttccaaagttgcttccacatttttgggtatctttacagtagcaccccactcccagtaccaatttactgtattagtttgttctcacgctgctataaagaactgcccaagactgggtagtttataaagggaagagatttagttggcccacagttctgcagggctggggaggcctcaggaagcttgtaatcatggtagaaggggaagcaaacacgtccttcttcacatggcggcaggaaggagaagtgctgagcaaaagtgcttcttttgctgagaagtgttgagcaaaatcagatcttgtgagaattcactgtcacaagaacagcatggaggtaaccacccccatgattcagttacctcccactgggtttcttccatgacatgtgaggattatgggaactgcagttcaaaatgagatttgggtggggacacagccaagccatatcactgtctctaccaaaaaaaaaaaaaaagccaggtgtggtggctcatgcctgtatcccagctactcatgaggctgagatgggaggattgcttaagtccaggaggttgagactgcagtcagctatgaccacaccactgcactccagtctgggcaacagagtgagacgctgtcaaaaaaaaaaaaaaaaaaaaaggaaatccattcttagcctgtgtgctgtacaaaagcaggcagcaggctgaatttggcccacaggctgtggttcgccaacttatgacctatacaaatggcaattcatatggttcatcctagcgataactgtacatggtgtattagatactatatagcatgttcatatcaaatgtcatataatgtataaggtaacatatacagtataaaatagtgcctgagaaatatttgatgaaaaaatctgataagtacttagcaggcacagtacaaagtaccatgaagttgttaaatgggggatcagggtgtttgagaaaggggtggggagataggtgggcctccctcaagaaggaatgtttcaactgtgagctgaaggatgcccctgcattgcatgtcagggcagtgatggggagaaagactccaggtagagggaacccactctgcaaaggccctgagtcatgaaggggtccctggaacagtgagttggggctgaacccacaagctgcagttgtggggattgtgatccatcctgagagctctgagaacctggaatagttttcagcgcagtgtgaagggactggggctgtgttttgaagatatcccctgtctgcggttgggaggggagtcaggaaacctatttggaggctggggttttcacccaggtcatgcagataagatttattaggtgtggaatgaactgagcaaatcacatgtcttctaatggtacaccacactttttttttttttttttggttttgagacagtcttgctctgtctcccaggctggagagcaatggcatgatcacggctcactgtagccttgacttcccaggttcaagcaatcctcctacctcagcttccggagtagctgggactacaggtgcccactaccatgcctggctaattttggtatttttattggagacggggtttcatcatgttggccaggctcctctctaacttctgacctcaagtgattcgcctgcctcagcctcccaaagtactgggattacaggtacaagccaccgcgcctggcctttagtgatattttaaagactaaattcccttagagatgcctgggtctgcatttattgctactgttctgtttctcactgtgtgtcttgaggtcatcaaaagtaacctgggccttttcccttgttttctgcctcctctaggcttatgagccattaagcaaagccggattggtgtgtgggtcaggctcttcatgttttctttagcttaataagcagtttctaagggaactcattgtgtcattgtttagaatagcaaaagatgagcagcctcccaagtggcaatcagtaggggctgggtgaatacagtgggttccaccccttccgtggtagggtgggatgcttgcagaaggacataagacgaggaagccctttgtgcacagatgtgcggcagcctccaaggtccagtttttaagtgaaaacgtggagatccacttggtatatttggtatgttacctctgtgtaaaaaagcagacaagtaagaattacgtagttgtatttgctgtatttgtaagaaattccagagggataaatgagaaactaaaagaggcaattgcatttgggcagagtaactttttattgtttaccttgatatatactttttttttttttgagatagagtctcgccctgtcaacaggctggagtgcagtggcgtgatcgtggctcactgcatcctccgcttcccagtttcaagcgattctcctgcctcagccttctgagtagctgagattacaggtgtgtgcgccaccaagctcagctaatttttggtatctttagtagagattgggtttcaccacgttggctgggctggtctcgaacccctgacctcgtgatctgcccaccttggcctcccaaagtgctgagattacaggcttgagccaccgcgcccggcctatatatgtattatataaacatatgcacacgcatgcatacgtacacacatatatattttttaaaaattgagtcatggccaggtgcagtgtgggtcacacctgtaatcccagcactttggcaggtgaaggtgggaggattgcctgagctcaggagtttgagaccagcctgggcaacatggagaaaccccttctctacaaaaatcacaaaaattggctgggcgtggtggcatacacctgtggtcccagctgcctggaaggctgaggtgggaggattgcttgagcctggtaggtagaggccgcagtgagccatgatcacgccactgcactccagcctgggtgagagagtgagactctgtcttaaagcaaaaacagagtcatatatttcctattaaggtgaaatttaaaaaataaattcctatattccatcatccccagcttctgccattctaaagcattttcctaagcagctccactgtggatgtagcgggtatttcagaaaggcattagaaatgccctgggagggcagaacccggggcttcactggaggtgctgttgggctcagtctgatgtcaaggcagggacatggcaagggtattgagatgtgaacaagcattactcagcaaggtgacatgtgttcatgccttgatacacttgtttccccaccagctctatttttgttgcctgctctattggtttctttttcttttttttttcttttgagactgagttttgcttttgttgcccaggctggagtgcaatggcaccatctcggctcactgcatcttccgcctcctgggttcaagtgattctcctgccccagcctcctgagtagctgggactacaggtgtgcaccaccatgcccagctaatttttatatttttagtagagacggggtttcttcatgttggtcgggctggtctcgaactcctgacctcaggtgatcctcctgctttgggctcccaaagtgctgggattacaggtgtgagccactgtgcccagtctctattggtttcttattgctggtattgccatcaacttggtgactgagaacaacacacatcactctagttctcgggagtcagaggtccaaaatgtacggctggtgttctttccggaagcttgcagggagaatccatggcctggccctgtccagcatcaagaggccacctgtcttcctcaattcgtggtttcatgtccctccacccctgcttgtgttgtcaaatctcctttactttttttttatttttgagacggaatctcagctcactgtagtctctgcctcccaggttcaagtgattctcctgcctcagcttcctgagtagctgggattacaggtgcatgtcaccatgcctggctaatttttgtatttttagtagagacggggtttcaccatgttggacaggctggtcttgaactcctgaccccgggtgatctacctgcctcagcctcccaaagtggtgggattataggcatgagccaccacgccctgcctcaaatctccttttctgactcagatattcccaccgtcctcttgtcccttataattccctgtgattacattgggcccacctggatcatctaggacaggggtccccaactcctgggccatgaaccagtagcgagcagtctgtggcctgttaggaactgagtcatgcaacaggagctgagtggcgggcaagccagcattaccacctgaattccacctcctgtcagatcagtggctgcattggattctcacaggagcgtgaaccctaacgtgaaccgtgcatgcgagggacctaggctgtgtgctccttatgagaatctaatgcctgatgatctgagggggaacagtttcatcctgaaagccaccccccgccatccctggcaaaactgtcttccatgaaatccatccctggtgccaaaaagcgtggggacctctgatctgggacattctccccattccaaagtccttaatgatacctgcagagtcccttttgccatgaaaggtaagagactcaggttctggggacggggatgtaggcatctttacgggctattctgtgtactgcacctgttcagcttagttccaggcacatagtaggggctcagtacatctttgttgaatgacacaatcaatcatttggttaggctagagaatgtggaaggaggccgggtgcagtggctcacgcctgtaatcctaaggctgaggcaggtggatcacttgagctcaggagtttgagaccagcctggacaatgtggcgaaaccccatctctcctaaaaatagaaaaattacctgggtgtgatagtgtgtgtctgtagtcccagctactcaggaggctgaggcgggaggatcacttgagcccagaaggtggaggtttcagtgagctgagatcatggcactgcagtccagtctgggcaacaaaacgagaccctgtgtcagaaaaagagagaatgtggagggatattatagcaagaagtggatctggaagttttactagtagtggtatttattgagcacctactgtgtgctctggctcatgtttaacaaagtgcttatttgcataatgttagtattcccattttacagatgcggaaactgaggtttagttgctggcctagtattacagggtgaggagctgaagccccatctgcctgacgaggggtgtgttggggatgtggactagaagcttggtcagggagggattctgttcaaacagggctgcttagctttggcactgttgacatttggggccagatatttcccgtcgtgggggctgtcctatgtattgtggccattaagcagtatccctggcctctgtccacagagtgccaatagcactaccctcttcctaagttgtgaaaacccaggatgtttccaaatgttgtcacatgtcccctgagtgacaaacttgcccccacttgagaaccatggtgttgaaacatagatcacggcacatcaactccatgctcctcaggtcaccctgcgtgaaagtcagaatccctgcggtggcctgtgcgtcccgcactgactgtctcctccctgccttcttccttcctcgctgtcttcactgcttgttattcttcagacctgttggcctctctgcggtttctcagaaatgccaggcctggtctgacttcaggacctttgcactggctgttttctctgcttggtgtgcccttcctccagatggccatttggtttactcctctgtttccttccatcctgtatttgtttatttatttttaattgagatggagtctcgctctgtcacccaggctggagtgcagtggtgtgatcgcagatcactgcaacctccaccacccaggttcaagggattctcgtgcctcagcctcctgagtagctgggattacaggcatgcactaccacgctatgttggccaggctggtcttgaactcctggcctcaagtgacccacttgtcttggcctcccaaagtgctgggattataggtgtgagccactgtgcctggctcaatcctgtatttaaatacccgtcctcagcaaggcttgccctcttctctgagtgcttttcatcacacatgtcttcatatcctctcctttctaaaccatctgtctcttctctttaggctgtcagctccaggagggccggcccttggtccctattgttcactgctgggccctcagccctaggaaccgtgctctgtaaatggatgaatgctgtctgtcctgttactgcagtgtccccagacatatccctatgcccagcacatgcctgacccctcacaagaccctggaacatgactaagggatttatttggtgaaacatgagagtctgataagaggagaggaagtggctggggagcaaccttgcaaagatagccagggttggatggagaaaacgagggtgagtgtcagcttcataggacgggccttccacgagaggcctcatggtgcttgggagagttggggtgaaagcaggttggaacaagatgcttgctgctgacatttgggcactgatgggcagcctgacctctgctttctttttagtgcttaacaacactgaagccctgttaagacaggattcttaggactgggcacagtggctcatccagcactttgggagccctgggtgggaggatcatttgagccccaggagtttgaggccagacagggcaacatagcaaggccccatctctggaaagaaatacaaaaattaaccaggcttggtggtgtgcacctctagtcccagctacttgagaggctgaggtgggaggatcacttgagcctgggagttcaaagctgtaatgagctataatcatgacattacactccagccgaggagacagagcaagactctgtctcaaaaaaaaaaaaaaaaaaaaaaaattagttttgcatgtaactgtgttcagttctgtgtcttggacgtgaggatttgtggtacccgcctggatagagcaaggatggccgtgcccctgccttcctgggtgatggggataagtctggaaattgcccctgtgatgttactgggctttattcttagctctgctgagttagggggcagggtggggtgcagcccagccaacagcatgccagggcgcgtcactgcccacgcgatgctggcttcagccgccttcctctcacctcatggccctgccagccgtgcttgcctcctgctgtgtcggggctgggagactttagcctttctccagatgttttcaggagtgcggtggggaaatgaaggccacatgctgtctctctaaacaggattaatgttcagaagcccagcgggtgccctgacctaaccacgggcctcttgcactccttttctcagcttcccttggcttctgagctacccctctgcagcgttgtttctgagtgtggcatttaggagcaccctgtcgtcttgcctttcgtccctccaagccccgtctgttccttggttggttgtgcagaagagttgctagggtttgaatccaggacggtcctgcccctgtgactcgcgggccatcttctcacctgtttgtctctgtgttcctctctgtaaaagtgggaatcattacagtaccttcctcatagactgctagggtgataaaatggagcgatgtacatgaaacctgaacgcagtgcctggtatgcagtccgtgcttagacagggctctggttttatttttatttctttttctttgagacttggtctcactctgtcacccaggctggagttcattagcataatcacgtctcactgcagcttcccactcctgggctcaagcgatcttaccacctcagcctcccaagtaggtgggattacaggtgtgagccactgtgcctggcaccattcagcaatttttttttgttttgtttttgagacagagcctggctctgtcacccaggctggagtacagtggtgcgatctcagctcactgcagtctctgtctttcaggttcaagtgattctcctgcctcagcctcccaagcagctgggattacaggcgtctgccaccacacccagctaatttttagtagagacagggtttcaccatagtggccaggctggtcttgaactcctgacttcaagtgatccaccctcctcggcctcccaaagtgctgggattacaggcatgagccatcacacccggccatcagcaaatttttaagtatacaatatagtattgtgagctatagacactattctgtacagtagaccgtaggactgactgactcatcttgtatgaccaaaactttatacgctttgaccaacacctccctgtttcccccaccaccagctccttgcaactaccattctgttctctgcttctatgagtttgtcttttttagatgtcacatgtgagtgagatcttgcagtgttcgtcttcctgtgcctggcttatttcatttagcataatgttctccaggcgcatccatgttgttgcaaatggcaggatttctttccttttttttttagacagagtcttgctctgtctcccaggctggagtgcagtggcacgatctcggctcactgcaagctccgcctcctgggttcacgccatcctcctgcctcagcctcccgagtagctggaaccacaggtgcctgccgccacgcccggctaattttttttttttttttttttgcatttttagtagagatggggtttcaccgtgttagccaggttggtctcgacctcctgaccttgtgatccgcctgccttgacctcccaaagcggtgggattacaggtgtgagcgactgcgcccggccaggatttctttcctttttaaggctgagcgatagtccatggcatgtatagatcatgttttctttgtccacttgaccacggatagacatttagttgtctccatcttggttgctgtgagtgacgctccagtgaacacgggagtgcagatatctcttcagggcccatgtgtggctgagattaggagatcactgctgtcgtctctagttcagcagtgctagtgcctcctggcgtttagcgtccagctcaagggagtggaatttgggtgtctcagggtctagggccacctgtgcctctaaatcgcagggaagctttgtgtgtgtgtgtggtggggtgcggggggctatgggtatgtggtggggtgaatcttatttctcttctttcccttttcttaattttccgttggcaaaacagagcgccactccagacccctttcattcttgcaatatacatgaaaagtacagggcttgttctgcaaaagaagagtagccccagcgagctcagggttgagtgaagttccgcaaggatggcacctctcggctcttctgggggcttcaggacagagctcagtgtcgccaagcaggacccccactgcgggcggagctgcagggccatcaacattcattaggtggatcagtgaatgtagactctgcggtgtcacaaagcagcacctgtactcactgtgcctgtctcgggatggaatctaagtcagacatccttgcatccccacttatgggctgttccttcaccttgctggtcctcacctttctcctagagttacggggaggagtaaatgtgctaaggccatacacgccgactctgcagtggccttgaaccatgcttctctgtcacccctttcgttgccttgacaatggctgcagcctcctttcccatctcccctaggatcttctcctagggtctcttaatacaggggtccccaatccccagagcacggactggcaccagttcatgcatgccctgttaggaaccaggccacaggccacacagcaggaggtgagtggcaggcgagcgtgtgagacttcatctgtatttacagccgctccccatcttttgcatcaccgcctgagctctgcctcctgtcagatcacctgtggcattagattctcataggagcgcgaaccctgctgtgaaccgtgtgcgcgagggatccaggctgtgtgcttcttttgagaatgcaatgcctgatgatctatcactgtctcccatcacagctgagatgggaccatctagttgcaggaaaacaaactcagggctcccaccgattctacataatggtgagttgtataattatttcattatatatgacaatgtaatcatagaaataaagtgcacaataaatgtaatgcactcgaatcatcccctaccctgtctgtgaaaaatcgtcttccacaaaacctatccttgctgccaaaaaggggatggctgtctttttttcttttgagatggattcttgctctgttgcccaggctggagtgcagtggcacaatctcggctcactgcagcctctgcctcccaggttccagcgattctcctgcctcagcctcctgggtagctgggattataggcacaatggcaccgtgcctggctaatttttgtatttttagtagagacggggttttaccatgttggccaggctgctctcaaactcctaaccttgggtgatcctcccgcctcggcctcccaaagtgctgggattacaggcgtgagccactgtgcctggccagggaccactgtcttaatatgtgaattaggcgatgccatgaccctgcttaatgcactcccagggcctcctgtgagaattagaacaaaaaatccatgctctgtaccatgcctccaagattggctatgtggtggcctttggtgacttctcccgcccaatcttgggtcctagctcattggtgcagccatatcctccccccaccccaccccactgtggcctttgcctgtgccatctttctgcctggtatgtgcttcccgagatctttgcacagccagctcttcctgacccttccagtctgctaggatgtcatctgcccagaccgccactctggtgcttcctgtcctgacacccctgctctttccttcacagcaggtactgctctttgtcattatgttcttatctgtgagctttcatctttgatggactatgagtcttaagaggacagagatatcgtttctgattttcccccatgcctgtgactagcccaggtctaggcatatagtaggtgctcaataaacagtcatcgaatgatagattgaatgaatgaatgcatgacaggaaccctgcacttatctgtgttaatccgtctcttggctgccgggaacaccagctcctgcaacctggcacttgggtcacctgattgaaccctcctgataactctctaaactctgtaataggtgggttctagaattagtcccatttcacagatgaagaaatcaaggcctggtgaggtgaactgacttgctttagggcagcagggatgatttttgcctctctggagatatttggcaatgtctagagacagttttgattgtcataacttgaggaggtggggagtgctactatcatctagtggcagaggccagcgacgccactcagtatcttacaatgcacaggatggcccccgacaaccaagaattatttgggctcaaataccagcggttctgaggttgaagaagccctgcttgagggcacacatctgtaagtggtggagacgggaacctagacctggaaccttgttttgttaaccactaccctgcactgctcacatgcgggggtgggtgggtgggaagagttgtagaatgtttccatgtctgagtcaaaatcttgcttctctgctctagggagatgaatttggaatctgtgaggcctgaggccattcacttgatctccggccctggagatcttgcctccaagcgacctcaggctccatctgtctgccatgtaccttgcaaacaccttagaattctggctgggcatggtggctcacacctctaatcccggcactctgggaggccgaggcgggcagactgagttcaagaccagcctgggcaacatggtaaaaccctgaatctacaaaagatacaaaaattagccaggcatggtgatgcgtgccaggtagtcccagctacttgggaggctgaggcaggaggattgctggagcccaggagatcgaggctgcagtgagctgtgatggtgccagtgtactcaagcctgggcaacagagtgagaccctgtctcaaaaaacaaaaccagctgaccaaacaaaccaaaaggccttagagttcaagcacgtggtttagaggtggtggatctcagtgtcagactctcagtgggttcaaatcctggccctgtttcttctaggttgacgagcccaagcaatttacataaactctctggacctcagagcccttgccaggaaaggggagagttttaatagtcctgactttgtagggctgttggaaagcttaaatggactgtgcttgggaagcacttaatcactgtgcctggcgtgatcactctggctgttattattggcacccaataaatacatgctttctctttgtttccaactcagcatttagaaatgtcctacccttcaattcctgctgctatttatttatttgaagtgcgaactagctttcttattattattttagaaatcatgcagaggagaaaattcaaacagtacgaaagataatacaacaaaaaatagtagttgccttcctctccctggtttcaggcctaccccctgcagattaattagctttttttctttctttttttcttttcttttttttgcaatatgaagtcttgctctgttgcccaggctggagtgcagtggtgtgattttgactcactgcaacctccgcctcctgggttcaagcaattctcctgcctcagcctccctagtagctgggattagggcagatcatgaggtcagaaatgtgacaacagcctggccaacatggtgaaactccatctgtactaaaaatgcaaaaattagccaggcgtggtagcaggcgtctgtaatcccaggtacttgcgaggctgaggcaggagaattgcttgaactcgggaggtggaggttgcagtgagccgagaccacaccattgcactccagcctgggcaacaagagcgaaactccgtctcaaaaaacaaacgaaacatcaaattcctgactgtgtatgctgcttgcaggttatatatgaccaggcctggttctgtatctgtaaaatgggttacgttatagtacctgagtcctagagttgtgtgtgaggatgaaatgtaatgtgaaacacttagagtggtgcttggctgatgcaactaatgaatcttccctcttactctttctatagacagaagaaggcggcacaggtttcttcattgcttttcgccctttgctgaaatgtcatcttggcccagaggccctttctgtctacctgataaagaactagcacctgcccacccaccattatgcttcacccactttcttcttcttcaagccatttgctcccattgggcatacatagagttgttttttttagctgttggtagttttggccgctttgcataaagtgaaattgtgtgagagtggagactttattttacttccacatgaccttggcccatggtagtagtcgctgataaatgtccactgagcaataagaacccgactgttgcaagttacttatttatttatttttgagacagggtctcagtctttcacctaggctggagttcggtggtgcagtcatagctcactgcagcctcgaactcctgggctcaagggatcctccttcgtcagcctctggagtagctgggactaaaggcaaacgtcatcacatctggctacttttaaatttttttatttgtagaaggtggggagtctcactccattgccacctctggtctcgaactcctgggctcaagtgatcctcctgcctcggtcccccaaagtgttgggattacaggtgtgtaccaccacgcccagctaagtttttttttttttttttttttttttgagatgcagtctcactcttttgtccaggctggagtgcagtggcctgatctcggctcaccacaacctccacctcctgggttcaagcgattctcctgtctcagtctcctgagtagctgggactacaggcgcacgccaccatgcccggctaatttttgtacatttagtagagagagggtttcactatgttggccaggctggtctcgaactcctgacctcatgatccgcccgcctcagcctcccaaagtgctgggattacaggcgtgaacccctccacccggccagctaagtttttaaatttttttgtagagatacagtctcactgtgttgcccaagctgatctgaaattcctggcctcaaactatcctcctgcctctgcctcttcaagtgctgggaaatataggcatgagccactgcacccagctggttgtgagttattgagatggttgaattgggagtggatgctcaggcctcagtggaacttgtggtacacagtatgtcctcattacctcccatcagtggcagttgagattcataatcactttttctgcctgttgtctgccccatcctctctgtggccttccctcctgtcctggagttggctggctgggtccctggcagggctgcatgcgttatccctgcaggcctgcttgccttatccctgcaggccctggtggagcatctgtgcagaacctgtgccatccagatgggagcagtaagggtgtagggcaaagttagtgagctgcccggtgcacgaggacttccatgataatcagggctgaaccaggaaggcaggtcaaggccagggtcatgtacagaaaggaggtcagcaccaggatcttgtatgggaagacttagatcaatgcctagtgccttagtcatcatcattcagcccagaaaacatgacgctatgcaacaggaattttatgaacacacaaaggtcaggggccactcggacttggacggggtccccaactctttgagtgtcagggctgagggcatggagacacaacttgatcaagctggtgaagtgtccagcaaggagaagcctctgttggagggagccgggagctggggaggacatgcgctttctcttttttttttttttttgagacggagtctcgctctatcgcccaggctggagtgcagtggtgcaatctcggctcactgcaacctctgcctcctgggttcaagcgattctcctgtctcagcctctcacgtagccgggactcaggcctgtgccaccacgcctggtgaatttttttgtatttttagtagagacggggtttcaccatgttagccaggatggtcttgatctcctgacctcgtgatccacctgccttggcctctgaaagtgctaggattataggcgtgagccaccgcgcccagccgacttgcgctttctctgtaaagatttctgtgggccaggttccccaaagggcaggccctgggccagtgcagtgaccggtgaccgtgttcaggactcatctcttgtggctgaattgtgtgtctggagagttgggtccttctgattctgctcagagcgtggtgggcctggctggatttccctagattaggaagcagcctcgggtagctgtgattctttgagttgggaacagcaagtggcctgcagactgccagggaatcgtcccttccttgagcctttaggtattgcccattattcaccgtttttcccagaagcctccagtagtgagagtcgcacttcttacctcctggagttgttaaagtaaagaaggacacattagggtccctgccggtaaggaacatccaggaggcctcgataccttttttttttttttttttttttccctgagacagagtctcgctctgtcacccaggctggaggacaatgacctgatctctgctcactgcaacctccacctcctgggtttaagcgattcttgtgcctcagctgcccgactagctgggattacaggcatttgccaccatggctggctaatgtattttttttttctttttcagtagagatggggtttcactatgttggccaggctggtcttgaactcctggcctcaagtgatctgccctcctcagcctcccaaagtgctgggatttcaggtgtgacccactgcgcccagtcccgatactttgtttctttgagacagtctcttactctgtcacccaggctggagtgcctgggtgggacgatcaaagctcactgcagcctcaagcccctaggctcaaaagatcctcccacttcagccttctgagtaggtgggactacaggcctgcactaccacgcctggataatttttaaatttttttggtgaagacagggtcttactttgttgcccaggcttttcttgaactcctgagctcaagcaatcctcccgcctcagcctcccaaagtgctgggtttacaggcgtgagccactgtgcccggtcctcagatgatcttagctttgtgacctatgctgttggccgctgtaggggctgtgatggaggtgatgtgggggtggatggcaggggtgacccgtgttggctgctttctgtaacagtcatagttcatggtcagagtcagatttcctctcgtcatgccttccttcccttccttctgctccctcccacagccgccctttgggtctgggctggccatctggctctgagcaggaagctagcctgtgctcttcaatttgctttctgcaggggaaacaccttcctttgctcagcgtttcctgacctctccttccctggagttccggtgtccttaaatgctctctggtttcttctgtagcttactttcttgcttgaaaggacaacttttctttgtcctttagacttcttatctctgggcaatacagtggtggtggcagtggtgattattatcaactattagtatctgctactacggtttattgtctctagactgtatcagcacctgtcacacattgtcccattgaatcctctccagaactcttccaaatgatgtgttttcctgacttttaaaaaaattaaaaaaaaatttttatatttttttgagacggagtctcgctctgtctcccaggctggagtgcagtgctgcgatctcggctcactgcaagctctgccttctgggttcatgccattctcctgcctcaacctcctgagtagctgggactacaggtgcccgccaccacacctggctaatttgttttttaatatttttagtagagacagggtttcaccgtgttagccaggatggtctccatctcctaacctcatgattctcccaccttggcctcccgaagtgctgggtttacaggcgtgagccactgtgcccagccaaaaaaatttttttaaagaaatggggtctcgctgggtgcgatggctcacgcctgtagtcccagcactttgggaggctgaggtgggcggatcacctgaggttgggagttccaggacagcctgaccaacatggagaaaccccatctctactaaaaatacgagattagccaggcgtggtggcaggcgcctatagtcccagctactcgggaagctgaggcaggagactcgtttgaacccgggaggcagagattgcggtgagctgaaatctctccattgcactccagcctgggcaacaagagtgaaactccgtctcaaaagaaaaaaaaaatagaaaaagaaaaataaaagaaatggggtctcactgtgttgcccaggctggtctagaattcctgggctccagctgtcctcccatttcggtctcccaaattgctgggattaaatgtgtgagcctctgtgcccggcctctttctctctctctctctctctctctctctctctctctctctcctctctctctctctctctctctctgtctctttctttctttctttctttctttctttctttctttcagcctgagtctcgctttgtcgccaggctggagtgcagtggcacgatctgggctcactgcaacctctgcttcccaggttcaagtgattcttctgcctcagcctcccgagtagctgggactacaggtgcatgccaccatgcctggctaatttttgtatttttagtacagacggagtttcaccatattagccaggatggtcttgaactcctgatctcatgatctgcccgcctcggtctcccaaagtgttgggattacaggcgtgagccaccgctcctggccttccttttttttgaagcaggttctcactctgttgcccaggttggagtgcaatggtgtgattatgtctcactgcagtgtctaccttccaaggctcaggtgatctcctgcttcagcccactgagtagctgggattataggcgagttcaccatgcctggctaatttttgtgtttctagtagagacgggtttcaccatgttgtccaggctggttttgaactcctgggctcaagtgatccacccgtgtcggcctcccaaagtgccgggattacaggcatgagccaccgtgtccagcttttctgactctttttacttatcaggagactgaagcttggagaaattaagtgacttgcccaagttcacatggggttaaggcctgaatttgaatctacatctgctcaattaggaagtgagtggtcatagctagtctctacctggatggattgttgtttaattgttaaattttttcaaaataattttaaattattttattaaaaaagagggtatcattatgtttcccaggctggtcttgaactcctgggctcaagtgatcctcctgccttggcctcccaaaatgctgaggttacaagtgcaaactactgtgcctagccagattattacttaacaaccaaaacaaaggaggaaattgacggtggacaagtaagaagatcattgcaaaggttgggggcaggttgtttggggagtgtggaggaagctttttaaatgaggtacctgagttggattttgaaggatgaataggagtttgttaggacagaaagacattgcagagagaggatctagcaagaggtgactgaagaaaccatttatttgaccagcagttggggaatgccttgaaggcaggaaccacagcctttcagaatctccagtgcctgcaacagtgtctagaacattatctgacaacaagcttggtaaatacttctttaagtaaatgcctgagtaaggcacatttggggaacagggtgggagaaattgtaggagaagtagatgggacttgaatgtagaaggaaggcctcatggatcactgcaagggttggttatttttttttattttttatgttttgagatggagtctcgctttgtcgcccaggctggagtgcagtggcgcgatctcggctcactgcaagctctgcctcccgggtgcacgccattctcctgcctcagcctctccaagtagctgggactacaggcgcccgccaccacgcccggctaattttttgtatttttagtagagacggggtttcactgtggtctcgatctgctgacctcgtgatccacccacctcggcctcccaaagtgctgggattacaagcgtgagccaccgcgcccagccagggttggttcttaaaagccaatagggagccatgggaagttgtttcccagcagaagagagaaggccattagatctgccctatttattaatgcaaatatctaagtctatgaatcttcctctgagcaggaaaacgtgattgcttttaaatccatatggaaagaccctcagttttactcatgataaagagaaaaggaacttaaactacacagagatatttttcacttcagattggcagaggtcggaaacttgttatctgctgtgctttgtgaagtaattgcctttgtaccttatcagctggagtatgaattgatgttccctatttggagggcagtgtctgtctaaatgttactgtaggcaccctttgacctggcaggttccttttttgaaagtttatatatatgtgagacagagtctcattatgttgcccagggtggtttcaaactcctgggctcatgggatcctcccacctgggcctcccaaaatgctggagttacagatgggagccaccacacctggcagagaaagtgatcttatcaacactcttgcttgagtgtgaaattcaattgtttattcaatgctgcattgtttgtaagaggaacaccaatgccaagtccccaggagaccgatggaagtcaagttcatccctacaatagaatacaaagcagccgtaacaaagagtgaggaaactgttcatgtatactgcgggatgatctttaaaatctgtggttaagagaaaaaagcaaagtacggaacattatgtaacgtatgcttccttcgatttgataacagaagatgtatatttactttatttttgtataaaatattttctgaaagaagacataagcaacccatgatcattgcctctagagagaggaactgaggggagggccatagggaatggaatgagaagacttgtcccttgtacctctttgttcaaaagaaatatcaagaataaaacacatctatgttactgataaagatagtttccaaaggctgtgtgcggtggttcacacctgtgatcccagcactttgggtggccaaggcgagtggatcgcttgagctcaggactttgagaccagcctgagcaacatggcaaaaccccatttctactaaaaatacaaaattagctgggcatggtggtgtgtgcctgtggtcctagctgctcaggaggctgaggtgggaggattgctggagcctgagaggttgaggctgcagtgagctatgattgcaccactgcattccagcctgggcaacagagtgagaccttgtctcaaaaaaaaaaaaaaaagttcagtttttaatattagctaagtaaaaaaaagcaaggtatagaatggagtatcgtagtgccttttgtggcaacaaaataggtcgtatttggaatatatctggaagaatgtaagatgttagcaatggtagcttgcctgtagggtagcaatggggggctgttaatttggggagaaagacatatttttcactgtatacctttttgagtaatttgaaagagttttagcacacaaatatattacctattaaaaataattacaaagagagggagacatgggtggatgcatggatggatagttggttgggtagatggatacatagacaggtggatggattggttggtggatggatggatgaactgttgggtgggtagatggattgatgggtgaatgaattggtaggtgggtagggtggatggatgaattggtggatgggtaggtggatggatgaatgaactggtgggttgctggatgggtggatgaattggtaggtgggtggatggatggattgatgggtgaatgaattggtaggtgggtagggtggatggatgaattggtggatgggtaggtggatggatgaatgaactggtgggttgctggatgggtggatgaattggtaggtgggtggatggatggatggatgggtgaatgaattggtaggtgggtagggtggatgggtgaattagtggatgggtaggtgcatggatgaatgaattggtgggttggtggatgggtggatgaattggtaggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatgggtgaatgaattggtaggtgggtagggtggatgggtgaattggtgaatgggtaggtggatggatgaatgaattggtgggtgggtggatgggtggatgaattggtaggtgggtagctgaatggatgaattggttggggggggtggatggatgaattggtgagtgggtagttgggtggatggatgcattggtgggtgggtggatggatgaattggtggatggatggatggatgggttcatggttgggtgataaatatatccatgggtatacatatggatgtgtacatagataattctctggctatgatagggaggactggctgtggtggggaacactgactgtggtggggagcactggctgtagcggggaggactcagtaggacaaggagaggctggaggcagtgaagacttaggaagcagttgcatagtcctggcaaggaataatttggggctaggatcaggtcaattaaatgtttaacattggaactatgtctcttgtatacataactgcatatgtcaagtcttggtatcgttttctttctagcagggcacattcctttggaatgagcttttactggcaactgctcagaagctgttctgtatataatgaccaccaacagtttaatccttttttcagccatcacctcaggaattaacagtagtatgaaatcaattaaaataatcagtctttgagatgtcatgccttctccacgatcaacttcttctttacaaggctgtgttccaaatacgccaggccaaaaagacgtgaactttgtcctttttagggtttgtgtcttgatgtttcctggctaaatctctttgtatgtgttggccttgtaaggtttactttttttttttttttttttgagatggagactgtgttgcccaggctggagtgcagtggtgcagtctcagctcactgcaacctttgcctcccgggttcaggtgattctcctgcctgagcctccctactagctgggattacagacgtgcactaccctgcccggctaatttttatgtttttagtaaaatataaaaattatgtttttatggggggttcttgccatgttggccgggcttgtctcagactcctgactgcctgcctaggcctcccaaagtgctgggattacaggcatgagccaccgcgcccaacctaataactagatctctttaattattggaacatgtatattttgatcagattgacacttttttttttaagtgaagtgatcttatttccctcatttctcatttttaacttttttttttttttgatatggctttaaagctctgtggagctgtaagggtctgggttccttgacactccatgggggtctcaggtgatcgtgggagggctgttggaatcagagctatttggagggtgcataggccagtaggatgggaaggctgtgggagaagtgggctttttggggaccgcagccaaatggacaactgggcctaatctaaagattggcccctcccagctcctactgatggtcatgtaacaggaatggggcccagcaccaccagattttctgatttttttttttttttttgagacacagtcttgctctgttgccaggctggagtgcagtggcatgatattggctcactgcaacctccgcctcctgggttcaagtgattcccctgcctcagcctcccaagtagctgagactacaggcatgcgccaccatgcctggctagttttttgtactttagtagagatgaggttttaccatgttggccaggatggtcttgatctcctgacctcgtgatcctcctgcctcggcctcccaaagtgctgggatgacaggcgtgagccactgcgcccagaagattttctgatttttaaagttatgccagagaccgggcgtggtggctcacgcctgtcattccaacactttgggagactgaggttggcagatcacctgaggtttaggacttcgagactagactggccaatatggtaaaaccttgtctttactaaaaattcaaaaaaaattagccaagcggggtgaccgcagtcccagctatttaggaggttgaggcaggagaatcacttgaacccgggaagcagagattgcagtgagccgagatcgcttgaacccgagaagcagagattgcagtgagctgagatcatgccactgcattccagtctgggtgacaaagcaagactctgtcaagaaaaaaaaaaataaaaataaaaagccggaaatcaaattttaaatgttgggatctaatctaatttttttaaaaacaaaaagtatgcctaaaacaacagcaataacaacaagccatctatgggccaaactgtgggtggggaaacctattttgtacttcttattttatccgattgaattgtggtggagataggaaattgagaccccaaaaagggtagtaagttttcccaaagttatttagtcagttgccagattatggcttgaattaaatttaaattcttcagctgggcatggtggtgcacacctgtagtatagctgcttgggaggcagaggtgggaggactgcttgagcccaaaagttcaaggcacaggaagctgtgatcttaccaccacacttcagcctgggcaacagagcaagacctcatttcaaaaaaagaaaaaaaaaagaaaaatttaaattcttcattacagaacagctgatggtggaggtttattcttgggcaggtacatctgatctatttatgtatgtatctatgaatttgtctatttggcatggctctttagcaaaatacaggctttttttttttaagtaaaagtaattgaaacaaaatttgtttccaaggctggacagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggtacttagaataaagcctggcatacagaactgcagtttggttgttatccgtggtggtggcggtggcggtggcggtggcggtggcggtgatggtggtggtgatggtggcgatggtgatgatgatggtggtgatggtggtgatggtgttggcagtgatattggtggtggtgatggtcatagtggggaaggtgatgatgatgaatgaagatgattagaaagtcctcagttcacaaggtcagagtgatctagatgacacagggctcttcggttataagagaatatccttcagggttcctttaaatggctctctccatctttcgtactacagtgggacttgccacaggttctggggactgttaatgtgagatgagatgctacatacctttttgttgttggtgggtttttttgtgtgtatgcactgttgtgtgtgtgtgtgtgtgtgtgtgtgtgtgagagacagggtctcgctctgttgcccagggtgtagtacagtggcatgatctcagctcgttgcaacttccgccttccaggctcaggcactcctcccacttcagccgcctgagtggctgggaatacaggcacgctccatgctcagccactttttgtgtttttcatagaggcagcatctcactatcttgcctaggctggtctcgaactcccagcctaaagtggtctgcccacttggcctcccaaagtgctgggattacaggcatgagccactgcacctgacctgtatgctcctgttaagagagctttatttttatttatttattttgagacagggtctctgttgctcaggtgggagtgcagaagacaccacatacctttatcccttgttcctcatttcttagtctttctggctactgatctttttagtttgcgtgttcatcctgaaaggtccttggatatataggagccttgtctgtttcttcaaaccccgtggcagctggtttcatgctccaggcgagctcctgtcctctggggtgtgtcctgctgacccctcgcctgtgtttgtgttcgcaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgtaagtcactggggggtttcgttgtggggggtgggaaggtgcacctggacggggagtggtggttggtgataactgacatttctcttctacttagttgaccctaagttccttcttctagaaggcagaagaataatgtgggaggtgaaaactggagctctggagacaaacatgggtacaaatctttgctctgccgcttagtatttggcctcgagcaaattttttaacctccccaagcctcagtttccctgtttatgcaataggaatgataggcttgttctcaaggcattcctgggagattatcagctcttcccctcttactgagccgatctcctttttatttaattaaatatatttatatagattttttctggccaatttttaatttattttttgtagagaggggggacttgctgtgttgcccgggctggtcttgaacacctggcctcaagcagtcctcctgccttggtctcccaaagtactgggatgctcagtgtgaaccaccacgcctggcccctaattttttttttaagttggcttttattttgaaataatttaaagctacaggaaaattgcaataatgggccaggcgtggtggctcacgcctgtaatcccagcactttgggaggccaaggcgggcaggtcaggagtttgagaccagcctgaccaacatggtgaacctgtctctactaaaaatacaaaaatgagctgggtgtggtggcatgtgcctgtaatcttagcaacttgggaggctgaggtgggaggatcccttgaacccaggaggcagaggttgcagtgaactgagatagtgccactgcactctagcctgtgcaacagagcgagactccttctcaaaaaaaaaaaaaaaaaaaaaaagttgcgatgataccaggaactgctgcctgattttctctatccatcactcatagtcactgtttcctgttttttttttttttgttgttgttttttgtttttttttgacacaaggtgttgctcttttgcccaggctggagtgcaatggtatgatcacagcatactgcaaccttgaactcctggctcaagccatcctcctgcctcagctttttgagtagctggtagctgggactgcaggcatacaccaccatgcctggctaatttaaaacaattttttgtagagacagggtctcgccttgttgcccaggctgttgtcaaactcctggcttccagtgatcctcctgcctcggcctcccaaagtgctggtattacaggcatgaatctggcctgtattcactgattttttaatcttttgctacatttgttttatcatgagcttttgttctctctctctgtatgcatgctataatttattttttctgaatcatttgagaatggatgcaccttgaaacatatcccacccgtagagggctctcagtaaatactggttgaatgaatggttgtcgtggagggctttcttgtgcagtgcgccggagttgcagctagagatgagctgtgagctgagctcttgagtgttcaggcaccggggagcatggtgaccagacaaacagtcctgttggaggtagtggggcgtagcaggctgattacagaccatcacgtgccggcctggatgccagctcaccataccgaggacttgtccttattccagtggatatgtgccatgtcctaggactgtggctgatcatttgaaggctggctggttctcctatccctggggctgagctgttcgtgcaggccctgggggaggttccagggcggtctgttgtaggatatgtatgtgcttctcttccaggccttgggatttttgctgtggatcgtctgctgggcagacctcttctactctttctgggaaagaagtcggggcatattcctggccccagtgtttctggtcagcccaactctcttgggcatcaccatggtaagtaggagctggctgtgacccctgggccatctgctgggctcagtggagaccaaaagtaataactcgtaagactagaatcatagttttttaaggcaatgatcagctggagctgggatataaattaaatgtagcctttttttttttttttttttttttaaagacatgagatctcgctttcatccaggctggagtgctatggtaccatcatagttcactgcagcctcaaacttctggcctcaagcaatcctcctacctcagacttctgagtagttgggactacaggtgtgtgtcaccacgcccagcttatttttggctaattttaaatttttctgtagaaatgggatctcactgtgttgtctaggctggtcttagactcctggcctcaagtgatccttccagagcactggcattataagcatgagccactgttcccagccccagctgcagtctttggatggggcatgtgttgtccagtttgccacagtccccaccatgccctattgtcttccctgccactgattgagtggcagatgcccccttttgttgcgtttgccacactttgctcttgcattggctactttggtcacttatatactaactgcctggggtctaatggccttgagttttcactatctggcatagggggtgggttgctaagctaaataggaaactgctctgtcccgggggatacacaacttagtgagtgacagagacaaggaaacaactttattaattacagctggtgtgtattgagcacttactatgtatgtacctggcagtattcttggtgtttcacgtgtcttgaaattcattgaattttcacaacaaccctgtgagatgggtcctgctttgttcccatcttacaggtgaggaaaccaggcaagagaggttaagtgtcctgctcaagatcacaccactaatgtgcagccgagtcaggggtgggaccccagatgccatgcttttagcccctgcaacctgcagcttctgagccctgaacagagagttctcggagagtgtagcccttgagtattgtaaaaagaggagggaggctgggcatcgtggctcatgcctgtaatcccagcactttgggaggctgaggcgggagaatcacttgaggtcgggaatttgagaccagtatagccaacatggcaaaaccccgtctctactaaaaataaaaaaattagccggcgtggtggcacacgcctgtagtcctagctactcaagaggctgaggcaggagaattgcttgaacccgggaagtggaggctgcagtaagccgagatcgcaccactgtgctccagtctgggggacagagcgagacctcatctcaaaaaagaaaaagaaaaaaaaaaggagagaacaagtttaaggcaggacattctgagcagggtgaacagtgtgtccagggaggggtggaaggttaaggggaggatgcaggcagggaggacaaggtgttcggtgaaggaacacggtgtgaaggttggggggatagagtggatgtgacagaggggtcaggaaagacaacgtggagccaggttgccaaggaccatgaatctttatttttctaaattaatttttcattttttaaattttagagtcagagtcatactctgttgcccaggctggacttcactggcgtgagatcacagctcactgcaggcttgaactcctgggctcaaatgatccttctgcctcagcctcccaagtagctgggagtgtaggcatgcaccaacatgcccatctacatttattttttatttatttatttttttatttttccccccgagatggagtttcgctttgttgcccaggctgaaatgtaatggtgtgatcttgagttgccgcaacctctgcctcctggattcaagcgattctcctgcctcagcctcccgagaggctgggattacaggcatgcgccaccacgcccggctgattttgtatttttagtagagatgggatttcaccatgttggccaggctggtctcgaactccggacctcaggtgatccacccacctaggccccccaaagtgctgggattacaggcatgagccaccacccccggccagtttgttatttttgtagagacagggtctccctatgttgcccaggctggcctcaaactccttgtctcaagtgatcctcctgtctgggcctcctaaagtgctaggattataggtgtgagccaccatgccctgcccagaccatgattctatatagcacacatatgtgctgtccactctctgccaagaactgtcctaatccctttattaacccttttacgttgtaaataaggtaagcaaagtgtggtacagagaggagaaggactggcccaaggtcacctggtcagtaagtggtagagccagcttccagtctaggccccagcgtgtagcctggcacctgctttacgcctggctctcctgctgggtttgattcccctttgtgtcctcagagcctggccctgtgcctggcatgcagtaagcgttccataaatgcatggagggaatgagagagtaaagggctttgctttgtcctgaattcgggtcttgggctctgtgttctggcagtggggtattagagtggatttttttttttttttttcaatttcactataatagagacagggtctttccatgttgcccaggctagtcttaaactcccgagcccaagtgatccctctgccttggcctcctaaagtggtgggattacaggcatgagccaccatacgtggtcagctgtttttgacttgagtaggtcatcctcccttaacattccttgttcctggtcttttttttttttcctttgaggcagagtttcgctcttttttcccaggcgcaatggcatgatcttggctcactgcaacctctgcctcccgggttcaagtgattctcctgcctcagcttccccaataactgggattacaggcacgcgccaccacacctggctaatttttgtatttttagtagagatggggtttcaccatgttggccaggctggtctcaaactcctggcctcaggtgatccacgtgccttggcctcccaaagtgctggtattacaggcgtgagcaactgtgcctggccgttcctggtcttttgatcgttcatttatgcctctgtcaccctgggggaaacaggggtgatagtctgagggttggggcttttgactcctcaggggactctgagctgggctggccaagaggtgaactggcctgtgagatcctcagcctctctttatctacctgagatctctgggatggaatggaggaccaccagctcagctgtgaatgtgtcagaaacattctgactatatcccagggaaccaggatatgcaggcactggtaatatgggacaggatgcagccagcacatgttttttttttttttctttgagatagcgtctcactctgtcgcccaggctggaatgcagtggcatgatctcagctcagtgtagcctccgcctcccaggttcaagtgattctcctgcctcagcttcccagctagctgtgactaaaggcgtatgccaccacgcctggctaatttttgtatttttagtagagatagggtttcaccatgttggccaggctggtctcaaactcctgacctgcccgccttggcctcccaaagtgctgggattacaggcatgagccactgcacctggctgatttttttttttttatccctactctgtatcaagcgttggagacacaaccatatagtctagctgtgcaaacagacattaaacaaatgattcctcaaaaggcacaaagtgtttgaacgtctgcagagtgctgtgtgagggtgaaggcaggggagcttggtttggtctggggcatagccaggcttctctgagggagggatggtggaggtgaagcctgagaatgagcaagttgttaaaaagcttaaggggctgagggcagaggaccagctgcggagaaaagcacatgtaaagtcctgagggtcacagggaaaacttgagagttgtgtgtggctggagcagagatggccgaggcagagagcaggggcgatggggcagaggctgaccccgggaacgttgagcatcagggcaagtgggttttgttttctgtactgggttctctgcctgttcttttaaataaagttttattggcatgaaggcatgtccattcattaacatcttgtctatggccactttcacactgcagtggcaaagctgagtagttttgatgtagtctatggcccatgaagtccaaaatatttattacgtggtccattaagaaatagtgtggctgggagcagtggctcacacctgtaatcccagcaccttgggaggccaaggcaagtggatcacctgaggtcaggagtttgagaccagcctggccaacgtggtgaaaccccgtctttactaaaaatacaaaaattagctaggcatggtggcgggcacctgtagtcccagctacttgggaagctgaggcaggagaatcacttgaacctgggaggcggaggttgcaagtgagctgagattgcaccactgcgctccagcctgggtgacaagagtgaaactctgtctcaaaaaaaaacccaacaactcctgtcttgtgcttctctcctcagctgcttgctacctttttaattcagctggagaggaggaagggagttcagtcttcagggatcatgctcactttctggctggtagccctagtgtgtgccctagccatcctgagatccaaaattatgacagccttaaaagaggtaagtggcagtctccttcctcatcttccttcagtggacccggagggagagatgctgggtccctctggcttgtgtagaagtcatgcgttgccatgggaaccaggggctgggtaccacatgcacctagcttctcccttggtgactttcctaccccaccaaatcctcactaaatcagccccagccttttttctagcacctcctttccccagggcctgatttgtctgtgttgctccaaggggctcccatgggacctccaagggcaggagctgtgggccgatgccaggctggccccatcagcaggaaacagcaagacaggcggctccaaattttgccaggctgggatggagccgagccgggaacggtgtttgcagagtgactgttcccctgggggaccctaggcttgtcctcgcgttacctttgtcccatcagttgctgctctggctggggaagttgtttacattggctgctgtgtgctgctgctaggaattttgaggagtgtgcacttttttttttttttttttgctgttgttgaggcggagtctcgctctgtcaccaggctggagtgcagtggcacgatctaggctcactgtaacttctacctcctatgttcaagcgattctcctgcctcagcctccccagtagctgggaccacaggcacgcgccaccatgcccagctaatttttgtatttttagtagagacggggtttcaccacgttggccaggatggtgtcgatcacttgacttcgtgatccacccgcctcggcctcccaaagtgttgggattacaggcgtgagccaccacgcctgacctggagtgtgtgcttttggaataacctgctgttcctgccatcttggagctaattagagactggcatgaggcaaaggaaggaaaagaagctgaacatttgactattgattgcctacatattattatgagtgatagcagctgatgctgattgagttcatgttttcaaagtgcctcgcaggggactgtgtatgtgtcacgaataatcttcctgacctcttgcagtgacttggacagaatttctcagcctcagcactaatcgacattttggattggagactcgttggttgtaggggctgtcctgtgctttgtagacatttaggggtgtccctggcttcccctgactgggtgccataacactcccaagttaccacaaagaagatatccccagacactgccagatgtttcctgggaggcagaatcacccctggttaagaaccaccggtggtttataggtggggaatctgaggcacagaaaggttaaataagttgacaagatcccacagccagtgtgagagagccaggccttgatacagctctgtttcactcccaagccctgtcttcctcccatcaggcagcggtgagcagtgagactacccgtgatggagccggctttctgccattacatcccggggggagctgggagcccctggggagcctgcagtgtccctgtggctgagtgggtttctgccacctgctctcagaatgtgatcttggttttttttttttttttttttttgagatggagttttgctctgtcacacaggctggaatgcagtggcgtgatctcggctcactgcagcctccgcctcctgggttcaagtgattctcctgtctcagcctcccgagtagctgggattacagttgcccaccaccacgtctggccaatttttgtatttttagtagagacggggtttcaccatgttgaccaggatggtctccaactcttgacctcaggtgttctgcctgtctcggcctccaaaagtgctaggattacaggcgtgagccaccacacccagccccagaatgtgatctttttcttccttccttccccaccatgtaggatgcccaggtggacctgtttcgtgacatcactttctacgtctacttttccctcttactcattcagctcgtcttgtcctgtttctcagatcgctcacccctgttctcggaaaccatccacgaccctgtaagtgtgaccacagatgagtgtgtgtgcgtgtgtgtgtgagagagatgcgtgacacagtaccagctaacatttcttagatccatccaggatctcgttccagcctccctcaacccctgatacagggaatatcatcccacctactttacagatggaaaaactgaggcttagatgtggctgggggagctgaaggagagaatctgctttgtcattgatgaactgctgtcttgcaggcctgtaggtttctcacttggcatggtgattttggaaaatgtgagcagataattacaaatcaggtattttttatgaattctagctgtccagatgttctggaaaagtaaagttctgacagattaggcctataatcctacagggcagagctgaggagttgctggagtccccggcactccctgttgtattatactggcatgctttcctcacttgtggcaaatgcctggcccctgagggatttgagtgtgagatccttggtctattttgtcagtttcagagaaattctgtaaatatggaaacttatcagtgaggagtgtagagatggccaccgtttctgctagtagaacaaaagggaacactttattaatttcccttaattcttttcttcttttttttgagacagggttttgctctgttgcctaggctggagtgcagtggtgtgatctcggctcactgtagtcttgacctcctgggctcaagcaatcttcctacctcagctttctgagtagctggaattacaggcacacaccaccatgcctggctaattttttttctttcttcaacttttattttaagttccagggtataggtacaggatgtgcaagttcgttacataggtagatgtgtgccatggtgatttgctgcacagatcaacccatcatctaggaatcaagcccaggatccattagctattcctcctgatgttctccctacacctgctccccaacttggcttacttttaattaattaataattaaagatggggagatggtctcaaacccctgggctcaagcgatcctcttgccttggcctctcaaagtgctgggattacaggtgtgagtcaccacgcctcgcctattctttatttttttaaatagagatgggatcttgctgtgttgcccaggctcatgtgcagcttttgataagagagatctgggaaggcctgcccagaaaactgcatgtgagcggagacctagaggggtgaggtagtgggtggagcaaacacctagaggaagagtgttccaggcagaggggaataagtacaagggccctggggtggggaggtgtggagagaacagcaagaaaagccagcacagcaggagaaggctaagagacagtgggtgcctgagaggtgggacagcccccttgtgagccagatgagctgtttgggttttattgtgagtatggggcagggaggccttggagcacctatttgatgctgattcatggctagtcagctggtaatgggcggattgcagtgggagaacttttcacctctgtggttctgttgggtttggcctaaacctctgtgaggggcagaggctcaccttgtgggtgacgaaagggcttggtgggcatcagtatggaggaggaggttgatgataactaagagattttagaaacctatgtctcaggccaggtgtggtggctcacacctgtaatcgcagcactttgggaagctgaggcaggcagatcagttgagttcaggagttcgagaccagcccagccaacatggtgaaatgccatctctgctaaaaatacaaaaattagccaggcatggtggtgcatgcttgtaatcccagctagtcgggaggctgaggcaggagaatctcttgaccctgggaggcggaggttgcagtgagcagagatcacaccactgcgctccaacctgggtgacagaatgagactctgtctcaaaaaaagaaaaaagaaatgcatgtcccagtgtatgttctgaggagtcccgtgttggtatttccttgcccaaagaggagctgggttggagaaatgagcaagtgcacacatctgtgtatgtattcctgtgcatctgtgtgtacgtgtgcatgtgcctgcttgtgtgtctcggtagtcataggcatgtatatgcgtgtatgtgcttatatgtgaatgtgtgcttgtgagtgtgtttatgttcatgtatgtgtgtgtttgtgtgtgtgtgtgtctttgtgttgtgtgtgcttgcatatgtataaagttcacaaaggcaatggtgactcatgcctgtaatcccagcactttgaaaggccaaggctagaggatcgcttgagcccaggggtcaccccattttggatccctggctggtgcctgacacagaagagaggggctcatgagtcagtggctgttatatgtattgtgtatcagtgtgtgtaagtgtgtggcagccgagtgtccctgtttgtcaaatgttgggctattcttttttgtcttttgtttgttgtttttttctgttgttttgttttgtttttagacggattcttgctcttgttgcccaggctagagtgcagtggcatgatctcggcccactgcaaccccgcctcctgggttcaagcgattcttctgcttcagcctcctgagtagctgggattacaggcgcccatcaccatgctcgactaatttttgcatttttagtagagatggggcttcaccatcttggcccggctggtctcgaactcctgacctcaagtgatccacccgcctcggcctcccaaaatgttgggattacaggtgtgagccaccgtgtctggccgagccattctttagaactgggatttatacaaaacaagtcacacctcaactgggtggctgcagaccttggattgctcagggtaaacagagtctggttggggctgcctggctggcgtggggatcacccaacccatcaagcttcctctgggagcctgggaagagctctcttgccatggatggttctggaagctttttgaaggagggactttcttaatttctgatctcccttgggaatctggataaattccctttcacttctcccctgggcgtgtgtgtaccagggtgactcacagatctgacttggacctttttttgtgctttctgcattcctggcagcctgggcctgggatttgctctgccaccctgggtgacatgaagctctcagctctggcggctaaaaggctacactgttgtggggctgggacaccctgactcttctccccagtcattgttttctgtttctgtgtcatctcccccagctcggctcctcctgtgtcactgctggtcttccaagatggtggaagacactgtggtttgtctctttgcagtctcgctctgtcgccaaggctgtagtgcagtggcatgatcttggctctgcagcctctgcctcccaggttcaagcaattctcctgcctcagcctcctgagtaactgggactacaggcgcacaccaccatgcctggctagtttttgtatttttagtagagatggggtttcaccgtgttggccaggatggtctcgatctcctgacttcaagtgatccgcccactttggcctcccaaagtgctgggattacaggcttgagccaccgtgcccggctgtggtctgcctcttgtgcagtgagatccagcagggtgtcaaatgtgggtgtgcaggctgctgcatttctgacatttgtgcacctgtccaggagagaacactttgattggctgacactctctgtccaggaagcctgaacttccctctgggttcctgttcaggaaccccatggggttgccatttacctttttgcagattagagtttagaccaggagttagccagtagcccatgggccgaatctggcctgctgcctgtttttgtaaataaagttttattggaacacagccactcgcgttcatcacatagtgtctacaggtgtctggagctgcagcagtggagttgtgtagttgctacagagactgtagcacccacaaagtctaagatacctaccatctgaccctttacagaagaagtttgtccacccctggtctaagcatttctttagctctgatgactttttagcttccttttttgtcccctttccatttgcaggcattctttcttcctatgcaaggcaaggacgggaatcgacatttattagatgcttgcggtgtactggctagcactatgctaagttctttatatgcatgtctcacttgactctcacagcagtcctggtgaacttggtactatttttctcattttacagacaaacaatcgcagacataagtgccttgctcgacctgagtagtagagcagagattcgaactcacgactggctgttgtgcacaatcatgtcacttcgcttggttgtaactgctgaatgggagggtcttggctaaataatggctttgtgttaggctagaggcttcacgtggcagtatccaccttgtaacctcagtgcctaagacacagccaggcacacggtgggcctgtagtggtaatttattgttgtgttatatggggaggtgctcagtacatgtggcacgtatattatgtcttgcataagggtgaagtgtgcatgaggcctcacaggacatcagattaagctgcttctctgccttcatcctgttcaagtattaccagcaagaaagaggaaggggactgatgtatgcacagatgttctgaaggcttggcatggtgtcaagagccttatttttttttttaatgttgcattttggggggttaaatatatgtaacctaagatttgccattttaaccattttaagtatgcaattcagtgatgctaagtgcttttaaaaatcttgttcaaggccaggtgtggtggcttacacctataaacccagcactttgggaggccgaggcaggtagatcacctgagatcaggagtttgagaccagcctgaccaacatggtgaaatcccatctctactaaaaatacaaaaattagctgggcatggtgttgagcacctgtgatccctgctatttaggaggcagaggcaggagaattgcttgtgcccgggaggcggaggttgcagtgagctgagatcgctccagtctgggcaacagactgagaccctgtctcaaacaaacaacgaacaaatgaacaaacaaacaaacaaaataaccacataactacctagcaacgtagcctagcaattgagatgggggcaaggaagggtaggaaccaggtcctgtgagaatcagctagacttgtggctttgggctcggtgctcttcctttggggacgtcagcagccccttcttgaaaacgggttgcaactcgatttgttgttggcttcacctcctctctctgtcccagacctgagccctgtgatctggggaggaggacaacgggacaacctgtttgcttgttttcccatcactctcagggattgaatcacagtggagccaggaagatggggagagtccaggcttgctgctctcccatcctcagagcagcagcaggccatccatcacctgtcgcctgtcctcagagtgatcagccaaggcctggggcggctggggtcaggtcaggcagggcgtgggtgggagctggcagggctggctcctccaggccacttcgtgctgagtcactgagtcggccaatcctccccagctggccctgctcccactccatgactcagatgtctattccagccctggctgcttggtggggctcctcccatctgtccttctggctctggggctgccgaggcttttgggagcctgggcagggctgaccaagactgccagagctccggccggtccccagtctcctgccttttttctcattggcactgagtctgtggtttaggtttgggggaggagggtcttgtagataaggggatcaaggccaaaggagatcatttattaggtcccagctgaaagcagaggtccttggaccagttggaatgctcgacatcccccggaagcttgctagaaatgctgggtctcaggcctcatcccagacctaccaagtcaaactcattttaacaagatctccaggtggttcagggttgcaaatcactggtttggaacattcagtgaaagctactcagctcgtttgcagtaagaggtatttttagtcctgtctgtataatatgtaatattttccccccagcattttactatgaacattcttaaacctacagaaaagtcgaaagaattctactgtgagcagtcatatagttggtacctagagccacagttaacattttgctaaacttgctttgtcacatatctgtctgtctaaccagatagctaatcagccagccaaccggctacttttgttttgttttttgtttttgagatagggtctcactctgtctcgcagactagagtgcagtggtgtgatcatagctcactgcagcctccaactcctgggctccaatgatcttcccgcttctgcctcccaggtagcttgggccctacaggtgcacactactgtgtttggctaatttttaaattttttgtaggcgtgagggctccttatgttgcccagtctggtcttgaactcctggcctcaagccatcctcccacctcagcctcccaaaatactgggattacaggcctgagccactgaacctagtttttttgatatctgaaacttccttcgaaatatattagtattctttcatgcacccacttccaagtaaatcattagctagagtttaagatctgtttacacttctgagttttttgcttaaaatttacatacagtgaaattgctgatctcaagttagcatttgatgaatcttggtaaaggaatactttaaacccctgtcaagatatagaacactgcaaggacgccaggaagttccctcgtgccccttcatgatcagtctctgtccccacccaccaaggcctgatcttggaccgttgattaaagcgttgaaactccattttctttccatttctccgtcatgctttcagtcatttaataatcaggtgttgtgccaggggctgagctagaaagaaacagaccttgaccactgccctggaggagagatggaaggtgggtggcaggcagttgaaccaacaactgcaggatggacagtgggggctctgagggagggaagtgctgggagttgtgggggctgggagagtggtccctgactcagcctggggctccagggctagcatccagggaggagaggggatgctcaagtctaaggaatgcgaggctctggccaggtgaatatgtttggaggtggtggggtgggagggtgctcctggtagagcaactggcatgtgcaaaggtccagttgagggagcttgtgggtgttgggaatcacttggaattcggcttggctaggctgggtgcagtggctcatgcctgtaatcccagcactttgggaggccgaggcaggcagatcacctgagactaggagctcaagaccagcctggccaacgtggtaaaaccccgtctctactgatcataaaaaaattagctgggtgtggtggtgcatgcctgtaatcccagctactcgggaggctcaggcaggagaattgcttgaacccgggaggcggaggttgcagtgcgccgagatcgcgccactgtactccagtctgggcgacagagcaagactctgtctcaaaagaaagaaagaaaaaaagaattctgcttggctagattggaagggctaggatgtaagcgaaaagagaggcaagagtcagcatcagagatcaagggtgcaattatgtgtcacaataaggacttggaattttttgtttgtttgtttgttttgagatggagtttcactctgtcaccaaggttggagtgcggtggtgccatctcagctcaccgtgccctccacctccggggctcaagcgatcctcccacctcagcctcgcaagtagctgggaccatagttgcgtgccaccacgcccaagtaactttttctgtttttggtagagatggggtttctgtatgttactcaggctggtcttgaactcctgagctcaagtgatgccctgccttggcctcccaaaatgctaggattacagggatgggtgaaccaccacatccagccaggacttggaattttaaccctactgtggtgggagctgaggaaaggtttttcaccagtggaatgacacactcaggttggacaggttgtggaagatcctcaggctcaaaggaagaggatacattggacatgggggtgaggtcggtggcacttaaaaagcctttgcaggcacccaggcaggtagagagggaggctgagccaggatattcccctgtgcccactacagcatcaaaaaccagaaaaagggccaggtgcgtggctcacacctgtagtcttggcattttgggaggcttaggggggaagatttcttgagaccaatctggtcaacatagtgagaccccatctcttgaaacaaaaaaacaaagaaaacagacaagttgatgggcaaagggcatgggcaaagattctggggtgtgctccagtagaggaaacggaggtcctgggcagggaggcattttgcacagttggtaagcaacagggcaaacaaatcaccagtgtttacgttatactggcaaatctcttactgctggacatttaggctccgtctaataataaggataacagctgggtgcactgtattatttatttagtcctcacagtagggcaggatgatcagtctccccacttgacagatgaagacactgagggtcagagtggtgatgtgtcaggaaccctcccactgggttctcacgcttgaaacacagattgctggtccccacccacacagtttctgatgcagtaggtctgggtggggcccgagcatctgcggttcccaacaagttcccaggtgccaccgatgctggtgacagagctgcgtttgaggatcactgctctaaacattattgctgctgcacgcattgcctcctgctgggtgcaggggttgtggggggcactttggcagtgcagagcggaggtaaccagcagaaaacccgttagaactaaaagctgagagtgtttctgacaaacaggtcaacatgctgaaagacccagacaaggtccttaaactaccctgcgctccaagaatcagtgcctggggctgccgtacctaattggttcaaaccacagggtttctggccagctcatctggtaccaaacgtagatgtcaatatggtggatgccaaagaacacatcactctgtttggatgaatcaggcttttcctccctctgccttcagccaggacttctctgaattgttttcatttcaaatgaaagagggaccagttcacaagctgctttcatgctatctgggacaggagttactgtatttcagtgtctgaggctgggaaaccccctggaggtggctctgtcttttgtacctagtgtgtgatgtcaaaagattctccttggtttgggttaaatgacatgctccctggattacaatccagtgccccatgattttttttcctccttttttattgtcaatccttgacctacttcagaagttagttgtctttgttgtcaagtaaggccttccacgtcagatagaggctgtttccaggccgggtgcagtggctcatgcctgtaatcccagcactttgggaggccgaggtgggtggatcgcttgaggtcaggagtttgagaccagcctggccaacatgataaaacccccgtctgtactacaaatgcaaaaattagccaggcatggtggtgtgcaccatgtaatccccgctatgtggcaggatgaggcaggagaactgtttcaatttgggaagcggaggctgcagtgagctgagaacgcaccattgcgctgcagcctgggcgatgagagtgaaaccgtctcaaaaaaaaaaaaaaaaaaaaaaaggctatttcctttttttttttttttttttttttgccagtgaaggggggaccctgtgttggcctccctatcggtcacttgagataatctgaaaatctgtgtttagatccatagaagagaggcggcctgaggagaagaatttgacaaagctctttgagtgtgcaaattagaaatggcaattgctgggcgcggtgggtcatgcctgtaatcccagcgctttgtgaggccgagataggcggatcagttgaggtcaggagttcgagaccagcctagccaacatggtgaaaccccatctctatcaaaaaatccaaaaattagccaggtgtggtggcagatgcctataatcccagctactcaggaggctgaggcaggagaattgcttgaacctgggaggtggaggttgcagtgagccgagatcgggccactgcactccagcctgggcgacagagtgagactcagtctcaaaacacaaaaaacaaaaaactgtgcagtgttctgtctgtcaatgtccttgttgcatttgcagggcaggttttctaccagtggctggggacttagttttactgggccgagggaaggttaggatttgagggtcttgttaagctggatatgggctgcatttcaagcctcccctggctgtctctatcctgcgtgttgatgccaaggctgaagaagactggatttgcaggcaaaagactgtcatttgaggcctgttttcaccccttaatcactgtgtcttggtatgttgtgggggttgaggtaggcagaggttagccaaccttttctggaaagggctggctgataaatacttgaggctttgcatcccatacactgtctgtggcaacccctaactccgctgtgtagctcaaaagctgccatactcatttataatacataaatgaatgggtgtgactgttccaatgaaactttatttataaatagctggtctgtgggccatagatgcttctgatatataaagcatctggtatagtggtgtattgtgaacccactggggttttttcccccccaaacacttgagctttattgatgtatattgacaaataaaaatggtatataggttgggcacggtggttcatgcctataatcccaggactttgggaggccgaggcaggtggatcacttgagctcaggagttcgagactagctcaaggaatagagtgaaattctgtctctacaaaaaatacaaaaattagctgggtgttgtggtgtgcgtctgtagtcccagctacctggggggctgaggtgggaggatcacttgaacctgggaggtcgaggctgcaaagagctatgattacactaccgtgctccagcctgggtgacagagcgagaccctgtctcgaaaatatatttaaggtgtacagttttatgtttccatataccagaggctactgtcactgcttctattattattactactactactactcatgttaccctttctttggctgttactttgtgccaggtactattctaagtacttaccatgtttgatctcatttaatcttcaccaccaaggaactgacccaaggtcccacagctaggaaatggcaagctgggattgagccgtgccagctagccccgtgctatgcactgcttcacacagaagctgcccctccacccctgccgccttccttttcctttgttcctttgttatcagctggccgtttccagaaacggttggttaacctctgcctacctcaaccctcagtgattaaggggtgatatcgggcctcaaatgactgacctttttcctttgttgcagctctcactgattgtaattctgattgtaattatatatttgtttgcaccgtggtttacttactgtccatcttccccagggcaggaggctgaatggggcaggggtctcgctgtctcgtttgcagctccgtccgcggcacttcacccacatcctggcctataagcaagtcctgcccatatatttgaccaataaataaatgaatcattgacagccgtgccccaccccttcctcctctctctgccagccagcaccttggtctttcacagtgggtagagggcttgggctgcaggtgaaatggatttgcaattccctgataacccacccgccgactgtgggagtgggcaggaaggtgtcagctcttccggatgaaaaaccagcctgcaatgcagtgtttctacccagcctacaaagcaaacaccactacctccacgccttaggttggagaaattccgctttacgacacagtcccatgggcctcatgtcatttgtccctcctggcagtcccgggggataggtcgagcaagcagtaggacaaacgactcccattttccaggtgtaaaaactgaggcttggaggtgaagggacttgcccaaggtcatcagctagaatatagcagggctgggattagaacccaggtctgtccgggtccacggtctgatctgaactcggcttcagttggtctggaatgcaccggctgcatctgatgatcttattaaagatctgtggctgtcagggtcctccccctggaggtgctgatttagttggtctgggttggggccctaggcacttggcacttaacaaactccttaggtgattccagtggacaggcagggctgggaacttcatcacccctccgagccccagagcggagcctgatccttagccctggctgtgtatttgaatcactggaggagctttttatttagccttttatgatggaaacataaagtagacagcctaggataatgaactaccatgagctctttttcttttctttttatttatttttgagacagggtctcactattacccaggctggagtgcgatggcacaatctcagcttgctgcaacctctgcctcccgggttcaagccattctcgtgcctcagcctcttgagtagctgggactacaggcacgtgccaccatgtccggccaatttttatattttttgtagagacagggtcttgccatgttgcccagactggtctcgaactcctgaactcaaagcagttctcccgcctcagcctcccaaagtgttggggttacaagtgtgagccactgcgcccagctgccatgagctctttaccatgcattgcataggtgaacgttttaatatgtatctctgaaggacatggatttgtttattttaaatgactttttatttcgcaatagtttggctcacaaaaagttgcaaaaataacagagttcctgttgttcattgctcaactttctctaatgataacatctgaaagataagaattttaaaaactgtaactgttgggctgcatgtgatggctcatgcctgtaattccagcactttgggaagctgaggcaggaggatcacttaagcccaggagtttgagaccagcctgatcaatataggtagaccttgtcttgacaaaaaacatgtatatgtgactgtaatactaactttaataataattcattattatcaaatattccagtaatccattgtgtttgtacaatggctcattcttctatgatatcattctttatgttttagctgggatttttttatggaaaagagtttccccttcatttctttgatcactgatcactctgtggtgatcgaataaatgactgttttcctcagggaagccttctccaaccctggtgaaccaaatgagtacatttgggaaaggtggagaaaatacttgtttctttccgctttttctgcgttcaaacaatgacctggttcactgacaacatcagatgtttctctttatttccagcgtcaatatgaaatttgtgtacataaacatgtaaggctgggcgcagtggctcaagcctgtaatcccaccactttgggaagccacggtgggcagatcacttgagtcaggagttcgagaccagcctgttcaccaacatggtgaaaccccatctctactaaagatacaaacattagcccagtgtggtggctgatgcttgtaatcccagctacttaggaggccgaggcgggaggatcacttgaacccaggaggcggagtttgcagtgagccaagatcacgccactggactccagcctgggcgacagagcaagactccatctcaaaaaacaaaacaaaacaaaaaccttgcttggtatgtttcagcctgttgtacttattctccttgtcaaagctcaaattgtccctcttttagcctgcagcggccacttctgcttggctcttgagccttttaacaatcctgttcatgcttagtttccttgttgtccggtgtgacaagatgttcttggcttaccttgcatatttcctgcccagccacttttccaagaaaaatctggaagtttaaaacaaaaacaaagcttcagtgccccagtcgcacccagaaccagcttaatcagattgcctggtgcgggtagggcccggatacagtatttttttaaattttatttttattttgtttgagacagggtccctaggctggagtgtagtggcacgatctcagcttactgcaacctccgcctcatggattcaagcaattctgcctcagcctcccgagtagctgagcttgcaggcacccaccaccacatccagctaattttttgtatttttggtagagacgaggtttcatcatgttgcctaggctggtctcgaactcctgaccacaagtgatctgcccgccttggcctcccaaagtactgggattacaggcatgagccaccacacccagccaggatacagtattttttaaaaagcacgcccagccttgaatggaaaaccactggacgagagtatgccaccttatcgggctctgtaaatgccttatatctgcacaaggctggaactttgagtggagtccttggctaaagctttcattactgcctggtgacctctcttccctctgctgctaaagcttgtgtttcagaatttagacccggatgcatccatgttgaaagccaggctttgtctgtcatcccaggagctctgtatcggtccctttccttgcctgcatgttgttgacttggggctcatcttcatttctctgggaaatgagttctttgatagcttgcttagaatctctcagtacttcccattgcccttagaatgaagaccaaaatatgtggcctgcagtgtagactgtgcacagcctccagtgtagactactcaggccccttcttggttcctggagtctaccatgctttcttctaccaccgggcctttgcacacactgctgtctgttgggaatgcgttgcctttccttgttacttagttctcatctactcacccttcaggtgccagcttgactgtctgcctcgggggcgccttctctgaccttcgtacaccagatcagcccccatgcacttactttgtctcattggtaatatttctctcccttcaggacacacatcaaggcccagaagttgtagttttgcatttgttcatgtgatcatttgatgcatgtctctctctggagcctgactctttggggctcacatcctcactccaccgcttttagctgtgggaccttgaacaaatcttttcatctctggtccccagtttttaagttaaattaaattttattttatttttattttgagacactcttgctctgttgccaggctgtagtgcagtcgttcgatcatggctcactgcaacctccgcctcctgggttcaagcgattctcttgcctcagcctcccaagtagctggaactacaggcgcctgccaccacatccagctaatttttgtatttttaggagagacagggtttcaccatgttggctaggatggtctcgatctcttgacctcatgatctgcctgcctcggtctccgaaagtgctgggattacaggcccagtttcttttaactgcaaaacagggatgatataatacttttatttatcttgtgaggtgaggatgaagattaaataaggtagtttgtgtaaagcacttagaaaagagctagctactaatagtagagaatcttggcaggtattactgatgattactgcagtagaccacaagctccatacaggcaggggtcatttctgtttgtttagatttgtatgcagggtgcttggcacaagggttgtgctcaggaaatacttgttggatgaacgaatgaatgaagtggagataatagtaataccatgtttatagaattccatgaggatataaaataatgcaagtatataagctcttggtagagtgtctagcacatagtagatggtcaataaatattcagtgactgaatgagtaaagtggggacaatagtaatacccgctcatgaggttgtcgtggggatataaggcaaccctgtagtaccttgtagaatgcctagcacatagtaggtgctcagaaaatatttgttgaatgaatgagtgaagtagggatgacgttaacaccaactcctagggttgttgtggggatagaagacaaggcaggtctatagcatgttgtattgtggttgcacatggtagacactccgttgattgaaactggaagagctgccatgaatttctttctcctggctattaggagagggtccttttggggtgcagaatggtgtggagctgacgctagtcctctggaaggaagagtgagcagctgactacttgctaagctctgacctggatgaaaagtcaaatcattcctttccctcttcctcccaaacctgtgctttctttccactagaatccctgcccagagtccagcgcttccttcctgtcgaggatcaccttctggtggatcacagggtaaggccaggccccccagacctcagggaggtggtggggagtgaatgaatgaatgaatgaacgaatgaacatgctcagctccccctccccaacttctccctcctttgctcttctgcagagttgtcttgaatctgcctgtgctggccatgtggtctcagagacaccaactctgtccggcagttccgtgaacttgaatgtgataaacacgtgagccgtgagcagctgacacctctgcagaaggctttgcctgggacagccatatgctggactgcttttgctttagcttcagatttgggtttttaaaatattaggtatagttattattgacattgtccccctcctgtcccccacgccttagaaaaataatactgtctcaccacaggaagtgtgggttaaaaaaccacatgtgcagatcagcagtgcaggagacatctagaggtaaccagtgtcaccattttagtatgccttcttctggtcgtctttcttttttttttgagacggagtcttactctgtcagtctcagctcactacaagtctccgcctcccaggttcaagcgattctcctgcctcagcctcccaggtagctgggattacaggcttgcgccaccatgcccggctactttttgtatttttagtagagacagagttttgccatgttggccaggcttgtcttgaaactcctgacctcaggtgatccacccgcatcgacttcccaaagtgctgggattacaggtgtgagccaccatgcccagctaccttctggtcctctttttgtatatctttttctgcccgttgttaacatcttagtggggattgtttgaagaatctttttttgcccctaataagcatcatcttttttttttttttttttttttgagacaggctttcgctctgtcgctgaggctggagtgcagcggcacacttgtagctcactgcagtcccaatctactgggcttaggtgatgctcctgcctcagcctcctgagtagctggggctacaggcacactcccccatgcccagcagatttttgtactttctgtagagatggggtttcatcatgttgcccaggctggtctccagcttctgagctcaagtgattctcccgcctcagcctccagagtgctgggattacaggcgtgaaccaccatgcccggtctcatccttgtcttaatgacaaacatcgttttaaaaaattagatgttttaaataatttcttcaagttactattaaaaagcatcactgggacagttgatgtaatttgttcatgactacaggaccccggatgcatgctaataacattcattcttgttttggaaaattgtgctctagttacataagagcatgtcctggattggaagagaatacctccagtttttcttgggtaaaggcatgtagaggctgtatgttaactttttttttttttttttttttttttgagatggagtcttgctctgtcatccagggtgcagtgcagtggcaggacctcagctctctgcaacctctgcttcctgggttcaagagattctcctgtctcagcctcctgagtagctgggattacagggacctgccaccacatccagctaatttttgtatttttagtagagatggagtttcactgtgttgtccaggctggtctcaaactcctgacttcaggtgatccacccacgtcagcctcccaaggtgctgagattacaggtgtgagccaccatgccagccctttaactgtttaagtggttcagaaaaagatgatgtgtttgcatgtgtgtgtgtgtttgtgtgtgcatgtcaatggatacagacagagaatgatactgcaaacgtggcaacgtgttaacaatggtgagttgagtgaattcttagtatgatttgagtaatttttctataagtttgaaattattttagaacaaaacatgaaagtattttaccttttattataaaagtgtttagtctgctgggcacggtggctcatgcctgtaatgttagcactttcagaggccaaggtgggtggatcacctgaggtcaggagttcgagaccagcctggcctacatggtgaaaccctgtctccactaacaatacaaaaattagccgggcagcacacgcctgtaatcccagctacttgggagggtgaggcaggagaattgctagaatacaggaggcagaggttgcagtgcactgagatggcgccattacactccagcctggatggagtgacatagaaagattaatataataaaactcaataatctcatcacccagatttcatgcttactaatgctttgtcatgtcagcctttttattttttaattttttccttcagcctatttttttttttttctttttatagggtctgactctgttgcccaggctggagtgcagtgacacaatgacggctctttgcagcctccacctcctggccttgagcaatcctgccacctcagcctcccgagtagctgggactacaggtgcgagccatcatgactggctaatttttttatttttacttttcgtagagatagtctccctatgttgtccaggctggtcttgaactccagggctcacaaaatcctcccacctcggcctcccagagcgctaggattatagacatgagctaccgtgcctggcccatatcagccttttttaatttaaaattttaaaaagttggcggggcacggtggcttatgcctataattccaagacttcgggaggccaaggtgggagggttgcttgagcccgggggttcaagaccagcttgggcaacatagggagactcttgtctctacaaaaataaaaaataaaaaaaaaattagccagtcataatggcttacacccaaagtcccagctactcgggaggttgagatgggagaaccactctagaccgggagctggaggctgcagggagctgcgatcgcaccactgtactccatcctgggtgacacagcgagaccctctctccaagtaaataaatgaatgaacgaataataaaaaataaaaaagagctatcctgatacttcgctcctaaatcatctttttttccctaagtcttttgtatgcaccactaaaaaaaaaaaaagccatttttcctgcatgacccaacagaatgagctgtaattagcttgtaatatatgcaaatgtccatctgcattctgacttcccaagctgcatggctgccttcatttgcagcgggcagctgtgctgcagaggggagcagcatcagcaggcgtgtggagtgagtgagccccgtcctccccctcctcctgtcattgactctcattgcctaacccccttgtgtcttggccccaggttgattgtccggggctaccgccagcccctggagggcagtgacctctggtccttaaacaaggaggacacgtcggaacaagtcgtgcctgttttggtaaagaactggaagaaggaatgcgccaagactaggaagtaagtgtgagtttccttgtcctccaggatgccctggtcacctcctttccactcctgtggcctcaatccaggatggggccctggcagtgctgcctgttactagctttgtggttctgggcaagatgcctcacttctcctcctggcctcagtttgcttttctgccaaatggggtaggatctcacatgtcattaaagcaactgggcagagaaaagaagaaagaagctgggtgcggtggctctcgtgtctaatcccagcactttgggaggccaaggcaggcggatcacttggtcgggagtttgagaccagcctggccaacatggtgaaaccctgtctctactaaaaatacaaaaattagctaggcatggtggcaggcgcctgtaatcatagctactcaggaggctgacaggagaatcacttgaacccaggaggcggaggttgcagtgagctgagattgtgccactgcatactagcctgggagacagagtgagactccgtctcaaaaaaaaaaaaagaagaaaaatgttgtccaaacaggcagttgatgctgtctgccatggcgcgtgactatccctccttgagtcagtctcacttttttctgtctctttctgagcatctggcatcctgcatgttcttgctgtttgaatgttctgtccaacatgcccagctgaccacgtaagtctgtttagccaaagaagccccatttgagggtgattttggctgtactggattttaggctctaccccctatgtaaggcgtgccccactgcaccacctctgtcactcttcgggaatcaggccagtgcctcccctgcacataccttaactcatcaaatctgagacaccattagttgcgtgatgcgttattattctatgtaacagtaagaaagaaaagcagctgccaattaaacaaggacataagacttgtctcgagcccggacgaactggaacatgaaattgtgggtgacatgggggcagtggattgcggccatgggggtagtagaatggctgtttttgttcctgttgcctgttctggggtaagtttactacgataaactgtggtggggccagtgtggtgcattggattccccacagacccattggccttacagggaaaaaccccagaccggggttctgttcctcattctattccggggatgcccaggatacaggccttcagtcagacccagatggtgggtgggaatctggacatccatgtgccagccactaggacatcagcagaggacctcgtgactccggtcggaggctgtttgggtggtccaggtgatgggagaaattgtctcgtgggaggcagatagagcttgggcctctgtgactgagcattgtaaggaaatggcccatgtccatgacccagttgaaggtttttggcaggcaaaggtggggtccctgtttattacagttcttcatggagacagaactagtaggatggatggatggatggatagatgatagatagatggatgatagattgatagatgataggtagatgatagacggatagttggtggatgtatacatggtaggtagatggatagatgatagatagatggatgattgatagatgatggatggatggatggatggaggatgagaggggatctactagggaaactggatcatgtgattatggaggctgagaagtcccaccctaggtcatctgcaacctggagaacccaggaagctggtagcatggctcaggcctagtccaaaagtctcagacccagggaagctgatggtggaattctcagtccatagtcaaaggcctgagaacctggagtcattgggtaagtcccagaggccagaaatcctggagttctgatgttcaagggtgggagaggatgacatcctggctgcagaagagagagtgcctgcatttgccattactctgactttttgttgtgtccggaccctctgctgattgggcggtgccacccacatggggcgaggatggatcttccttagtcagtccactcattcaaatgccagtctcgtctggaaacatcctcacagacacacccagaaataacactttaacagcaatctgggtatcccttaacccagtcaacttgacccctaacatcacccatctcatctggattccttcagcctcacctgcagcatcccccccgctaagcaggccacatttgtagtgtgggcttcagcattcctcatcatccacgcctctgctgatcacctggctcggcttcctctcatggaagacggatgcccacctttgtgtcccctggagcttgtcaggagagcaggttgctggagacaccatgggagaggccaatatcacagccttgggaggaggacagagtttgaatccagaagctcctccactggcctggctcttaatccactgagcagatgaaactgactgctgcttttgtgcttagcgacgtttagtccctgagggttcagagagtggaacaaaagagacacactctagttgggtgccatcgacattctatatgggagacaggacgttggttgtgaaacatgcattgacaagaagctttggagaatgatggtgttggggtgagataaaaatgaggaaatgagggtgagagtaaccgaggaagcttttgtgtgtgtgtgtgtgtgtgtgtgtatgtatgtgtgtgtgtgtgtgtgtgtgttttctttttttttttttttttttgagatggagtctcattctgttacccagggtggaatacagtagtgtgatctcggctcactgcaacctctgcctctcgggttcaagcaattcttctgccccggtctcccaaagtgctgggattacaggtgcatgccaccacgcctgactaattttttgtatttttagtagagacggggtttcaccatgttggccaggctggtcttaaacttctaatctcaagtgatcctcctgccttggcctcccaaagtgctgggattacaggcatgagctactgtgtccggctgagagaggtgttttagatacagtggtcaaaggttctacccagtgtggccatgacccttggtgagcatgtgcctgtccctccctaagtctatctctggctgttttcgagcctctggcatcctgagtgttactgctttttgaagtgtttttgttcaacatgcccagctgaccatgtatgattgttttgagaaggtcacatttgagcagagacttgcattggagggagtgagccttgtgtgtatctggggaaggaagggctttccaggtagagggagcagccagtgcaaaggctctgaggacactcgtggtgcatcagggggcttgtgtggcttgaggaaagtgagtgagggggagaaagggaggagatgaagcaggagaaggatttgcaggggtctcctctgagagttaaggtgggattccaggtgcagtgagaacacaggcgcaggttttctgcagggcagtggtgtgacgtgagttctgttgtttgtttgtttgtttgtatgtatgtatgtatgtatgtatgtatgtatgtatgtatgtattttagagacagggtcttgctctgttgctcaggctggatggcagtggcatgataacagctcattgcagcctggaaattccgggctcaagcagtcctcccacctcatcctcccagagtagctgggattacaggtgcacaccaccatgcctggctgatgaattaattaattaattttatattttatatttgtttttttgagatggaattttgctcttgttgcttaggctggagtgcagtggtgctgtcttggctcactgcaacctccaccccccgggttcaagcgattttcctgcctcagcctccggagtagctgggattacaggaatgtaccaccatgcccggctaattgtgtatttttagtagagatggggtttctccatgttggtcagtctagtgtcaaactcctgacatcaggtgatctgcctgcctcggcctcccaaagtgctgggattacaggtgtgagccactgcgcctggcctttttaaatttattttattttattattattatactttaagttttagggtacatgtgcacaatgtgcaggttagttacatatgtatagagacaggtctcactgtgttgcccaggctggtctccaagtcttggcttcaagcagtcctcctgcctcagcctcccaaatagctgggattacaggtgtgagccaccacacccagctgagttctggttcataacaacccaggctgtcctggggaaggtggatatttagggacaagagtgaaggcagggagaccagggtgggaacctcaagggctgtccatgaagtcccttcatgcctcaccgggagccgccattgtatttatttatttattttttgagacagggtgtcactcttttgtccaggctggagtgcagtggcacgatctcggctcactgcaacctccatctcctaggctggagtgatcctcccacctcagcttccctagtagctgggactacaggcacgtgccaccacacctggctaattttttttttttttttttgtagagatgatatctcgccatgttgcccaggctgttctcaagctcctgagctcaagcagtccacctaccttggtctcccaaagtgctggtattacaggcgtgagccactgtgcctgactggagcctccatttttcacccagagcattttctgagaattcagtgagatatatgatatgataagctgtgccctagccctgagtacatgctgggcaggttttaattgtacaagttttatttattcatctgtacactttgatcttgccagggaggatgtggtgagaactgggtcttggggcttgaaagcgggccacctgagaagggtctggctctgtgagtaccttggtgtttagagatcctcagcgtggagccaggggatcatttacttgggacattggtagacggatcgcttgctttattcccagaggcataagccagatctggcacctgtaacccctgtgaacctggagagagtgagaaggaaaaccctgtcctaggctggaatttcctggtgtggccccttacactcagatcccttttgttaaccagagaaaggaatgcagctcgtgcagctctgggctgctgggtatcctaggctcggggatcaggtgatggacgccagggctgggggctctgcatggcttcctggatccttttaccacctctcttcacccatgagtgactccttctcaaaagtcaggtgtggctgggcatggtggctcatgcctgtaattgcagtacgttgggaggctgaggcgggaggctcacctgagttcatgagttcgagaccagcctggccaacatggtgaatccctgtctctgctaaaaatacaaaaattagccgggtgtggtggcgctcacctgtaatccagctacaggggggctgaagcatgagaattgcttgaattgtttggatttaaaaacccagtgcttcattggtttgtgtgtagtggttttatgttctcttttgtgtatggccactcagagcttagggccattttggactgtggtttctgctggcatgaatgtgaaatgcttctgtgactctggaagagtttggcagttttttttttttttttttttaagttagacacagtgaacataccaccagtcacccccttcccaggcatccagccaacagagctgagaacatatgttcataaaaggctggtacaggaatgttcttagctactttgtgataacccaaactggaggtaagccagacatctattagcaagtgaacagacagatgcaccagttatgtacatctgcacaactgaatactaagtgatgtacaagaacgaactattggccgggcacagtggctcatgcccataatctcagcactttgggggcccaaggcaggcagatcacttgaggtcaggagttcaagaccagcttggctaacatggtgaaaccctgtctctactaaaaacataaaaattagctgggtgtggtagcgcacacctgtaatcccagctactcgggaggctgaggcaggagaatcgcttgaacgcaggaggcggaggttgcagggagtcaggatcgcaccattgcactccagcctgtgtgatagagcaagactccatctcaaaaaaaaaaaaaaaaatccctataagataaagactacttttttggtgacagctttattgagatattcatacaccgcacaattcatgtatgcagaacatacaattcactgatttttagtgtgttcacagagttgtgcagtcatcatcacagtcaattttatttatttgctttttaagacagagtcttgctgtggcgctgaggctggagtgcagtggcacaacctcggctcattgcaaccccctcctcctcctgagttcaagcgattctcctttctcaccctcccaagtagctgggattacaggcaaccgccaccatgcctggctaattttttatatttttagtagagacaaggttttgccatgttggtcagggtgttctcaaactcctgacctcaagtgatccacccgcctcgacctcccgaagtgctggcattacaggcatgaaccactgcacccagtcaaaaaaaaaatttttttttagaaatagggtcttgctgtgttgctctggctggctggactgtttttttttttttttttttttccactgatgtatatatgcctatccctttacctgtcttgatgattgttgttcttttttttgttttgtttttttctttttgagactgagtctttttgcccaggctggagtgcaatggtgtggtctcagctcaccacaacctccgcctcctgggtttaagcgattctcctgcctcagcctcccaagtagctgggattataggtatgtgccaccatgccgggctgattttgtatttttagtagagatgaggtttctccatgtttggtcaggctggtcttgaacctgccgacctcaggtgatctgcccacctcggcctcccatagtgctgggattacaggcgtgagccactgcgcccagcctattgttgttctttctttttgagatggagttttgctctgtcacccaggctggagtgcaatggcctgatctccactcacagcaacctccacctcccaggttcaagtaattctcctgcctcagcctcccaagtagctgggattacaggcacctgccatcatgcccggctaatttttgtatttttagtagagatggggtttcactatgttggtcaggctggtctcaaactcctgaccccaagtgatccagccaccttggcctcccaaagtgctgggattacaggtgtgaaccaccactcctggccatgattgttattttgtattgttttgaaatcaggaagtgtgaatcctccaacttgattcttatttttcatgattgttttgactgttctggatccttgagtttccatgtgaattttaaagttagctcataatttctacctggcagccagctgggcttttgatggggattgccttgactctagatcagtttggagccatcagttttctaagtctttaacttattcaactcgtttaatcttacctaccttggaggtaggtcctacttttatcctcatttcacagaggaggaaactgaggcccagagagcttaaggaccttgtctgaagtcacgcagctggccagtggccaagccagaccttgagccggtggctctggagcccgtggctctggagcccgtgtttgtaaccactgtgctgagctgcctctttccctgggcttgttgtctttgactctgccttccctgaagggtgacattccctggccatgtccctgtggtagggggctgcatctctggcagaccccacaacggcttcacctccttgtgttccaggcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagtaagaccccttccctcccaggtgggctccattttccctccttggctttgatctttcagttgcatcagtcataaccctggggtcatgctgtgtcctgaagtgggctcatagccagatgtctccatttttactttagcttttttgaaaaaaatagagacagggtcttgctttgttggtcaggctggtctcgagctcctgacttcaagcgatcctcctgcctcggcctcccaaagtgctgggattgcagatgtgagccatggtcactgcctagctttactttatgctttacttaattaccatattagtgaagaccacatcgtttgcaagtaacagaaacccactaggctcccctaaaacccaaatggggaggatatggcattgtcttgggaaaccaagagcaaggaaatgccagcagatctcatgaaaaaactgcaaccagggttgggcgcagtggctcatgcctataatcccagcactttgagaggctgaggtgggaagatcacctgaggtcaggaggtcaagaccagcctggccagcatggtaaaaccatctgctaaaaatacaaaaattagccgggcgtggtggtgcacgcctgtaatcccagctactcaggaggctgaggcataaaaattgcttgaacccaggaggcagaggttacagcaagctgattgcatcactgaactcaaaccttggcgacagagcaagactttgtctcaaaaaaaaaaaaaaaaaaaaaaagaataaaaacaacaacaaaaaactgcaaccaggaactggggagtcagaaaggaagttgcctctctcctacctggctctctgctgctctgtgactcaggggctacacatcccttctcttttcctccctacctctttacctcgtgttccctatgcaattcctttgggtgacttgctggtgatgagatatagctagagcaattagtgcacaaccccaaggcagaggcctcttttatgagcagtttgggtcacctgcacagccagatcaccactgtggacttgtttttccatctatgaaattgaagtgatagtgtctagctcatctggctcaggagaaagttgcagtgccaacactgaagctctcttccctgcccccacgtgtcacaagtcattccaggccctctctttgctcctttgcaggttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggtaggggacgctgtgccattggcatgtggcccgacttccacatcccctcctgcagccctgggttactctggggccagcgtggggatttccagcccagcttctggagcagtaggatgagggtagcttccgtgaccttaggtggcagggacagcacgcatcaggcattgtacgttaggaaagctgatttcaagggtgggcgtgtagatgtctttgtgtatcagctgtgagtaattgagtttcttagatggatcagtggcccttgttgtggggaaatccaagtttggatcctcattctgctgttaacattctgtgtttcagcttgttgtcactctttttttttcgtttttttgagaccaggtctcactctctcccccagactggagtgcagtggcatgatattggctcactgcaacttctgcctcctgagttcaagcgattcttctgcctcagcctcctgagtagcggggactacaggcgcctgccaccacgaccggctaatttttgtatttttagtagagacagggtttcgccatgttggccaggctgatcttgaactgctgacctcaggtgatccgcctgcctcagcctcccaaagtgctgggattacaggcatgagccaccgcgcccagcctgttgtcactcttaatttgaactgagcaggtggcacattccttgcatggtaagagtatgtagcaggcatttgtgtacatccaatttcaaaggacctaaattaccttcttgatccctataaatttttttttttttttgtctcgaggtcaaggaaactgcttggctcctaggttaggaagagacagtcttgcaggtacttgatgaactagaggagtgattctcaggcctgtctgtgaattagactcacctggggagcttaaactgatgcaggccaggcactgtagctcatgcctgtaatcccagcagcttgggagaccaaggtgggggaatcactggaggcttggaagttcaataccagcctggtcaatatagcaagaccctggctctgcagaaaatttaaaaaaattagccaggtatggtggtgcgtacctgtagtcccgtctactcaggagattgagttaaaagaatcacttcagccccggagttggaggctgcagtgagtcctgatagcatccctgcattccggcctgtgtgacagaatgagaccctgtctgaaaaaacaaaaaaacttcctgacacctaggttgcaccagaccagtgaaattgcgattgctgtggtggcacccaggtgtcattgtttttgttttttatttatttttatgttttgagacagggtctcgctctgtcacccaggctagagtgcagtggcatgatcttggctcactgcagcctccacctcctgggctcaaacgatcctgccacctcagcccaccacgtagctgggcccagaggcatgcatcaccacgcctgctaatgtcttagtgtttttaaaactcacgaggtgatagtgtgcaatcatgtttgagggctagggacattttcccccaccagggcacgtttggcaatatctgggggcattttcggttgtcccaactgggggcgagggcatgtagtgggtcgaggccaggtattgctgctaaaactcctacagtgcgcaggacagccccccaaagaattatctggctccagatgtcaagaatgccaaggattagagaccctggcccacaccctcagtccttcagtgggatctgggaccagtagcactgacacagcctggaagcgtagaaatgcagaatcccaggccacaccccagacttgcagaatccaaaacaactccccccaccccccaccactccccccagaaaaacccggccgcatgtgtgcacattaaagcatgcgaagccctggtttcgaggacacctagggtcccttgccaactgatgagttcaaggttgggaggcactgagcaccgcggataagaatgtgggctttgagatgacacaggcgtcctgggcagacagataggtcgggaggggaggaggagagatctgcggcatttctgcccctgagagtctccttcctctccgtgggtctggagggagagtcaggcctcttcagctgccacactcacccaccttccctctcctttgtcccacaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctggtgtgtgtttaacgccgtttccctttgcatgcagggagggacttctacgtgtgggcagtgggccgagggagtgggtgttgatggtaatggcatgtagagctccctggcagttccggctgtggttcatattttattttccagcctgttaaccaattcctcagtattttgttcctttcctgaattgtcaggttgatgttctccttggtggcatggcgttttcattttctcttttccttgacagtgtcagtaattaactaccctacaatggacgacacatcatatttctccccttgaatcctcccaaacgctaaccagactcacttattcattagtccctaattatggtggtcaaaattctctcaattgcaagggatataaatctgtcttaaagtagcctaagtggccggttgcagaggctcacgcctgtaatcccagcactttgggaggccgaggcgggcagatcacctgagatcaggagttcgagaccagcctcaacgtggagaaaccccgtctctactaaaaatacaaaatgagctgggcgtggtggtgtatgcctgtaatgccagctacctgggaggctgagacaggagaattgcttgaacctggaaggcggaggttgcggtgagccgagattgggccattgcactccagcctgggcaacaagagtgaaactccaattccaaaaaaaaaaaaaagtagcctaagtaaatagagggaactttggggctgcatgtatctcagaaatctggggactagcttcaggtgtggattgatccaggagatcaagcaatgttgtcagtactcagtttcacccactgccctgttgtcctctgagttaacatcattctcagtggtacttccctacatggctccgtagctttgggctgataacatcctgatagataaaggtgccagagaaaagacaaggcagcatttctctgcacagccagagtcagtctcagagagcactctgattagcctggcttggtcctattcacacccgtgaaccaatcactgtggcccaggaggcagagttctctcattggccagcctgggtcacatgtcctctcccatggcagaagagatgtgattgacagcccttccatgtggagagggagagttcccaaaataaaatgataagcaaagaggctcatagcacaacacatgccttgtgctttgctacctctggatctttgccacgtacctttccttccttcttcctaattgatgaaagcctgctcatcccccaaggctgtaacaaacactacttccattgatttaccctcccttctcaattagatggacttcttcttttgaattttgagtcccaataactttagtataggaactcatctaataatactttctgaaatagttttttttgttttgtttttgttttgacatggagtcgcgctctgttgcccaggctggagtgtggtgtgccatcttggctcgctgcaacctctgcctcccagcttcaagcaattctcctacctcagtctcccgagtagctgggactacaggcttacaccaccacgcccattaaattttcttttttttttgtatttttagtagagacagtgtttgatcatgttggctaggctgatcttgaactcctggcctcaggtgatctaccctctgtggtctcccaaagtgttggaattacaggcgtgagccaccgtgcccagcccactccctgaaatagttttgttttgttttttttgcatgctcagtgtactgcctcctctttgaagggtaacatgttagctacttgcagacatatagcagctgacttttgtgtcttctgtgggtacaaccccagcagggcctgatgcataatgggcacagctcaaattattatctgttattgaaagagaagggctggacgaaatggctcatgcttgtgatctgaacactttgggaggccaaggcgggtggatcatctgaggccaggagagcagcctggccaacatggcaaaaccccgtctctactaaaaatataaacattagtcaggcatggtggtgtatgcctataatctcaactacttgggtggctgaggcaggagaatggcctgaatccgggaggcggaggttgtattgagctgagtttgtaccactgcataccagcttgggcaacagagcgagactctgtctcaaaaaaaagaaaaaggaagaagaaaaaattactggtttatttggctgtagtttggtttttttttgtacatttgtagagcagaaggtgagtaaagtgtttctaataataaaactcagaaaaaacaccagaatttaattgtctaataggctgggtacagatataggtggcatgcgcctgtaatccctgcactttgggaggctgaggtggaaggattgcttgaagccaggagtttgagaccagcctgggcaacatagtgagaccctgtctctacaaaaaaaaaaaaaaaaaaaaaaaattagctgggcatggtggtgcctacctgtggtcccagctaccgtggaggctgaggcaggaggattgcttgagcctaggagtgcagaggctgcagtaagctaggatcacaccactgcactcctacctgggtgacaaggcaagaccctgtctctagaagaaaaaaaaaatctaaataaagtgtcttttcaagcaggtgtcttggggagtccacttttgtaaaagtgctactatgggaaaaatatttttggaacatttgttctagaactgccttcaggattggtttatgaaccgttaagaaaattgtctaacatcacgttttgttttagatggtagttgcttgagctcagcactgttgacacttggggccagacagttctttgttgtgggggctgtcttttttttttgttcttgttattgttttttttgtttttttaagggacagagtcttgctctgttgcccaggctggagtgcagtggtgcgatcatagctcactgcagccttgaattcttggcctcaagcagtcttcccactttgtcatctcatctagctggggactacaggtgcacgccaccatgcctggctaagttatttatttttttgtagaaatgggggtcttgctgtgttgcccaggctggtctcgaacttctaccctcaagctatcttaccactttggcctcccaaagtgatgggattacaggtgtcagtcactgcacctggccacaaggctataagttaatacagcaaaattagcaaggaattaaggcacacatggggcggtgttcaagagaagccaggtgcaggcttccaggagtccccagcagagtcacaggttcactaattctctggcaaccatgatgattatgtgtgtgaaatgttgccaaccagggaagcttggtaggagctcagttcctgggtttgtattaggggcaggtcacataagcagcctttgcttggcacataccaaaagtctagactcccagagggaaagcggtgttcagcataaaccatattgtttgtacaaacagttgaggcacactgagctactctacccaattctgttaatggtggaaaccctgtaagtatgcagacactagccaagggctaaacttgtaagcagccttcaagcaggaaaagcaatcaggtggtcgtgttcacacttttctgcttactaccttattacctttctaaaaatctaagctgggtgtgatggctcgcgcctgtaatcccagctacttgggaggcagaggtgggaaagtcgcttgagcccatgagtttgagaccagcttaggcaacatagtgagaccttgtctctacaaaaaatcaaaaaaatagctgggcatggtggtgtgagtgtagtcacagctacttgggaggctgagttgggaggatcacttgagcccaggagatcgagagcagtttgagtaacatagtgagaccttgtccttacaaaaaaccaaaaaaattagctgggcatggtgatgtgactagtcacagctacttgggaggctgaattgggaggatcgctggagcccaggagttggagaccagcctgggcaatgtagcaagacctaatgcttacctgtagtcccagctactttggaggctgaagtaggaggatcactgatgcaaatagccactgtactgcagcctgggcaacatagcgagacctcatctcctaaaaaaaaaaaaattagaatcctgcagttgtaatttgcaaaactcatgtggccccaagggcttgggagaaaggagcgtggacctgcttattcttcaagggattgggaggacctggagagatgctcaggaatgaaaccacaggctcttaacaccctattgtggggtaaaagtaacacaccttgccctgaacttggtcagcagcatccacgtgggatggatcaaccggggaagctgttacgggccctgttttcttctgtctggtgagtgatgaagagtctcctttccttccttagaatctgggcccttccgtcctggctggagtggcggtgatggtcctcatggtgcccgtcaatgctgtgatggcgatgaagaccaagacgtatcaggtaaggcatgtgtctctgcgggcccccaagccgggccctaggcagaggcctctccatgaggattttagtccagttccttctgctctgtccctggggttctcagccttgcctgccagttggactcacttggggagccttaacaaatgctgatgccccggctgcatatctgggattctgattcacttattgtgggtggggtctggacatcaagatgttttaaagcttcccaggtcattatattgggcagccaagattgagagctcctgacacatggttagaccttgtaggccggtgactggaatcagaaggtctgtgagcctctgagaaagtccttgtttcccacggtcttgtttattatgtgtatgtgtgactcagctttcaagagttgagtacaaattaccccctacttttttcccccttattagctcttaccttataggatacatgctgttaatctctttatttaaattaaaataattaatttctaaaatggggccttgctgtgttgcccaggctggtctcaaactcctgggcttaagtgatcctgttgcctcagcctctcaaagtgttgggattacaggtgtgagccatcatgcccggctttcagctttttatttttggagatattttgtattttaaaaagtttgaatacccaagtaatagagtgatgtttcttattataaaaaagtccaaatcaagccgggctcacccctgtaatttcagcattttgggaggccaaggtgggtggatcgcctgagcttaggagttcaagaccagcctgggaaacatggtgaaacctgtctctaccaaaaatggaaaagttagctgcatgtggtgatgcgtgcctgtagtcccagctacttgggaggctgaagcatgaggatcacctgaacccaggaggtcgaagctgtagtgagccatgattgtgccactgcacaacagagtgagaccctgtctcaaaaaaaaaaaaaaaaaaaaaaaaaaaaaaaaaaaaaaaagtttaaatcgtacaaaagtacataaattaaaaggggatacccccttccctactctctcaaccactgcaaatatatagaagcaaatccttctacaactttctacgtatgtatatacagacctgattaatggtatagtttggtttgtttttatatatgtgggtttttttttttgtttgtggagatggagtctcactttgttgcccaggctagagtgcagtcgtacgatcttggctcactgcaacctctgcctcccgggttcaagtagttctcctgcctcagcctcccgagcagctgggattacaggtgcccaccaccacacccagctaatctttgtatttttagtagagatgaggctttaccacattggccaggctggtcttgaactcctgacctcagatgatccacccgcctcggcctcccaaattgctgggattacaggcatgagccaccatgcctggccattatatatgttttgtgtgtgtgatattattaccatatctgtttttacctaaatgggcccacgtggcagcatgatttttgtcctttagcgccctgctttggggacctctctgtgctgtgccgtatagcttcaattcattcttccaacccggtgccttttggtctataatggagatggtgcagtttatttctttgctcttctgttgatggatatttatggtgtgctgtggaatttcaaatgggagcactaggctgcactgacgataccacagggagatgagtttcaggacatgggcctgttggaaggagaggcctcacgtggtagggttgggtgggatgggtgaggcaggggctttaggattgagtcacccttcagtctcttgatgtgtaggatgccctgagtggcccgactcaacccatttcagtccctggcctccagatcatgtagcttatattcttcccatctgtgacccggggatgactgtagcactaaatgataagagttcttgtgattgttaagtgtctgaatacatgtaaaatgcttagaaaagttgctgggatacacaaaatcctgggtggtagtaaaagtatttaacaactgcactgcacaagtatccactatttggaaccagtgctagccagtacagaaacatttcactattttaacaaccatgggccaggcacaggggctcatgtctgtaatcccagctctttgggagcctgaggcaggaggttggcttgtggccaggagtgcaagaccagcctgagcaacatagcaaggtgccatctctacaagaaatacaaaaatgaactgggtgtggtggcatatgcctgtggtcccagatactaaggaggctgaggtgggaggatcgcttgagcccaggaattcaaggctgcagtgagctatgatcatgccactgcactccagcctggatgccagagtgagatgatgtttccaaaaaaaaagaaaactgggctgacaagaaataagaaaacaggctgggtgcggtggctcacacctgtaatcccagcactctggtaggccgaggttggatcacttgaagtcaggagttcgaaaccagcctggccaacatggtgaagccccgtctctactaaaaatagaaaaattagccaggcgtggtggcaggcgtttatagtcccagctactcaggaggctgaggtaggagaatctctttaacccgggaggcagaggttgcagtgagccaagatcgtgctactgcactccagcctgggcaagagagcgagactccgtcacaaaaaaaaaaagaaaaaatacgaaaacagagaagaaaaacaccaccaccatgtctcctgtgtttgggtcagcagagtagggactgaatcccttcttttctgtacacctgaagggtttttcttgcctctgttcctggattctaaattgagtatgtttctccaatgtctaacctaacgtgatttgaaggggttttttttttcttgatagcggggtcctttggtgtggtcttggggctcaagagtagggctagtagggattacagggtcagctctcccaccctcaggaggcccatttttaatagacggtgaagttgaggcccagtgcggtggctcacacctgtaatcccagcacaggagtttgagaccagcctgggcagcatggtgaaaccccatctctattgaaaagaaaaaaaaaaatcaatataaaaaacatttacatgtcaaagtatataataaagtttatgagaaaaatagctggtgatgttgagtgatgggctgatcccagggtcgccccagatgtgttgactgcccgtctcttccaaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtgagtgaagccacatttttcctggccctcattgtttgatgttttattttctctgcgtacctgaatatttttaaaaggtcactatgttgcccaggtgcagtggctcatgcttggtaatcccagcactctgggaggccaaagcaggtggatcacctgaggtcaggagttcaagaccagcctggccaacatggtgaaacccagtctctactaaaaatacaaaaaaataagccgggtgtggtggcgcatgcctgtagtcccagctactagggaggctgaggcaagagaattacttcaacctgggaggcgacggttggagtgggccaagatcacgccagtgcactccagcctgggcgacagagcaagaccttgtctcaaaaacaaacaaaaaagtcactatgtcagcaaggccttccctgaacacttggtttaaacatttgccatcttctccattctcctttgttttattcacacttagcagcttctagccaacctgtgtaggaaccgttcgttatctatttactgtgatataaggagcttgtgccagaatgtaaaccagtgccccctgcttcctgcattaagatagccttgcaagacaaaaagtgcgagctgagtcgaacggcacgcttggtgccatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttgggagtccaaggtgggtagatcacttgaggccaggagctcgagaccagcctggccaacctggtgaaaccctgttactgcttaaaaaaaaaaaaaaaaaagaaagaaaaaaaaagctgggcatggtggtgcatgcctatattcccagctactcaggaggccgagacatgagaatcccttgaacctgggaggctgaggttgcagtgagccgagatcgagccacggcactccagcctgggcaacacagcaagaccctgtctcaaaaaagtaaaaaaaaaaaaaaataagtaaaataaaatgtacttattttattgtctgcttttcccccactaggatgtcagctccagatgggcatttttgtcgtttctcttgactgctgtatcctcagtatataaaacagtgcatagcaggtgctgaacaaatattgtcatccattgtaaaaaaaaaaaaatacagaaagatataaaatgaaaagtatattgtcctctcttccatcagttcctcccttctaaagtgacagtttcgtgtacgcttttagagaaaaatggacaagcatataggtatttaaaaatactttgacagatataaatggaatcatactgtacatagtgttctcttttctttggttaacaatatatagtcttggttcgttcattctggtctacttcattttagttttttggggggttttgttttgaaatggggtctcgctctgtcccccaggctggagtactgtggtgcgatcatagctcactgcagccttgaactcctgggcccaagcaatcctcctgctttagtttcctaagtagctgggactccaggtgcactgctaccactcccagcttgtttcatttgtgttcatgatggatgcttgtctgacgtgcagatgcgccctgctggaattaccctttctcccattccttgcaaaaacaggttgttccctgttttttttgctgttatgatccatgctacactgaaagttctggtacctgtcctggggtatggtaatgggtctatccctgcctagctggctttgaaaagtttaaagacaacagtgcaacttacaatttgcaaagttggccgcaaatcaggagaccatacagagatggactttggaaattccctttttaagcacagttaaaaacagttaatggtgaaggatgacttcagatcatgccccatgtttgttttttctttctgtctttttattaactgtgtcattctttttgtaatgttgtgctcattacaactattccttcttggtcaggttggcaaattatatgtttttctggcaagtttctgtgaagcagagttaaacatgtttatgaatatgaacttttctgttaaactaccatctgcttcatctttgttgagtttcaggtggaatgtctaaggaagctccagctgtttcagcatttgcgaaagcgtgttcatgctcccactgaattttcttagtcttgccttacttctctcagggtctggaactgcaggagagatggtgttcaaattcaagcctgcatcagaatcacctggagagcttgttattatattttattatttattcatttattgagatgaagtcccagtctgtcacccaggttggattgctatggcactatcttggctcactgcaatctctgcctcccgggttcaagcgattcttccacctcagcctctgagtagctgggattacaggcatgcagcaaccatgctcagctaatttttaaaatatctttagtgtagagatggtgtttcaccatgttggccaggctggtctcgaactcctgacctcaggagatctacccgccttggcctccgaaagtgctgggattacaggcatgagccacagtgctggctgttagcttgttactataaaactcagctttctgggccccacccaaattttcagttttagtaggtctggttggggcctgagtatttgctttcctaacatatccctaggtgctgctgcttctggttcaggttgacatgtagagacaccggagtggatcctcactgcctaaagtctggtccgtggaccagcagccatggcatcacctggtgcttgttaacggtgcagaatttcaggcctcagcccagatccactgaaacggaatctgagttgtaactagttctctaggtggtgtgtatgcacattaaatttcgagagagactggcagaaagtaggagtaaagaaactttttctgtaaatactttcggaattccgggccatacagtctctgtcacaaataccagtctcttccagcgtagtgcaaaaacagccttagataatatggaaatcgatgggtgtggctgtgttcctgtaaaaaagtatttagagacaccaaaatttgaattttatagaatttgcatgtgtcatgtaatattgttttgatttttttaacttttaaaaaatatgaaatctggctgggcgcaggggctcatgcctgtaatctcagcactttgggaggccgaggcgggcgggttgcttgaggctagcagattgagaccagcctagccaacgtggtgaaaccccgtctatactaaaaatacaaaaattagctggaagtggtggtgcgcacctgtggtcatagctactcgggaggctgaggcaggaggatcgcttcaacccaggaggcagaagttgcagtgagccaagatcatgccacacactcctggctgggcaacagagtgagaccctttcctgctgctgcccccccaccccctcccagccccccacaaaaaaaaattagccaggtgtggtggagcatgctggtcatccaagctttttgggaggctgaggtacgggaatcgtttgaacccgggaggcggagatcgcagcgagctgaggtcacgccactgcactctaagcctgggcaacagaacaagactctgtctcaaaaaaaataaaaaaaatgaaatcaatgctgagctcatgggccgtatgtaaacaggtgtgggccaaatgtggacctgagccatccttgttggccagcccctggcttagaggactggaatgttcttctgagaatcaggacacctgccacattctactgccagctcacagtgtgaccccaaagctggtcatctcacctcgctggctctagattttgtcacatggaaaatgaaggggttagattccaagcatgtcaaatactgggccctgtcctccttcctcatgcccacagcagacacccacagtcactcatggggttctttcccactgagttatgttcaagcagccctccaggtgactggtgccagtggcctagagttgagcaagaaatgacatcttgttgcccttctgtaactccatgttccctaagatcacttccagctccaatgcccctgcattctgccttgtacattgcattcttcttacactccaataccttgactttaccggggtgcgttgatgaactctctctttttttgttttttttgggactgagtctcactctgtcacccaggctgaagtgcagtggtgccatctcagctcactgcaacctccatctcccagttcaagcaattctcctgcctcagtcccccgactagctgggattacaaacatgcactaccatgccttgttaattttaatatttttagtagagatgggtttttgtcatgttcgccaggctggtctcgaactcctgacctcaagtgatctacctgccttgatctcccaacgtgctgggattacaagcgtgagccaccgcgcctggactctcctttttttttgagaaggagtcttgctctctcgccaggctggagtgcattggcacgatctcagctcactgcaatctctgcctcttgggttcaagcgattctcctgcctcagcctcctgagtagctgggattacaggcgcctactaccatgcccagctaagttttgtatttttagtagagacggggtttcaccagggttcaagcaattctcctgcctcagcgtccgagtagctgggagtacaggcgcacgccaccatgccaagccaattttttgtatttttagtagagatggggtttagccgtgttggccaggctggtctcaaactcctggcctctagtggtccacccacctcggcctcctaaagtgctgggattacaggtgtgagccgccatgcccggtgggtcttactttataaagtaggaagtaatgtatttgcatatggtgaaacataattaaagctgcaccagatggtattcatacagccggacttcgcacgtggccacctcagcctgctgacattcgccaacaggtcatcctttgtccctgtgttgtagggcctggactgcacattgcaggatgtttcccagcatctgtggcctctacctgccagatgctaagtcgtacctctccctcttcttcccagtggtgacaatagaaaatggctccaggcattgcgaagtgtccccttgggggacagaattctcccagttgagaaccacagtcaatagtgaaaggcccaagcccttcctcctaacaccagtcaccttgcttccctctctccatgtttcttgtgtgtttttccagagtccacgtctgtatcactgtaatggtggatacatgtcatacatgtagttatggttacttgattctgtttactttacttttatacaagtgatagtaagagtcatacataaatacatacaaaatggctttttttttctttttttctttttttttttttttttttgagatggggtctcacactgccgcccaagctggagtgcagtgacatgatcttggctcactgcaacctctgcctcccaggctcaagtaatcctccaacctcagcctcccaggcagctgggactacaagcatgcaccaccatgcccagctaatttctgtaattttgcagagacagggtctcactttgttgcccaggatgttttcaaactcctgagctcgagcagtccgcctgcctctgtctcccaaagtgctgggattgtaggtatgagccactgcacctggccttgatggcattttgaaaggtcttgtctcagaggaaaagatacaagccagagggcgctggtgatgaggtttggtctgtgccttgtgtcccgcttaggaggggatgggcagcgtgttctcacagctttttgctctgcacattggattcgttggcaaaacccacagtttccaggctgtcaccaaactttgcttatcacttcctgccctgttccccattaggaaaccacagcagaagatgcttaagagcaggactggcttttcttctcttttttctttctttctttcttttttaaagagacagggtcttgttttgctgtccaggctggagtacagtggcttgatcacagctcactgcaacctccaactcctgagctaaagcgatcctcctgcttcagcctctggagtagctgggattacagatgtgaaatactgagcccggctaccggctttacttaaccttttcttgagctttcttgccatttagtttcccggagtttccagagacagagtttgttgagctgtttggcaagaaacagatgggcctgggtgtcagctggggagaccttgtcctggccgaggcatcgaagcctctgactacattaggataaaatatgtggcctttagttcccctggaaggtgcctgagtgttttttccactggtgtgcattcctgtgcttcaaagacgatgaggtgtttacccagcggtaggtgtgatggaacacagaggccggggaaggccagggatgccatccagggactgatgggactgtttttctggaatggcaaacctggcatttaccacgtccacctaatgcactttcctaaaatagcatcgccaggcagccgtcaatatttaacattttctgtcttggatgatttgtgagcttcttgccttctgtttaccctgaatctccctttgttagaataattcatcattctctatggtaatgatctgtcctgtagttctctgctgatcatatcctagggcccatggagacactgccacgaccatgtcattttatttatttatatatttatacatttctgtatttttgagacggagtctcattctgccgcccaggctggagtgcagtggcacaatcacagctcactgcaacctccacctcccaggttcagctgattctcctgcctcagcctcccgaagagctgggattacaggtgtgcgccaccacacctggctaattttttgtctttttagtagagatggggtttcaccatgttggccaggctggtctcaaactcctgacctcaagtgatccgcccacctcggcctcccaaagtgctgggattgcaggtgtgagctaccatgcccagtcagaccttgtcattttgtgcttgtaccagcaaagcatagggaccttggcaaatagttcatgctctgtaaatgtatgtaggtaaatgaataaatacatgaatgaatgagaggttgaaataaatcatattaattaggaactgtcttgcaaataacagaaacctagcttaaatcaactagagtaagagaagagggggatttttgagtcacaaaactaaaaagtctagaaaaagacttttaagcatgaatggggttccaggcatggctggatctaggagttcccaagataatgttgggaataacaacgtctctgactctcagctctgctttcttgatggtggtttctttattagctggtagtttcctgatcatcctgtcacctcagcaacccctgtgaacagagagtcttactcttttcccctaatatttcctgcaaagctatgggattgagtctcattggttgtggtcgatcacatgcttcttcctgagccagtcactgaggccagggagataggatgcttgggtcagccagggctaggtcatgtctttcagggcttggggccaaggtagggggtgagggaggaggttcatctgtggctgaagctcataggttgacactgggagaagttcagttcccccagagaaaattgcatgttgccataaacagagtaatagatgccaggtaggcaggaagagcaggtaactgcacacagggcatcaggatttttagggagtgggctggagtgtaggggttccattcattggttttccacgtttctcagaaaaggcacctaggggacaggtgctcctcactgtgtatgaagggcttttgcaccctagaccctcgcctattacaaggcgaactccagtctcctgctgcctggagccccagtcattgtgcccgtcctaccagcctcttcggatttccaaacactgcctgcagggaacctgttaaagcctgtgcttccactagactgtgcgtctcagggttgccaagcccacctcagtccccagcgcatgatgggtgctcagttaccacctgaggggtggatggctagatgacctcctccttctggagaagccaggaccatggacctgaaaggggccgcatgatgttgtcctgtcccctctctgtgtgtgccctgtgctgccagcagccggcatcgattggtacttggctcaccaagggggctggtacgttttggtggtgagatgcctgaggcctggtttgcttcactgctgaagagacacctgtgatgtgctcttctgccctcaggcaaattcacctaccccgtccccacccatttatccactcccacccatccattatctatccagcagacattcactgagcaccatgatctgggctctgtcctaggctctgacaatacagcagtgcatactacaggtaataatctccagtcatggaacattcatttttcacggagagaaacagacaaggaaaaataggcacaataaataaatcctagtgctagagaaagccatcctaagtgctatagaaagaaaagagtcagatctttggaataagggcggcttgcagttttaagtagggtggtccaagctcactgagaaggtgacacttgaggaaagacttgatggaggtaaagaggccaaccagggagtagcaagagcatgtgcaaaggccctggggcattactgtgcccattcataggtgggataaccatggaggctgaaacagtgggagtgaggggagagtgacagatgacgccaaatgaggtacagggaagggactttacaaatcagctgggccttgggatctgagtcagcactttgacttctacactgaaaaataggttgactttggagaggtacttttttaaaaattacttgtttagagatgggggcctcactctgttacccaggctggtgcgggggcacagtaatagctcactgcagcctcgacctcctgggctcaaatgattctcctgcctcagcctccctagtagctaggactacaggtgcatgccactatgcttgacttatttattaatattattgttgttttgagacggagtcttgctctgttgcacacgctggggtgcagtggtgcaatcttggctcactgcaacctccacctcccgggttaaagtgattctcctacttcagcctccctagtagctgggactacaggcacatgccaccacacccggctaatttttgtatttttagtagagacagggttttgccctgtcagacaggctggtcttgaactcctgacttcaggagatccacctgccttggcctcccaacatgctgggattacaggcatgagccattgagcccagccacctggcttattttttaaaaaattttgtagagacacagccttgcttttttgccctggctctgctcgaacttctggcctcaagtgatcctccctcctcggccttgcaaagcatttggattacaggcatgggctaccatgccgatcgaaatgtatttttttaacggaggtataattcaccatttaaaagtgtgcaattcagtggtttttttgtgtgatgtgtggtggtgtgaaggtcacccagtgggttttttgtataaatgataatgacaatcaccactaattccaggacgttttcattaccccaaaaggaagccctgtacctgttaccagttgctccccaaatcttccattccattccaggcaaccagtaatctgctttctgtctgtctctgtttatctactgtggacttttcatataaatggaatcaaacaacaggtggccttttctgactgttttctttttttttgagacgaagtgtctcccttgttgcccacctgaagcgcaatggcatgaccttgcctcactacaacgtttgcctcctaggttcaagcgattctcctgcctcagcctactgagtagctgggattataggcatgcaccaccactcctggctaattgtgtatttttagtagagacggagtttctccatgttggtcaggctggtctggaactcccgacctcaagtgatccgcccgcctcagcctcccgaagtgctgggatttcaggtgtgagccaccccgcctggccatctgactggtttcttagcatgatgttttcaaggtttatccatgttttagcatgtataagaatttcactcctttttatggttgagaagtctatcatgtagatacatgtagaccctttcgagtaaagaatatctctgggctgggcatggtggctcatacctgtaatcccagcattttgggaggccgaggcagacggatcacttgaggccaggagctcaagaccagcctgaccaacatggcgaaaccccatctctactaagaaaaatacaaaaagattagctgggcatggtggtgggcgcctataatcccagctacttggagactgaggcatgagaatcgtttgaccttgggaggcagaggttgcggtgaactgcgatcgcaccactgcactccatcttgtgcaaaagaatgagactgtgtctcaaaaaaaaaaaaagtatctttaggtaagatgccagtgttgcgttaccgcttagaagatgggagccaggatgggtgcagtggctcatgtctgtaatcccagcactttaggtggccgaggcaggcagatggcctgagcccaggtgttcgagaacagcctaggaagcatagggagaccctgtctctacaaaaataaaaaaactagccgggcatggtggtatgcgcctgtagtcctagctactcgggaggctgaggtgggaggaatgcttgagcccgggaggtcgaggctgtggtgagccatgattgcaccactgcacccagggatcatgcgtccctgtcgtttcgagcaccttgcctccctcttgacatcggagcctggaaaatttctgtgccatggctcagcgtcatctgtcttgttaatgtcagagccagaacacgaaccagctctggcttcccgtgggaccgggctctcgcttgtgtgaccacgttaatagattccttggaagaatgatctaaggaatttggaccaaatcttccaacaagaaataaaaacagctgccatctgttgagttttactgtgcttgggccctgtgcaaataaacaccctacataagtgccaacagcccttaaaagcctatcatgacttccattttatagatgagaaaataggggcttgcctggagaggtgaaataactcaaccagggtcccacagcggaaatatggcaaagtgtatggtttttatttttaagctgtatgaccttccaggaagtaacaatgaaatggcagtgctgagaccctgaaaatacatgggccgatggccagatggcagggctatttgggtaaagtgggagagacagctcccttgaatggtgagagggaggagtcaggtggccccctggatggaagatggtttcaggcagaggaaacgtcaggggcaaaggcctggcttggggattgtgcttggtgcttttgaggaatactaagaatgcccctctaggacatctctgagaaagttgatgggagaggccggctctttgggctcccggtcgttgatttatccagttcattcccagagtgtttagtgagcacctgccatgtgccagatactgccccaggtttttccacgagctccagcagctggtcagttgtggccacctggggagggcccaagcgcgtctccagggcctgtcactgctcctaggatgatgactctcactcggggcacagcagtcagcactgggcgttctgcttgcaggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggtacagggggaagctggggcgacttccgagagggggccttggggttctaggccacgaaagcatggaagtgcccccgagcgcagcctctagatcacactcccggtcgggctccatgaggcccggacaaaggctgccatgctttcgtctggtcatgcctgaaagaaagaaaacacatttgacttcttgacagagaactcgcacttgagtatatgaatcaagtttaatgcagcagggctttcccatgctctggaagaatctttccgaaatactctgttctcttcagcctgttcctccgccattcctatcctttttttaaaaaacgtagctcttgtctgacttgattgattttacaacccactgataggtcttgaccacccacgctttgagaaaccccaaccttacagccgggcgcggcggctcatgcctgtattcccaccattttgggaggctgaggcgggtagatcacctgaggtcaagagttcgagaccagcctggccaacatagtgcaacctcatctctactaaaaatacaaaaattagccaggtgtggtggcgggtccctgtaatcccagctactcggaaggctgaggcaggagaattgcttgagcccaggaggaagaggttgcagtgagccaagatcgtgccattgcattccagtctgggtgacacagcaaaaactccgtctcaaaattaaaaaaaaaaaaaagaaaaaccccaaccttacggccgggcatgatggtacatgcctgtaatcccagcactttgggaggccaaggcaggtggatctcttaagcccaggagtttgagactagcctgggcaatatggtaaaaccctgtatgtaaaaaaaaataaaataaaataaaataaaaataaataaataaataaataaataaataaataaataaataaatatgtttgaaaattagccaggcatggtggtgtgcccctgtactcccagcgactcagaaggctggggtgggaggatcagctgagcttgggaagttgaggctgcagtgagtcatagtctcaccactacactccagcctgggtgaagggagtaagaccctgtttttttttgttttttgtttttattttttagaaacaatgtagaccatgtagaatctctaaaattcctgccattgactgtgtaaggaggggtggctttctgttttgtcacacttgggcactactggaagctcctgtcacttttctgcactgttttcacattctttttccgagcattgcgaacatcccttttgaaaactccattttaactacataggcaaatcaaccgtaaaatttggtagtacaaggctgatagcaggctttgtcaaaaacaaaaaaatccattttattatgaaaaatgtcaagtgtacacagaagtagaatagcttaaagtttgtaaactggcattaaaagaaaaagaaaaagaaaaaaaaagccaagcatgatggctcacacctgcaatcccagcattttgggagaccaaggcagacagatcagctgaggtcaggagttcgagaccagcctggccaacatggggaaaccttgtctctactaaaaatacaaaaattagccagatgtattggttggtgcctgtaatcccagctaatctggaggctgagacacgagaatcgcttgaacctgggaggtggaggttgccgaggttgcagtgagccgagattgtgccactgcactccagcctgggcgactgagtgagactcagtctccaagaaaggaaataatacaacatgaaccccgtgtacacatcactcagattcaacatcggcattttttggctgggcgcagtggctcacgcctgtaatcccagcactgtgggaggctgaggtggtaggattgcttcagcccaggagttcaaaatcagcctgggcaatgagacccttaatctacaaaaaataacaaaatgggtgtggggtgcatgcctgcagtgactacatgggaggctgaggcagaaggatcgcttgagcctaggagtttgaggctgcagtgagttatgtttgcaccactgcactccagcctgggcaacagagcaagactctgtctcaaataaagaaaccaaggttgggcgcagtggctcatgcctgtaatcccagcactctgggaggccgaggtgggcggatcatgaggtcaggagatggagaccatcctggctaacacggtgaaaccctgtctctgctaaaaatataaaaaaattagccaggtgtggtggcaggtgcctgtagtcccagctactcggttggctgaggcaggagaatgttgtgaacccgggaggtggagcttgcagtgagccgagattgcgccactgcactccagcctgggtgacagagcgagactccatctcaaaaacgaacaaaaaaacccaaaacattttgccacagttgatttatctcattctttttcagtatccctcccttgtccctctttcccttcatttgtttttaatgctaaactctgctatctatcccttcattctttcctttctttgccgaataattttaaagcaaatctcagaccccttacattctacccacaaatatttcagcatgcatttcttcctacataatgtaataccatcatcatgtctaagcaaactaacaataagtttttacaataatactcagcccatatccaagttttctggaatatctcagaaatgcctgtcccattgggctgtttgaattggctctgttgcatttgctgttacgtttccagagtcccttttccaccaggcctctgcccttttcttcttttatttttatttttatttatttattttttgaaatggagcctcactctgtcacccaggctggagtgcagtggcatgatcttggctcactgcgacctctgccttcccaggttcaagtgattcttctgcctcagcctcccgagtagctgggattgcaggtgcgtgccaccatgccaggctaattttatgtatttttttttttttttttagctgaggcggggtttcaccatgttggccaggctggtctcaaactcctgacctcaagtgatctgcctgccttggcctcccaaagtgctgggattacaggtttgagctaccgtgcccagccattcgcccattttttctgaaataccttttgtgggcttttaaaacaaagcagaaccaaacctgtttctttttttgttttgtttaattctaaagtatacactggttctaagaaatgtgggaccttcagaaataagggagggtgtgtgcccctccacacctggggaaacccttgaaagttaaccttggttggttttgcaaaaatgctttttaaaaataactctcccctgccattgctctctgtacaggcgagtgtctccctcaaacgcctgaggatctttctctcccatgaggagctggaacctgacagcatcgagcgacggcctgtcaaagacggtgtgtgtgtgttcagtcctggcttctggaagtggccgccttcccatctcccactgggtcctccctacttgcatttctttcccttggctgccctcaggtttgactctgcccagccgcttgtctgcgagaccccgggggacaagggttctgcagagcctgcagaagggaagggaagcctggcctcctgggcttctgtcctgtctcacacttcccaggagggtgaacttgcacttgcatttttgttttcttgctgagggtcagcagctgcttgaggcttccccgtgggagtcactttccaaggctttgaccttgattctattctgggctaaatgaggactctggaggctggccagcctccatcacccacaagctgtgtagacttaggtctgagcctcagttttatctagataagggaaacaaaagtacctttctttggctgagtgttacttggatttttttttttttttgagacagggtctcattccatttcccaggctggagtgcagtggtgcagtcacagctgtcactgcagccttgatttcgtgggctcaggtgatcctctgaccttagcctcccaagtagctagaactacaggcacacacagcaccatacttggataatattttggtatgttttgtagagacagggtttcaccatgttgtccaggccggtctcgaactccttagctcaagcaatccacctgcctcagcctcccaaagtgctgggcttataggcatgagccagttctcctggcctttttttttttttcaatattaaattgttttatttggagagacaaggtcttgctttgttcctcaagttggtcttgagctcctgggctcaaggatccctctgcctcagcctcccaaagtgctgggatgacagatgtgagccactgcacctggccatgcatttttattggcaggtttgtttgttttgtagcttgttaatttatcgtttcccagcccatccccctgagccagggatgttgtttgtaaccatctctctaggcacttaataataaatattaggccgggcacagtggctcacgcctgtaatcccagcactttggggagctgaggcaggtggatcacttgaggtcaggagttcgagatcagcctggccaacaaggtgaaaccccgtctctactgaaaatacaaaaattagctggacatggtgttgggcacctgtaatcccaactactcgggaggctgaggcaggagaatcacttgaacccaggaggcggaggttgcagtgagccaagatcgcgccactgcactccagccagggcaaagagtgagacttcatctcaaaaaaaaaaaaaaaaataataataataaatattaatggcactaagtgcagtgacacgttcacttataaagcctctgtcatgcacatgccattccaaggatgtcaatgtcccaacttgtccattactcaccatggtacccctggaggagggtgatggaaacccccattttccagatgaagaaactggtctctgaaacttgcctgagattgcacagctgatcaaaagaagaaccagcattcacacccacagcccatcggtagagtccatgctcttcctggccatagggtgttgcctcactgagatttactgagcacctactatgtgccaagcattgtgagaagtgctctgtgtgcactgcctcatagacaccccatcacagccctctgaagttgattgcatgattgtcagccttattttacagatgaaaaagtgaggcacaggctgggtgcagtggctcctacctataatcctagtactttgggaggccaaggctggaggattgcttgaggccaggagtttgagaccaccttgggtaatgtagtgagacctcgtctctacaaaaattaaattcaccaggcatggtggtgcacctgtagtcctagttacttgagaggctgaggcaggaggattggctgagcccgggagttcaaggctatagtgagctatgatcatgccactgtactccagcctgggtgtcagagtgagaccctgtctcaaaaaacaaacaaacaaaggcacagagaagttaactaacttgcctgtggctacccaggtacgaagtggtagccccaggattcaaacccatacagtctggctccagagtccaatgtcagaagattgaatgtgtgtaaacgtcggttataccgcgtgagctgtgtctggcacctcgcaggcgctcaggtatctttagtggcacctaaaacgtttgacacgtttgacacagcacctggtgcatagaagatgataaacagatcctgggagttgtcacttctctggtctgagcgagatggtctcagcatcttcagctcagccccctggtgtggggttttttatcctgggcgctactgacatctggagacacattgttctttgtggttggggactgtcctgtgcactgtgggatgttgagcagcaaccctggactctacccattagatacagtagtatccatcccaattttggcaaccaaaaatggctccagacattgccagatgtgccttgagggacacagttacctccagttgagaaccgtggcccaagtggatgctggactcttcctcccaacactcctgggctgtggtcatctggtttctgctgtcccagtgtcccacatcccctcacatcataaggcaatgattccatctactctggggtcaaatttctctgctaaccacaggctgaaatttgaggtggccggcggtgggtggggggtggtttcttggtactgaagttgttcacagctcaatgcaagcatcaggaaacccctaggcccctgggtgccgcccgcaccccagcccctccttcctgccctaatagtggcctcctaggtggttggacttcctggaatgtttagcacgctctagccagtgggggcccccttggctgctcccagctcccaagctaaccgttctctgcaacctctctgtctccagtggcttttcttaaattccttaaatagcaactcccagtttcctcattccacgtccactcgtagaagagctgagggagaaagttaatctaggttaaccagcaccttcctctctctctaggttttttgtttttttgatgcatggaggaagttatttcttcatttgacaacttaaacaaaaaatactcctgtattatctccagatggtcttaaggtggctcataattcagagagctgcttttctgttttttctttttctttttttttttttttttgagacagagtttcactctgttgcccaggctggagtgcaatggcacgatcttggctctctgcgacctctgccttggtttcaagcgattctcatgtctcagactcccgagtagctgggactacaggcatgcgctaccacacctggctaatgtttgtatttttagtagagatggggtttcaccacgttggccaggctggtctcgaactcctgacatcaggtgatctgcccgcctcggtctcccgaagtgttgggattacaggcatgagcccctgcgactggcctgcttttgttttaagtgagagacatgaagtaaaaggaaaataacaggaagaagagtaaaagaagacagaggtgctaggagctttagaagtgtggagctggccgggcatggtgtctcatgcctgtaatcccggcactttggaaggccgaggcaagcagatcacttgaggccaagagttcgagaccaggctgagcaacatgtcaagaccccacctctacaaaaaatacaaaaaaaaaattagctgggtgtgatggtgcacatcctgtagtcccagttgctcaggaggctgaagtgggagaatcgcctgcgcctgggagatggaggttgcagtaggccgagatcgcaccactgcgctccagcctgggtgcagaagccagatcctgtctcaggagaagacagaaacatggaaccagttaacgtgggctttgtctccgacactctccccttccctgtgccctcgtaccacacttcctgttccgtatcctctttttttgagtttatcgtgatggatgttttagaaagatccacctgctgtgatgtgctgtgtgtagagtggtgtggctgggggaggaagacagaggacctggggagaagggtgaacgacctccctttgcacctcaaggagggcccagcggtctgatgctggccaccccagtggagagaggtttgcatgtggacgccagctgtttcccactgaccttggccactgctcggccctcccagctggagctgccccgaacctgcctgagaagggccagggcatcgagagcattgagtaattctcatgcggcccccgcctctgcagtcatctcccaagatgatcgtccagatggcgcaaccccatcttacaaggacaaagctgcttgcagtttccttctgctttctgggtctggggctgcctccagaactgcaggttgagtttcttctttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatgggtaagccgggacgtggacacacgtgatggtgtggagagagccacagggcttttgttaaacgtggattcgaattcccaccgtgctccctctctgtgaccttgaacaactcactttgcctttctaagacttagcttacccatctggacaatgggtgcagatacacctgcttaggctgtcgtgagaagcagacacacatgcctagcacagagggttccctgggattgtaagttacagcagccttggacagctagacttagacaatacaggagattcttggcttgcgtaactgggaagttctactttcaggtgcggtgtgatccagggactctgccgtcagaactttcttcatattttctgtgtttcactttctcctggtctgctttatcctcacgcatcctctccccttgtgatggtaaatggtcccaacagctcccactgtgtatcccactgttaggagaactgcctgcttcttattgacccagattgggtcctgtgccctctgtgaggcaatcgctatgccttcagacactgagtgtgctgattggccagtctcagtcaggggctgtgatgctgctgaactccagtgcccctcagctgcccagctcaccctttcttgccagctttctatctggcaccccacaccctacagtccttacctttccaaagcacatgatgtctaggaaattgaccttatccccaggcaacttgtcaagcacctctcattttgttctgaccagaggccttgatcaacagctttttaggcccccttaaggaatccgcaaaacacaggggtgatgggacccttttagaggtttagctcatgcctgggtagccaaatcactgctgtattttatgatgaaggagagaaactctccagagaaaacaatctgtagaaggcctgcattgaaaattcatgggggtactgcatgcttaggaagttcttccttatgtctaacttaaatcctgcctgcttcaattgtagctgttctgtcttgttgagctgcacaactaatctgtatctgtgtccctttcctgacccagtggttttcctgttcagttaccttccccccatgagcccccagaacctttctctaacccttttctctcatcagcctgtaagaatatttcagtctcacgtggacagtggcaggtactgtctcacgtggacagtggcaggtattgtctcactgggcttcctgcccactcaggccccataatcctttcccctcccagcacaggaacaaaaagcctgatgagtgtcaccatgcagcagtgtcataagaatgaaacaatcagtgacagcaacgactatcagcatttccactaatactctgaaatcagaaaggtggcagttaaaaagcacagaatcccagcactttgggaggccaaggtgggcacatcacctgaagtccgaagtctgagaccagcttggccaacatggtgaaaccctgtcactactaaaaataaaaaaactagctgggcatggtggtgcatgcctgtaatcccagcactttgggaggctgaggcgggcagatcactggaggtcagcagttcgagaccagcctggccaatgtggggaaaccccatctgtactaaaaatacaaaaattagctggatgtggtggcgctcgcctgtaatcccagctacttgggaggctgaggcacaagaatcatttgaacctgggaggcacaggtttcagtgagccaagattgagccactgtactccagcctgggccacagagtgagactcttgtctcaaaaaaataaataaatacttaagtaactaaatacagataaataaaaaataaaagcacattccatataagtgagtccagcaaaggtttggatgtgccctcccttccctgggaggatggaaaccctgctctggaggtgccgtcggcagtgggagtggcctggggttgacctgccccattgacagccggtcttactgggtgaatgctgagcttattttattttgctttctgctgttcgttaaaggatgatttcaatagagacatcttcctgaaattcaactcagatttattcatatgcgtttcccttttcaaccctttggtggctcccggctggcagagttcaggtgtcttagcacagcgtccttccagggcatatttcaaggtgctcccaggtctggccactacctacctcagtgccatcgcatccctggttacaccctgtgccttcacccctttacacctttctccggctctccacatgtttctgtgtgtgggacactcctgctttttgtcagagttttttggtttatttattttctgagacagagtctcacgctcttgcccagatcggagtgcagtggcacgatctcagctcactgtaacctccgcctcttgggttcaagtgattcttgtgcctcagcctcctcagtagctgggaccacaggccctgccaccaccacgcctggctaatttttatatttttagtagaaacggggtttcaccatgttggccagactggtctcgagctcctgacctcgtgatccgcctgcgttggcctcccaaagtgctgggattaccagcactggcatgagctaccgtgtccggccccagtttgtcttgaggtgtcctctcctttcagaccttgcgtcatgcccccagtaaagtttctgcctctccgaggggcaaaaactgttccagaagcccactgtgacaggatccctcaggttactccctgcctcacttctctaagggacacctgtcacctgcctcccacctggaggccccctgagacaggtcactgaactgaactcagcagtagaaatggaaggaatgttgaggccttcagtgtttagtacagtcttgccttctgtctttctctttctctacttggggtaaattgaggctcggtggccatgggcattagcccggcaggcctcattcagcgtggctgagccaggtgtgttgtgtcgtttcagcatcaccttctccatccccgaaggtgctttggtggccgtggtgggccaggtgggctgcggaaagtcgtccctgctctcagccctcttggctgagatggacaaagtggaggggcacgtggctatcaaggtaggatgaggaccagcggggaggggcagtggggaagctggtggtctgaggaaaagctcagaaatgatggtgtttcttttgactgtccctgtgccagaagcgaaagcagcaacgtctcttttcctcctcctcctgtatctttccactgtctctttctctctcgttctttctgttctgttccgtgctgtcctagaaggcaggattttggtatcatttatttccatctgtctcccagcacttaaaatagtgcccagtatatagtaggcacttaataaatatttattttgttacctctttattaagctgttattttattattattattatcattattattgtgtttttttttttttgagacagggtcaggctctgtcccgcaggctggagtgaagtggcgtgatctcggctcactgcagcctctgcctcctgggtccaagcgattctccctcagcctcccgagtagctaggattacaggcatgcgccaccatgtccagctaatttttatatttttttagtagagacggtgttttaccatgttggccaggctggtctcaaactcctgacctcaagtgatctgcacacctctgtctcccaaagtgctgggattgcaggtgtgagccaccgcatttggccacttaagaaatacttagtagacacacgaagactccctggtacgcagcctgtgtctccttcccttgcgtctctgcctgtcactgagtgtctcttggtctgtttgggtctttttggattgttctttatctttatggatctctgagtatctattcttataaatgtaacaaaacaaaaatgtttatgtggttggaatattttcttagaacattttttaaagggaacagtttaaatttttagtgttgaattcttaatatggagctaaaagaagactgcagttttactgcttttaaatacacagtgtactttgaagtaagttgaaattccccaggagtgagcttaagaggctcctttacaaataatccccactggaaatcaacagcctttgtttgcatttagttcactccccatgaaggccttttcctagtgtaacgacacgtccctggaagttttgctaccagcatttccaggagtgtggtctgcagccagctcatcttgcaggacatttgggcgataaagaaccccaggctcaaagaagcgtgggaaataatgcatactccagccccctccctcttggagacttacagtaaacattagcaaattaaaggctctgacaagtcctgcaaggagaaaaaatctattaactgtttaaccttatgtgtcccaggtgtacttgtccgcacctctttagtgtctgtgcaactgcacatttgtctcttggaatctgcctttgggaatgtcaagtttatgacgttgtttgttgttgtgggttttgagacagagttttttttgttgcccaggctggagtgcagtcgtgtgatcttgactcactgcaacctctgcctcctgggttcaaccgattcttctgtctcagcctcttgagtagctgggattataggcacccaccattactgcacccggctaatttttgtattttcagtaaagacgggattttaccatgttgacctgggtagtctagaactcctaacctcaggtgatctccccatctcggcttcccaaagtgctgggattacaggcgtgagccaccgctcctggcctagttaatgacattgtttttatttcagagcaaaaccctttctttgattatacagtgcctttagaaagtatacattgtggttgggtccaaattaatgacctttagctgttgttttaagaaatgttttatcattactttcaagttcctgccataaaataagatgaatgaaccatgagagctagattaatggaagaaaattccaaatcccgatgggatccacattgctttctgtttccttaaccccagctttctgctatcctggcactattagcatttcaggccagatgattatttattattggttgtttggcctaggtaaggggagtgctagaaatgtatataaaatatttatcttttcccaaatgttttagttggtgtggtttgtgtatattatgtctgaaatttctgtgggttctatggtaaggcaccactgttgacattttggctttttaaaagttaggatattcaagtcagcaggttaattatttgagaatttagagtaagaatgagggtacctgggacctgctgtcagctttgccctctctagaattcccttattcaagaatcttctggctgggcgcggtggctcacatctgtaatcccagcactttgggaggctgaggcaggttgatcacctgaggtcaggagtttgagaccagcctgaccagcatggcgaaaccccgtctctactgaaaatacaaaaattagtgggcctggtggtgtgtgcctttagtcccagctactcaggaggctgaggaaggagaatcccttgagcccggaggcagagactgcagtgagctgagatcttgacactgtattccagcctgagcgacagcaaggcttcgtttcaaaaaaaaatcttcaggggctccccttgcccctctgataaagcccatgctccccaccaagtataggcccccttgctgtccctggtgtgttttctgccagtcgttccctcacaggattgatcgatgttcctgtcacgctggcctttctgttccttgaatgtgccaagtacttttcacttccaggccttcgcatgtgctgttccctcggacttgaatgctcttccctcttctcctcatgaaactgactcattcttcactttttggttcttgtctaaacatatgtttgagctgagcatgatggctcatgcctataatcccagcacttcaggaggccaaggcaggaggattgcttgaggccaggagtttgagaccaggcttagcaacatggcaagattttgtttctacaaacgtaataaatatatagagaattaactacctcagcattttcattagcaaaatacacaaaacaaatatccttactctagcctttattctcatgctgtttgtgatacctgacatatggaaataaaaataagcctttgaaatggatgcttgatataggagtctttgcttcaatttttagcaaggatatttcctcaaagatccttcccggatgtcccaaactaggtcagtcttttaatttttttgagacaggatcttgctctgtggtccaggctggagtgcagtggcacggtgcaatctcagctcgtggtacctccatttcctgggctcaggtgatcctcccacctcagcctcccaagtagctgggactacagatgcacagcgccatgcctggctaatttttctattttttttagagatgggatttctctatgttgtccaggctggctttgaactcctgacctcaagcagtctgcctgccttggcctcccaaagtgctgggattacaggcatgagccactgcgcctagtcaagttagactcttaaaaagtgtcatatatctttttatctttgcgtccaccgtaactgtaatcaagtagttttccgtcacctgagggacttccactctttggaagcaggggttttgatcaccgctgtaggcattgagttaatagctagctactaagtaaataactgtaatcttatcaacgaggatatcaactctttgactcctgatattggagtcagtgattcacctgctgtgggttctgatcccagccctggcatctgttgtcctttgtgagtcagtttccctcttgccaaagcaatagttgtgatgaaaatgacttgtgaagtgaggccctcctagcaggcgggtgggccagctgttgtctcgttgatcagatctgtctgtgtgtctgtctcacctcgttctccatttgcaacttagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaaggtcagtataggttggatgttggcccctgaatcagtcagctgttgccgcgtaacaaatgctctcacaatctcagtgggctgtgagtctgctgctatcagctgacccggcagggctcagctgggcggctctgctgcacgctgcaggccagctgaacttgggtccaggctgtgggtgtggctcaggtctcacttacagagcttttgctggggaccggggtgaggggtccacagctttccaaaggggggctcttctcatggtggcagcagaggcccaagataggccccccagaaagcatgcaatgtcccttaaagtacactgtcccttctactcacaaagcaagtcacttggccaagctcaaaggcaagggaccaagaaggaagtacattctacctttgtggtcacatgactgcagagtcacatgacagagggcatgctgttgggaggaggggagtcgatgattcatatgttcacagtccctgtcaagatagccataatactgaaaatagcacaatagctaacacttactgagcattttctctttcttttctttctttctttttatttatttatttatttttgagatggagtcttgctctcttgcccaggctggagtgcagtggcacgatctcagctcactgcaacctctgcctcccgcgttcaggtgattctcctgcctcagcttcctgaggggctggaattacaggtgcatatcaccacactcggctaatttttgtatttttagtcgaggcagggtttcaccatgttggccaggttggtgtctaactcctgacctcaagtgatccgctggcctcagcctctcaaagttcttttttttttttgaaatggagtctctctctgtcgcccaggctagagtgtagtggctcactcttggctcattgcaacctctgcctcctgagttcaagtgattctcctccctcagcctcttgaatagctgggactacaggcccctgccaccacgcacagctaatttttgtatttttattcgaggcagggtttcaccatgttggccaggttggtgtctaactcctgacctcaagtgatcggctggcctcagcctctcaaagttctttttttttttttgaaatggagtctctctctgtcgcccaggctagagtgtagtggctcactcttggttcaacctctgcctcctgagttcaagtgattctcctccctcagcctcttgaatagctgggactacaggcccctgccaccacgcacagctaatttctgtatttttagtagagatgggatttcgctgtgttggccatgctgatcttgaactcctggcctcaggtgatctgcccgcctctgcctctcacaatgctgggattacagatgttaaccacctcgcccggcctataacttgagtattttctgtatgttgggaactatgctaaacattttacacgtaattcttccccacagcaagcccatgggtggaatttgttgttatacctaggtaatcattgaggaaaaaggaggcacagagaggccaagtgacttacctgaggccacacagccacagagctgcagagagcatggttcctgtgtccatgttgttacctgctcattttgtcatctctaaaagggccattctctgcctctcaccactgcagaccctccctcctgctgtgctccatctcccaggttttcctgctgcttcacagcaacccccagcccctgcccacctccacaccttggtctgagccttcaaggcctggggtgcctcccctgctgcttgcctggccactttgctctggcaccccatggtggtcgtctggtgtgtcccctcttggaagaccaagagtgcaaagcactggcccatttctgtttttagttacaagccaggggctctgtcggctttcttacgtggtgaatgatgtttaaaaattgagataagcctgcagctccttggaaataaaaaacgaattattggctgggcgcggtagctcacgcctataatcccagcactttgggagaccaaggtgggaggattgtctgaggtcaggagttcgagaccagcctgggcaacatggtgaaaacccacctctactaaaaatacaaaaagttgccaggcatggtgccgtgcacctgtggtcccagccacttagggggctgaggtgagaggattgcttgaacctgggaagcggagattacagtgagctgagattgtgccactgcactccagcctgggcgacagagtgagattctgtctccaaaaacaaaaagaaggcacgtggctgccaggaccccacctcagtgcatgggagtcagggcaggcatctcaggagggactgggcagtaacctgtgatttccagccaaatagggaaacgacgttggcttatctgtcatggtgggagctggcgctgctgctggtccatgcattgtccttcctcctggtgactgggatgtgggctggatttcagcatccccaggccggagccttgcttcacctatatgtggctttgccagacagtgacagatccagagtaagctggcaaacatggcagctgtcaccaacagcagcagtaacaataatatgaccacgtccaccagcgccttccatgagactaagggatcacggccttcccactggtcaacatgatttggtgccgtcagccatcctttgctgagcacttgctgtgcaccacgtgccctgctcagcacctcacgggagattcaggttttctcttttgcccagttgacaggtggggctaaaccctgtgcctgtgatcccatccttggtggtggtggagctggggcctggctccaggtttgtgcaggcgtgacctcatgccttcagcatcaaacttaaagaagaggaggtgggtgcagctctgcagggccttcacccaggacctgctgtgtcctgagcaggctctatgcctttctttctttcttgtttaaagagacagggtctcattctgtcgcccaggctggagtgcagtggcccagccatagctcgttgcagcctggaactcctgggctcaagccatcttcccactcagcctcctgaatagctggaactacaggcgcacatcagcaggcttggctaattttttcttttcttttcttttctttttttgtagagacagggtctccctatattgctcaggctggtctcaaacccctggtctcaagcagtccttccaccttggcctcccaaagttctgggatcacaccacactcggcctgcttctacgtattgtgagtctcaagatttcccaggaaacccactcctgtgtgtgtctctccccagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaaggtgcctgctggcggggtggggcttggtgttgggccgtctcgccctttggttaagtcagaacgtgtcccctttaggagtcctttactttctctggctttctttgtttttaattggactttaaagaacacatttctcatgcttgtcttggaagccttcctaagacagccgtcttgtacttgtctttataggggtaagtcctccgcgcagagttaaattcattgcctctccatggccaagggaggcctctcttcctgattaagtcacagggctggcttcttagcggggaatcccactccaagacattgcctgtgacctagcaggctgcattttcttacttgcagaggtgtctgtgggtagaggggtcggaaaattgccacaacaccttaacataataggaaatagttcctgtgttctttttatagggcagttgtggtaatgggtacacactggctcttttttttctccccctgattttatttttttgaggtggagtttcgctactgttgcccaggctggagtgcagtggcatgatctcagctcactgcaacctccgcatctcgggttcaagcacttctcctgctttggcctcccaagtagctgggattacaggtgcccaccaccacgcctggctaattttttttatttttagtagaatcgaggtttcaccatgttggtcaggctggtctcgaactcctgacctcaagtgatctgcccgcctgggtctcctgcaatgctgggattacaggcgtgagccaccacacccggctgtttctgctgattttaaaactaacacatccccatggggggcatatagattaagaaaaacatgaaaaagaaaaatggaagcagttacacacattccactggttagaggttttgtatttttttcaagtctttttgctctgtgtataaactttttaaatagggttatcttgttccacgtatatatacaggaaacatcgtgctacatgacctcttgtaatcgttcccatacataccactaacattctgtgtaaacatattttaaaatagtacaaaacatttttgaaaattactaagtaatacatgcccattgtaacaaaattgaaaagtacaagaatatggatatcttcttataatatatgtgtgtatgcgtgtgtgtgtgtgtgtgtgtgtgtgtgcatgtatataaagtaaataaagctgggcacggtgagtaatcccaacacttttggaggcctagaccagtggatcacctgaggtcaggagttcgagaccagcctggccaacatggtgaaaccccatctctactaaaaatacaaaaatcagccgagtgtggtgatgcatggctgtaatcccagctactcgggaagctgaggccggagaatgtcttgaacccgggacgtggaggttgcagtgagctgagattgcgccactgcactctagcctgggtaacagagcgagactccgtctcagaaaatatatctaaataaagtaaataaaatagtccctcttcatcctgcatccctaatctttaattcttctcttagagagcaagggttagcaaatctggcccactgcctgctttttatatggctcttgagctaagaatgatgtgtgtatttttaaatagaagaaatctaaacaggaagaatattttatgacatttgaaaatcgtattaaatttagatatcagtgtccataaataaaactttattggaacatggccaatgtattttttttctttttttttctgcagacagggttttcctctgttgtccaggctggagtgcagtgccacagtcatggcatggtagcctccagctcctcggctgaatcaatcctcctgccttctgagtagctcctgggaccacaggcatgcagcaccatgcctggctaatttatttttatttttattttgtggagacaggtctcactatgtttcccaggctggtttcaaactcttggcctcaaggaatcctcccgttttggcctcccaaagtgctgggattacaggtgtgagccaccgcacgtgtcctgttctttaaagcatcgtctacagctgcttcaactcggcagggctgagttggtgccatggcaactgtaagatccataaagctgaaaagattgaccgttagctgtttaaggaaacatatgctgacttctattaatagtttgatgaatgtcttcccaaactttcagatttgcagataaaatgtatgcatgtgcatattttgtagtggttttgggggtggctgacagcgggagttgttttagaaaaaaattaagccagagctgggcacggtagcgcatgcctgtagtcccagcacttttgtaagccaagggcgaatggatcgcttcagttcaggagttcaagatgagcctggacaacatgatgagacccctgtcttgacaaaaaatacaaaaattatctgggcatggtggcacgtatctgtagtcccagctacttgggaggctgaggcaggagaatcgcttgaacccaggaagcataggttgtggtgagccgaggtcgcaccactgcactccagcctgggcgacagagcgagaccctatctcaaaaagaaaaaaaaaaaagaagaaaaaaattaagccattgggctgggcgcagcggctcacacctgtaatcctaaaactttgggaggccaagataggcagattgcctgaggtcaggagtttgagaccagcctgggcaacatggtgaaacgccatctctactaaaatacaacaacaaaaaaatcagccaggtgtggtggcgggcgcatgtaatcccagctacgcgggagggaggctgaggcacgggaattgcttgaacccgggaggcggaggttgcagtgagccgagactgtgccactgcactccagcctggacaacaaagtgaaactctgtctcaaaaaaaaaaaaaaaagccattgcatacaaactgttttgctgtggcaccatccttttattcctttacacacttgtatggttccctccctacctcttgtcattcaggtttttgttaaaaaataaccttccccattacctttgttaaaattgcaaaacccgcacacttggtacacccgttcccctttttgctgtgtttttgccattcagcaagcactattctactagtgttcgtttctcctgcggccctggaatctggggcaggggtctttgtttccttccccttccccagcttttagctcagcacctgaggcgtggcaggccctttgcacatgcatgttacaggaccgtgtgcacaggttcagctgctcctggatgctgttatcgcgggtgcatgtcccaccttcagacctgagttttgcccaccaggtgttcgtcggctcattcctcctttagtcttcactctgccaagctaggcagtctcacacatgtgcactcacgtggccgggtgtcccctttgcccacagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggtaggggcagccccagggttccacccactcagggtgtctggcaccttgaagggccacattggcctctttgaggttgccaccagccacttggggaaggcggctcctcagggcatgagggtgggagctggatggagccccctaaagaagcaatgtggaaaaccaccttagtccctgcagtgctgaactgggagagagtctcggtgctttatggccaggggatgggagcaccaggcttcagctcagctgacctcagggcagggtctagcgccttcctggaacatgaccttggacctgatgagtttcagggtccttatggcaaaaatgggaatgatggtaattaaagtcctggctctcggggctgagagaaactgaggacatacgtgacacaagagatgtgagggttgtgaggtgaagcacggagttaagctggcaggctcgggttggtgacgtctgggttcaatccccggccgctcatctccccagctatgtgacctgaggcctgcccttcagacccatctgagcttcactttcctccctcataaagcagttcagcagggccagacgtggtggttcccagcacttgtaatcccaacacatagagaggctgaggtgggaggatcgctccagctcaggagtttgagaccatcctcagtagcatggcgaaacctcatctctacaaaaaatacaaaaaatttgccaggcacagtggctcacgcctgtaatcccagcactttgggaggccgtggtgggtggatcccttgaagccaggaggaattcaagaccagcctggccaacatactgaaaccccaactctacaaaaaaaaaaaaaaaaaaattcagatgctattaagtgctttggaggggaaacaaaaaagacaatgccatgggctgaggagtgatgggtgtcattgtggcaactcaggcaggggatagggaaaccctctctggggaggttgcattggcatgggaaggagccagcagggagaagatctgggaagtgttgtgggcagagggaacagccagtacaaaggcctcaggaccagcatgagctcaatttgtttacaaaacaaaaagggtggtgtggccagaccatggtgtgccaggacgtggggggcaggagaagaggtcagcacagtgattgtcctgcagggccttccaggtgggttttggtctaactgccctgggaagccactgagtgtcagagaggcaaagtgaccagccccaggatacacagcagctgctggcagggttggttctcaagttggtctctgagtttctcatcctttgcctggggtgggagctccttctctgcagaggtcctagtgatctctaataagtgctttcttgagatgtaattcacacacgtaggctgggcgcagtggctcacgcctgtaatcccagcactgtgggaggctgacacaggtggatcacctgaggtcaggagttggagaccagcctggccaacatgatgaaaccctgtctctactaaaaatacaaaaattatcctggcgtggtggcgcacgcctataggcccagctactggggaggctgaggcaggagaatagtttgaaccttggaggcggaggttgcagtgaaccgagatcgtgccactacactccagcttgggcaacagagcaagacttcgtctcagaaaaacaaaacaaaacaaaacaaaaattcatacaacatacaattaacccacttaaatcacaaaatccaaccatcaccacagtcaggtttagaactttttttaatcacccccaaaagaaaccccaatccatcagccatgactccctattttccccagcacctccgaagccctaggcaaccactaatctttctgtctctctagatttgcttattctggacatttcatataaatgccatcacaataggtggaatgttgtgactggcggcttttacacttagcgtggtgttttcaaggttcgtctatgttgtagcttcatttccttttattgcggaataatatgccattgtgcagatagaccatactgtgttgatctgttcactggttgatggacattcaggttttttccactttctgactcttgtgaatactgctgtcatgagccctggtggttttaaaggaaaagttggtggccgggtgtggtggtttgtgcctgtaatcccaccactttgggaggccaaggcgggtggatcacttgaggttaggagttcaagaccagcctgggcagcatggtgaaacctcgtctctactgaaagtacaaacattagctgggatggtggtgcacacctgtagtcccggctattcgggaggctgaggtgggggaatcgcttgagcctgggagtcaggctgctgtgagccaaaatcatgccactgcactccatctggcctgggtgacagagcaagaccatgtctcaaaatacagttggatttttgtttcttgccagtgcatgatagctgacattcccttcagcttttaaattatttgattagactgaatttctgcatgttcattcccttgtggttgggaagttctaccttgagtctagcctgtttcttcttgctgcagaatccccctttgtctatctctcagcccgagcaatgcattgtggcaacttctcggtgactttttcactgacctgcttggcaggctacttttaggtgacaataccctttgtgctctctaaatcaaaatgtgtgggtttagctgaatcttttgcccagcgtgaggtctgtctctctacccttccgtccaggtgagcaaaaaatgtccttaaactctcttggccccagataggttccgcacccccgcctttctttcccagctgctagagtatccaagcagtgtatacagaacatggaaggctgccagatgctttgtgatttttgtacacatcagcacttaatttggtgatgcaaatgccgcccaccaccctggcacctcgtgcgttcattttcccagtttgacctccctacctcctgcctttgaggttacatagaagtccttggcagtgggtcttacatcaaactggggcacccccctctctcaccacccacccttttccattgctctggaggggccctggctataaagtcttgacatcagggtctggtcttgcccagccttagccaactcgaagcgccaatgaccttgggtttgtttaaaccacatttttggctcttcctaaaggggaacttttttccttgttggattaatcagctcttttttttagaacacccaggctgaaggggtgcaggtgttggtatttggtttgggagaatccttgaggggggatgggcaggaaccaggcttgtgaatggggccataccgacctctctcccgggatattcagtttactgatttctaagaaatatatcttttttactgtttgtctccctctctccttttttttttttttttttttttaacttttaatggcattccttttattcctaatttattcccatgccataagcttttgtttcttcaatttcttctgggatatatttttcttctgtgcagcctccccttccggtttaggaacagtttgttccctttcaggcaggatcatctggatgtggcagagtgagctcacgtatgggttaatccgaccgaccctgagctctgtaggtccggcgacgcaacttaggtgctttcttcagttggatatgctcaaggaccagagaatctgcatctgaacccttaagttcagtgtgactctctgtatttttaagcatgtgcagcagaaattcagtgctctttttgggccgccgaccttgtggccagccccacttcttggcctgggtacatctaccaactccaccattataatgtcagaatggtacatgttgtttctgtaaagtggcatctttctgatactttgtggccttttgtacgtgcatacctttgatggcctgggcgctttcaggagtgttctttttctttttcttttttttgagacggagtcttgctctgtcgcccaggctggagtgcagtggcgcgatcttggctccctgcaagctctgccgcccaggttcacgccattctcctgcctcagcctcccgagtagctgggactacaggcgcccgccaccatgcccagctaattttttttgtatttttagtagaaacggggtttcaccgtgttagtcaggatggtctcgatctcttgacgtcatgatccgcccgcctcggcctcccaaagtgctgggattacaggcgtgagccactgcgcctggccttttttttttttttttttttttgatacagagtctcacttgttgcccaggctggagtgtagtggcacgatcttggctcactgcagcctccacctcccgggttcaagaaattcttgtgcctcagcctctcgagtagctggagttacaggcatgtgccaccacgcccagctaatttttgtatttttagtagagatggggtttcaccatgctgaccaggctggtctcaaactcctggcctcaagggatcctcctgcctcagcctcccaaagtgttgggataacaggcatgagccaccatgcccggcctcacaaatgttcttaaggtgaacacgaagatttgaacctcttgatctgcatgattctgtggtgttttctggataaagtgaatagtgaaccattttcacagattgcctcaagccccttaggggaacaaatttttaagggatttaaaaaaatggctcattaaccttcatacctggaaggtaaaacacatcttcatgactctggtttctttcttaggaacctaatacctagagcagtggttttccatcaggggcaaattgcccccaccctggggacagttggcaatgtttggagacatgttgggatgtcaaaactggagtggggtttgcccctggcaggcaagcagggtagaggccagcgatgtcgctaaacatcctacagcactcaagacgaattcccccttaccctgccccccgtgacagggaatccccttgccaggacatccaaagcaccacgagcaagaaaccctgtgtgctccgacttcacactgctgaattcttcccttgtcctcttgggagaaggatctttattccaacaatgtggccatttttctcttttaaaaaattttatttatatatttttatgtttttttatggagatgggatatcagtctgttgcccaggctggtctcgaactcctgggctcaagcgatcctcccaccttgacctcccaaaatgcaaatgctgggattataagcatgagtcgcggcacctggcccgtggccatttttcaaaaccttgcttgaaccatctgttaacctcatggcaaatatttttccctcttaagtatttaccgagtttttcttaatgattataaaagcaacatgtgctcatcgtagacatttgcaaactacaaaagagtacaaagaatcaggaaaaaaggtggctcatatgtgtaatgccaggactttgggaggccaaggtaggcggatcacctgagggcaggagttcgagaccagcctcgccaacatggtgaaaccccatctctactaaaaatacagaaatgtcaggaggctgaggcaggagaatagcgtgaatccggggggcagagcttgcagtgagccaagattgtgccactgcactctagcctgggtaacagagcgagactgtctcaaaaaaaaaacaaaaaaacaaaaaaaaactcccgagaaagaacatctttctgccctcactgcccagaaggggagctgttgttagctttggcatctttttcacctgtccttccttcctaggccttctcccttgacaagattgagagtatatcttagagttttctcatctcctgccaccttttgatttcttttcttaacagtgggccataagcacctccccaagttacacaaattagttgtcagcacagagcagctgccgagagagttcatcagacagacccccacattccttctggctgtcctcagaggccggatttcttcctcttttgaggatgaagagctttctctgccgaggctgggggaggaggtcagtgaggcagccagtgaatgccgtttttggtcaaaaatgaggcgttgactataaagctgtgagttgaattcttccctccggggaggctggcctgctggaccttgcccaagcagagttccagaaccttcttgagtaaaggcagtgttggtggaataaacagtgagaggactggcaacggaatacacagacccggggcagcacttaacgtacgtgggtcaagggtagaaacagcacctggcttgacagcatccaaaacccaacacctggtggttgcatgaactcagtgacagtcactgaattacaagtttcgtgtgtttgctttaaaaaaaaaaagaaagaactcttgctactttatagcattctccaccctggcccccagccttcatgtccctcttcttccctgctttgattactttgtggcacttattgctgcctggagtaaattatggatctacttgttcatttattgttgatctcttcctttggaatttaagatctgagggttttgtttgtttgttttgttttgttttgtttgttttgggagtctcacgctgttgcccaggctggagtgcaatggtgcaatctcggctcactgcaacctccacctcctgggtccaagtgattctcctgccgcaacctcccaagtagctgggattacggatgcctgccaccacgcccggctaatttttgtatttttagtagagacggcgttgtgccacattggtcaggctggtcttgaactccggacctcaagtgatccacccgcctcagcctcccaaagtgctgggattacaggcatgagccatcgtgcccggctgctctgagggctttttggttgtctctccatccccaggactaagaaaagagcctgacacatagtagacactcagtaaatgtgttaaatgagtggatgaatcgcaccttggctgttcaaggcatgtcctgcataagcagtgggtaggccggagggctttggatgtttacactgcagataaatacctcagactaggagaaaataggagtggatttcaccccctctcaggtctgctttagaaagcagctttgtcagtcctgcctatgagaggggcccctctggcattgggaagtcagctctgcttcttgacttgactatacacttgtcagtctgcccatctgtctgtcgggtgtgtacagagtgcctgctgtgtgccacaaggccacctggtacgtgagcctctgtgtggaatggtgccccccacgttgagttgtgcagtgtgcatcttgtgtaactgcacttggccacctgctgtgccaggtgctggtgatacagtaatggatatgacccacttcatgcccttgagagctcacagtctgatgggagagacaaacgccaaacaattaagggtatcatagtgctaaatgcagtgatggagggctgcttgagggcctgggaaatcacagagaaggagcccccatcccagcctgggagggtccagggtgatatctgggctaagtcaccttttcttctcctcttgggcacatgtgcatctggctctgtgtggggccagcccctctcaggagcagtgtctgtcctcaaaggggctggagctgatgcccatgccacctcccagtgtcatgcctggcctgcctactgtaatactttatttcttttcctctcctgcgtaaaaacaagcctgaagactgaaggttggtctgcattatttgtttagctctatttatggttaaacacagttatgactttggccaggcatggtggctcacgcctgtaatcctagcactttgggaggccaaggcaggtgtatcagctgaggtcaggagtttgagaccagcctggccaacatggcaaaaccccgtctctactaaaaatacgaaaattagccaggtgtggtggcgggcacctgtaatcccagctatttgggaggctgaggctggagaattgcttgaacctgggtggcggaggttgcggtgagctaagatcacgccacttccctccagcctgggctaaagagtgaaactctgtcacaaacaaacaaacaaaaacccaacacagttatgactttggagaaaggggttggtcttgtgcagtgtgcttgtcccggatccacccagcacgtgtgggatggggaaactgacgcacaaatggagcagacccttcagccattcttgcctctccccctttagaaaagacactcccttcactcctttatttagataggggcttagggcgggagtttcgctttgcttcttaacaatatcttgggtcttctgaattcccaggcagcacagtgatggacgaggaggaagcaggtcagtactgcccgggttggagttggcttggctcatagaatgaggccagagacgggccgagactgtcgctgcatgtctggggaggtgccgtcagatgtctgtgttttcacccctccggttgttcattggttcatttagcacacatttactgggtacctactgtgtgtctggctttgaggctggcactgggggatacagcctgagtccccagatccctttattgtcactgatgaccttgggtaagctctactgtttcatgcatcacgttaccgtgaccagcatgccttgaggggaccatgcttatgaagtgcctggcacacagtggatggacaataaatggcaacagtttgattgtgagctgccacgcatagatcctggggcacagtcaagacacacatgggcccagacaatgcagggtgatcagcgcctgttggggaactgcagcaggtggtggtggggaccctgaagagggatgtcgcctagtggaattccagtggccagactggacccatccctcctgccttctgcagtgtgtggcttagggtcccagccaagggctttttttgtaagcagcagaagctgaatctggccaccttaaacaaacagagggtgtttcctggaaggataccaggtaactcatgaatcaaaggcagaactgagcaagtaggactcaggaaatgggaactctgggagactagactcttttaggacaggtgaacttgaactgtctttggtccttgtagaccactgatgacggttcaaatcctgggagaggggcttttatggggcgacctcagacagtgcccaccttggctgggggaatctgaggcaccctgattgacaggcccaccaaggctgtaggaagagggagagctgatcccttcaaaaagccaacagggggccaggcacagtggctcacacctgtaatcccagcactctgggaggccgaggtgggtggatcacctgaggtcaggggtttgagaccagcctggccaacatggtgaaaccccgtctctactagaaatacaaaagaattagccaggcacggtggtgcatgcctgtaatcccagcttcctgggaggctgaggtgggaggatcgattgaacccaagaggcagaggttgcagtgagccaagatggcaccagtgcaatccagcctgggcgacagagaagaccttgtctcaagacaaggaaaaaaaaaaatgctgagaggatggtggactaactgatgttcagattcctcctcttaggcgcttggtcctcctccgtgcagagtggaattttccagctgcccagttcgacctgtgggctaattggtgggttgagagggtaagacagccttagcgagcactgcatgcctgcagaagctcccagctgaccatggtggctgcgctcagtgacgaacaggagaagtgaaggctgaggcttataggagggtggcctgaggctgctggtaggagagcgggggggctctctgcggcatgcagcctccagatgggggtccctgggagtgttctggaacattctcatccctgcacagagaaagatggttaagggcatggctggttcccagtgtcacacatgtgtgtgaggacaggctgcatgggaagtcctgcttggtatcattcttccttcctgggtgatgtggctatttgtgttttgtttgttttttaagttagtgtttagttagtttagacaaaacaaaacagatgctgacattaaagggaatgtttaaagcagagtttctcagttcctggctgtgcctagaattctctgtagaacctgtttaaaaatgtatttagtaataagcaacacgggggtcgccatcactgaacacttgctgtgccaggcactgcgtgcagtctcgtttcaccctctcgcaaatgaaggttgggtctgctgttcctgttttgcagatgtggaagatgaggctcagacagatttatcatttccccaaggggcacagccaggaagtgagagaacacttcccacatatcacagttcctggagctctaatcgagactcatagcagggactgggctggacacgagggcacctgctcagtttttaattttaattttttggtttattttcttttattcgtgttttttagattttttttttatttttattttttatttttatttttagacagagtctcgctctgtcacccaggctggagtgtggtagcatgatttcagctcactgcaacctccgcctcccgggttcaagcaattctagagcctcagcctcccgagtaggtgggattacaggcatgcaccaccacgcccagctaatttttgtatttttagaatagagttggggtttttccatgttggccaggctggtcttgaactcctggcctcaagcgatctgcccgcctcggccttgaaagtgctggggattacaggtgtgagccaccgtgcccggcggccacctgctcatttataaagccccccgtgactcatttacaaccaagactgagaattcctggcatggagtgcctccctctgtccaggaatgatctgcagccccctcttcccttccaggtgtgtctgtgtctccctgtggctgtttctgcaagattttgcatttttgagctctgcttttattcatgtcatcacccgagcatgttcccagggtcaccctgaccatgctgctggctgcgtatttatcccttttgtatcttctgtcctgggtcctctcccaccttctctggggtcagccctgtggtgccttacattgtgctgctttctctcctggcaccaaagaatgaggcagtcagtgcggagtgggggcagtagtcatcatcatcactgagttattgtgaaccgggaaagagatatgatctgtgttgacacgacacacggtgcccaagtgcacttgataaatgttggctgtcattgtcattgttgatgttccggtgattattgttgatgctgggtggattcttcctgggatcagggcagatatccagctgctgtgtcccttggtgtccttatcagtgtccttcctaattctgcaaccaaggcatctgccagggctggggtctcatctgaagactcaatcagggaagggtccactttgaagctcacctggttgttggcagaacttggttccccagttcaaatgttgaaatactttattactgtggaaacagccactgccccaggtaccttttaccctgaactcttgggacctctctgtggtctaggaactgaagggttaactcctggcactacaggggtctccgggcctctgcctgttggctgatggccttgtcaaattggttatctattttgaatatcacttcttctttcaatgcttgggaatcacggggctatgccctttccctcatgcgtttccttgcatcctggtcctaggaagtgagcttaacatagcagggctactgttttctgggctgggttttacccattgctgctggcacaggatgctggctcaggcccagtgccctcagtggatggagccttctgcacagttgcaaagcactgtccctaccccaagggactgagctccagataccacctgccccacaaccagacagcctgttcatggcctctgcagagcaggtctcctactttctgatcatcctggcggccaggtgctctgtggtctcctcactgaagtggccggtttttgttgcccttggttttagcatctgcctcatataaccccacttgccccctttgtctctcttctgccaggggtcacgggcgtcagcggtccagggaaggaagcaaagcaaatggagaatggcatgctggtgacggacagtgcagggaagcaactgcagaggtaagggcggggaggaaggccccaacctaaggaccctgccctgccagtgggaggacaagaggaggaacaaaaaaaggcctcagccccctgaggtcctggaaggcctgggcttttaccttccctcccaaatcctccaaggaccttgcttttcagagtacagaggcccaaagaaggaatgtggcactctttttgccaggtggcacaactcacacaggcctcatgatttaaccagctgtccacgcttctgacactcgggctccctacatggtgtgggtctttgctcaggtctcttggcggggcctggaaggttcaggctttgtgaagcagcatttgatttaaaactgtctcaaggccaggtgtggtggctcctgcttgtaatctcagcactttgggaggttgaggcaggaggatcgcttgaggccaggagtttgagaccacagtgggtaacatagcaagacctcatctctacaaaaaaggaagtatgctcgtgtttgattatagagggcttccttagatccctggggatttatagcgtatgcagtatattaaccatcctagcttttaaaaaactggctaagtcggccaggcagggtggctcatgcctataatcccagcacttcgggaggctgaggcgggcggatcacctgaggacaggagttgaagaccagcctggccaacatgatgaaaccctgtctctactaaagatacaaaaattagccaggcatggtggcaggcgcctgtagtcccagctactcgggaggctgaggcacgagaatcgcttgaacccaggaggtggaggttgcagtgagccgagattgcgccatggcactccagcctgggtgacagagcgagactccatctcaaaaaacaaaaacaaaacaaaacagcagcagcagcagaaaacagtaaaacaacaacaaaaattgacaaagtcggagcctaaacgtatcagaccgcggagatctgagaaaggatcccggacctgcagttgctacaggggtcaggagagagcaaagaccatgcggcatagcacggtgcctggaacagacaaacacttcgtagatgtcgcttttgccatggttatcatccggacatggttatggtccggaattggtgggtcttggtctcactgacttcaagaatgaagccgcagaccctcacggtgagtgttacagttcttaaaggtggcacgtctggggtttgttccttctgctgttcggatgtgttcggagtttcttccttctggtgggttcgtggtctcgctggcctcaggagtgaagctgcagaccttcgcggtaagtgttacagctcttaaggtggcgtgtctggagtcgttcgttcctcccgctgggtttgtgctctggctggcttcaggagtgaagctgtagaccttgatggtgagtgttacagctcacaaaggcaatgtggacccaaacactgagcagcagaaagatttatcgcaaagagtgaaacaataaagcttccacagtttggaagggtaccccagtaggtggccactgctggctctggcagccagcttttattctcttatctggccctacccacatcctgctgattggtccattttacagagagccgattggtctgtttttacagagtgttgattggtccgttttgacagggtgctgattggtgtgtttacaacccctgagctagatacgtaagttccccacatccccactagattagctagatatagagtgttgattggtgcattcacaaaccctgagctagacacagggtgctgattggtgtgtttacaaaccttgagctagatacagagtgctgattggtgtatttacaatcccttagctagacataaagggcctccaagtcagcaccagactcaggagcccagctggcttcaccaggtggatgccacactggggctgcaggtggagctgcctgccagtcccgtgccgtgcgccctcactcctcagcccttgggcggtggaagggactgggcgccatggagcaggggcggcactcgtccgggaggctcgggccgcgcaggagcccatagcggggaggtggggaggctcaggcatggcaggctgcaggtcccgagccctgccccgcggggaggcagctaaagcccggtgagaaatcaagtgcagcagctgctggcccaggtgctaagcccctcactacccgggctggcggggctgcccggcagctctgagtgcggggtccaccgagccgacgcccacccagaactagcgctggcccgcaagcgccctgtgcagctccggttccctcccgttcctctccctccacacctccccgcaagctgagggagccggctccagccttggccagcccagaaaggggctcccacagtgcagcggcgggctgaagggctcctcaagcgctgccagagtgggtgccaaggccgaggaggcacagagagcgagcgagggctgcgagggctgccagcacgctgtcacttctcaatcttacacagcctaaattctagtgggagactccagacagtgcatgagtgtagaaggatgtaagattttctgtcgaggtgtgtggatgtgtgaagtcctaggtcatgaagcaggaagccccagctccccatttgaattctagattccatccagagttggttccagttgctccctctgccactccctgaaaactcactcttgctttcagatttgagggccacttccacctcactaggccttaactaaagacctttgcacagatctcatgggtaaggaaagtttacccaatcccaggcgctaattcaaagaggggaggtggtggaggtttattcggccttcaggaagtgttttcaggggacacagttctgggggtgcagggatgactcatatggggctcttgacctcagttagcttataatcttgtgcaggagataagtgggtagaggaaagtatagaaatttccacggcagtgagccgcagctgtgttttgcatggtctccataatttcttttcttttcttttcttttttttttttttttgacatgagtctccctctgtcgcccaggctggagtgcagtgtgcagtggcgcgatgtcagccactgaacggaaaactgtgggcgacgcaatctgtgatcatctctgggggtctgcataaagctcatgaccactgatgtgcgaaaagtgcttttttttttttttttgagacagggtcttactcagtcgctgaggctggagtgcagtggtgcaatcacggctcactgcaatttctgcctctgggattcaagcgattctcctgcctcaacctcccaagtagttgggactgcaggtgcacggtaccacgcctggctaatttttgtatttttagtagagacggggtttcaccgtgttggccaggctagtcttgaactcctggcctcaagtgatccgcccacctcggcctcccaaagtgctgggattacaggtgtgagccactgcacctggccaaataatgctttctgagtaacacgcttgcatgaaggagcagtcaggcaagatcccaccccagtgcccaccacatttgtaaaacaagaaaatcgaactagctgggtactttgccctatgtttttcatcatatgttacattttgaatctttttcatgtttgaaaaatgatctacgatgtgccctttctgttatatcttttattggcttttttttttttgagatgaattctaattgatctcagaaaaaaaaaaaaaaagcacgcactttttatataccagttgtcatgggctttttgcaggcccccagagatcatcacagattgcgtttcccatgggtctcattcctgcctgagacactgcctttctctgggtacctataaacctggagagtgacatggtggggtgtggtgcatatattcatatatatgtttacatgtgtgcatgtggaaacactccgtctcttatgccatggttcagacccacaatagcagtcccagcagggagccctccgaccctgcccaaggcatctgtacggttgacacccttgtgctttgcttctccagacagctcagcagctcctcctcctatagtggggacatcagcaggcaccacaacagcaccgcagaactgcagaaagctgaggccaagaaggaggagacctggaagctgatggaggctgacaaggcgcagacagggcaggtgagattcgctccttaagtgatgacagtggctggagtttatagagcgcccactgtgcactgggcactgtgcaaagtgccttgtctatgttaactcacctgtccatcacaacacacctgtgaagatactatttgcagcaccagaaactgaggccagagaggctaagtgacttactcacggtcacccctggtcagcggcagaactgggatttgaaccctggccaactccagggttagtacttgtagtctctgctctattgactgcctgagcagctcaggggggtctcattcgctagaggtgagctggatgctttaaatcagggcttcctgcaacgtggggttcagttgtgcatgagatggtgtccggttgtgcacagacgcattaaatgacagaggaatgtttgtttcatttctttttttaatttttatttttttgagatggagtctcactctgtcaccaaggctggagtgcagtggtgcgatctcggctcactacaacctctgcctcctgggttcaagcagttttcctgcctcagcctcctgagtagctgggattacagaaacttgctaccttgcccagctaatttttgtatttttagtagagacagggtttcaccatgttggccaggctggtcttgaactcctgacctcaggtgatccacccaccttggcctcccaaaatgctgggattacaggggtgagcaccgcgtcctgcctgtttttcatttctcatttggtcctaatgattacgtccctgagaaagtcccagttgggtcctaccctgccttctcaacctatcaaccactatcctctctttgtaacaaggagaccgggttttgagctcctgttttattgtttttaaagatcgtctattttgggcaagtgttaataattctccatttatggtggtgatccaaagtttatttttaaaaataaatgtggttttttttgtttttgtttttaaagggaatggaatttttaaagtaggtaaaaaataagcatgcagataaagaaaaacaaaaaaaaaaacatgaaaggtggtagccggggagtggggctggggcactttctcttagatctgcccggatgtgtccagagcttccgaggactgtctgttcctggcttcttccttaacttgtcatcagagtcaggaccgtaacaaggggcagaggtgactctggtgtcctctctcgccttacccttagtgaccctccaggaagccagagaagttaccccaaatcgcaggacatgggaaggaagggccagagatgccaggcccatttaatcctcatttaactccaattttatattcaaggaacatcaaagccagggggcttgttacttgtcaaagttggacccagagtggagccaggcacaacacgcttatcgtttctttgtgtcttttttttttttttttttttttttgagacgaagtcctgctgtgttgcccaggctgtagtgccgtggcgctcaccgcaacctccgcctcccgggttcaagcaatttacctgcctcagcctcccgagtagctgggactacaggcctgcgccaccatgcctagctaatttttgtattttcggtagagatggcgtttcactatgttggccaggctggtctcaaactcctgaccttgtgatctgcctgcctcagcctcccaaagagctggtgctgggattataggcatgagccactgcgcccggccttttttttttttttaatttgttttcttttttttttttctgagacaaggtctgactctgtcacccaggatggagtgcagtggcacaatcatggctaactgcagcctccacctcccggattcaagtgattctcccacctcagccttccaagtagctgtgactacatgtgtgcacccccacgcttgactaatttttttaatttttttgtggagatgaggtttcgccctgtcgcccagactggtcttgagctcctgggctcaagtgactggcccgcctcccaaagtactgggattacagatgtgagccaccacacctggccacacacttgtcatttctgacccccgagcccaccacattccactactcatgagaaagaggttcctgaacgctgcaggctaatttcagggacagcaggcaacttggccgcatgacaaagccaagtggtgaaataaacacattcttaattatgacctgtctcctcacccacatttttcattttccagaatggggacttgaaaactcaaaaggaagcagccagttacacatcagacctgttatctttcacctgttacctttcagctagaccgtagggtcagatgatttttgtttttttttctggtgaggggcagagcctcactgtgtcgctcaggctggagtgcagtggtgtgaccaacgctcactgcagccttaagcttctgggttcaagagctcctcctagctcagcttcctgagtagctgggactataggtgtggaccaccacacctagctaattttaaaattttttgtagagacagggtcttactgtgtttcccaggctggtctcaaactcctgggctcaagtcattgtcctgccttggcctcccaaagtgctggcattataggtgtgagccaccgcacccagtccagatgattttcatgacccaaaattcagcatgaaaagcttgaaatgacaatgagcacagacacgggtaaagatccctggaatttcttgaaaccaagtcaggtggtttaggtgggggctggcctaaagcagattgccctgtctctcatgtcaggcggctagacacatttgtttagccccatgctgggctccacagggaatataggagggaaagaaactccaaccttcacctcctggagcgaactgggcactgggaagatgggtgagatggtattctgtgctcagagtgaaaagagttggaggaggctggcccagttgtggtgttgaggtgacatttggccttggttgccaggcaacatgtcacacgttgcttaaaactcattggtggcttctgctttctgtcagtcttggctaaaagttggaatcctgacccgagtctcccatgccatgtgtggtctgactgcgaccggtttttccagcctcttgttccttgctgccccatgatctcctggctccagccaccagtgccttctctcagttccccagatgcactgtgttccctcctacctcagggcctttgcacatgctggttctgccaccttttttccattttcagctggtttaactcctttttttttttttccccctggaggcaatgtctccctctgtcacccaggctggtgtgcagtaagtttggcttggtgcaacctccacctcctggcttcaagcgacccttgtgcctcagcctacaggcatgtgcccccacgcctgactaatttttgtattttttgtagaggtgagatttcatcatgttggccaggctggtctcggattcctgacctcaggtgatccacttgccgcagcccctcaaagtgctgggattacaggtgtgtgagccacgatgcccagcactctttatttttttttattttttagagacagtctcactctgtcacccacgctggagtgcagtggcgcattctcggctcactgtaacctccgcctactgggttcaagccattctcttgcctcagcctcccgagtagctgagatgacatgtgcctaccaccatgcccagctaatttttgtattttagtaggcaaggggtttcgccatgttagtcaggctggtctcaaactcctgacctcaggtaatccacccgcctcggcctaccgacgtgctgggatcacaggcatgagccactgcacccagccttggtttaactctttaatgtcacttcctcgaagaaaacctcccccaatacctctctagactgcattaggtcaggttgtctgattttatactcacgtggaattgtgcaccgtttacagcccttctctgtgatgacgcatttatctgggatgattttatgggagcctatctcaccacgcgactggaagctccatgcatgagggcagagaccctgagtttgtctcttttttttgagacggagtctcactctgtcgcccaggctggagtgcagtggggcaatcttggctcactgcttctacctctgcctcctgggttcgaggaattctgcctcggccttccaattagctgggattacagatgccgaccacacacccggctaactttatatttttaatagaggcaggattttgccatattggccaggctggtctcgaagtctctacctcagttgatctgcccgcctcagcctcccaaaatgttgggattacaggtgtgagccacggcgcctggccctcgactttgtttactgctgactttgttgaatagctaaaggggaggggtgttctacgtaggagcaaaggcaggcagctgggtggcacagtgctggtgaagcccccgaccttgtggggctggggctggggctgggtgcgtgcatgtgctaagctgccttatctcctgtgatctccaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaaggttggtgccgctgtctcccaccccgcctgatttgggcccctgttgtggctttgtctaattatagaaatggatccttagagtcctcagcgttttgtgggaccccaaaccaagccaaacccagaaaaatggtagctgtcagctagtagacactcagatatttgtagagtgggtgtttgagtgctttgttcatatgggccttggtggtagacgggaggagtgctccagtgtgcccattttacagatgaggacagttgagaacagaggcctctggaagcactgagggttgggaggacccccttgagcatgtttgctttgtcacagtgacagagcttccatgaggtctcatttgcggacttttgcctgctgagtgagggcggaaattggcttatactagtaattcccaattatgggcagtgttgtccctcagggatgtttgacaatatctggagatgcttttggttgtcaaaagattgagaaaccctgctgttggccaggcatggtggctcacacctgtaatcccacactttgggaggctgaagtcaaaggattgcttgaggccagatattcgagaccagcctgggcaacatagtgagaccctatttctagaaaaaatagataaataaaataaactacaggtcacgtggtggtatgcgcttgtggtctcagctacttgggcagctgaggtcacaagattgcttgagcccaggagtttgagcctacagttagacctatgattgcaccactgccctccagcctgggtgacagagcaagaccctgtctcaaaaaataaacaaaaaaaaaaaaaccctgctctatactgttctgtgtggtcctatgggagtcctcaaatgcagcagcgttgatattaacagctggcatttactgagcatttacttggtgcttggatttgttctaaacacttccacgtgttttaacttattttatccttgcagcagtcctgtgaggtaggagttaatatttccctcattttggagatacagaaactgaggcccggagaggttgagtcagttgccaaaagtcacacagctaatacatggcagcattggcattgaacaaggcagtctggctcaggagctcacgctgttatccactgtgctacgcagtatgtgagccatgtttgcaaatacacatgtatggtccatatgatatatacacagtaaatggatagtcttgacacatttgagtacttctgtatgccaggcacattgccaggtggggacttcacattccacagtgctccgaggtcagcgtcattgtcccattttacagatgaggaaactgagagattcagtgaccagtaggaggtcccatagctggtaagtggcagagatgggatttggcagcattggctccagagcctgttacttgagcccctgcctattgggtgtcttcccgattaaagaggccgagatggaagcctctctgttcctaggaagttgctgctctggaacacacagtgcgctcctgtggattgtttgagagaagcaccagtgtctcaggatctccaggaggtggctttgggaaaacccagcggtagcagagcacacatggactccttgagtctctcaatccctcccctcccctctccttgccattaggggaaaggactgtggcctacaaattataattgagggaaggtagagaacagagagggtgtggtattacctgaactcacacagcaacaacgtctgttccagagctgtgctgtctggtgcggtagtcacaagacacaggtggctattttaatttcagctgttaaaattaaataaacgttgggcgcagtagctcacgcctgtaaccccaacactttgagaggccaaggcgggtggatcgcttaatccaggggttcaagaccagcctgggcagcatggcaaaaccctgtttctacaaaaaatacaaaaattcgctgggcgtggtggcgcatgtctgtaatccctgctactcaggaggctgaggtgggaggattgcttgagcccaggaggtcgaggctgcagtgagccgtgatcacagccctgtactccatcctgggtgacaggatgagagagaccccatctcaaaagaaaaataaaattaaagatttattcgattagactagacacgtttcaagtgctcagtagccatcatttcagaaaattatctcagcactgttctaaaacagcgatccctagcctttttggcaccagggactggtttcatggaaatggtgggtggtgatttcgggatgaaactgttccaccttagatcatcaggcattagttagattatcagaagaagcgcacagtctaggtcccttgcatgcacggttcacaatagggttcgcactgctaggaggatctaatgccaccactgagctcacaggaggcagagctcaggcgctgatgctcaggaggtgaccaccactcacctcctgctgtggggcctggttcctaaccggtcatgagctgctgccaatctgtggccccggggttggggacccctggtctagaagaatatggcatggggattaagagcaggctgtctggattaaaatcccagttctgcttctgctaggcacagtatactaagggcaaaggcgttcacctatctggacttcagttttcttatctgtaagttgggtagtaatagaagttattcagagtcatcataaaaatcagttacatgtaaaacccagcacagtgcttagcacataggaagtaccctctgaataatagctgccattatcatcatcattattattactatttttttttttttgagacggagtctcattctgtcgcccatgttggagtggagtggacgcagtcttggctcactgcaacctccacctcccggattcaagcaattcccttgcctcagcctcccgagtagctgggattacaggcgccaaccaccacgcctggctaatttttgtatttttaggagagacggagtttcactgtgttggccaggctggtctcgatctcctgacctcaagtgatccacccacctcggcctcccaaagtgctgggattacaggtgtgagccaccatgcctggttcatcattattattattattagaagttgggagtccaggcctgcctcgtccacatggccactcctccctgcagtgcctggtcagctccctctctgcattgtggagttttaactccgagtgtctgcagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccaggtaaggggtgaggtcttagtgttcgggacaagccctactgtgcattatataccagtgttacctaaagccttgttttatcttaccatgtccccagtgtggtgcttttgaagcatgtagatttgtttttgtcagtttcgaatacctaaattgtttttttgctcacaataacaaaatgcactttttttgtggaatgcagttttttcctaagttttacttttccacctgtcaattcaaaaaggaaacaaaacctatcactataaagacaacttcattattaaaatttctttttttttcttgagacagagtctcgctctgtcacccaggctggagtgcagtggcacaatcttggcttactgcaacctccacctcccagttcaagtgattcccctgcctcagcctcctgagttaacaggtgcgcaccaccacggccggctaatttttgtatttttagtagagacagggtttcaccagtgttggccaggctggtctcaaactcctgagctcaggtgatccacccacctcgacctccccaagtgttgggattacagatgtgagccactgcgtccagcctaaaatttcttcaagtataaaattctttagttcttaagcctcctgcaggaggcaggaactaaacaaaaaacatgactaatagcagcctaaataagatagacgttttctttttctctgtcataatagaaatttagaggtaggctgttcagggctggtatggcagcttcatgagtttaatatcccagatacctgcttttatttaaaaatttaaaaaatcttaccatatttatacaagcctttcattctttctttctttcttttttttttttaatttgacatggagtctcgctctgtcgcccaggctggagtgcagtggcgcgatctcggctcactgcaagctccacctctcgggttcacaccattctcctgcctcagcctcccgagtagctgggactacaggcgcccgccactacgcccagctaattttttttgtattttcagtagagacaaggtttcaccatgttagccaggatggtctcaatctcctgacctcgtgattcgcctgcctcagcctcccaaagtgctgggattacaggcgtgagccactgcgcccggcccctttcattcttaagttggcctcatggtccaaggtggctgctggagctccagccattatatctatatttcagtcagtgagatcaaggaagggaagtagggcaagggagcatatgggtgctgaatcagcactactcccttatctgcaggcacacattctaagactcccccaatggatgccttaaactgcagatagtattgaatcctacatatcctgtttttttctgtacatacatacctatgataaagtttaatttataaatttggcataatagattaatagcagtaatttataataataaaatagaacaattataacaatatgccagtatcactacttctccacattagaggcgttatttttattacttttttttttgagacagagtttagctgtgtccttcaggctggagtgcagtgatggaatctcggctcactgcaacatctgcctcccgggttcaagtgattctcttgcctcagcctcccaagtagctgggattacaggcatgcgccacacccagctagtttttgtatttttagtagagacgaggtttcaccatgttggccaggctagtctcaaactcctgacgtcaagtgatccgcccgcctcagcctgccaaagtgctgggattacaggcattgacccactgagcccagccaggggcattattgagtaaattcggattacttacccataagcactgcagtacaatggccgtcagtctgataaccgatatggctattaagtgactaaactgacagggagggtctgcagcatggacctgctggacaaagggatgattcacaccgcggatgggactgggggggatttcatcacactactcagaagggtgcacaatttaaaacttacacattatttttggaccacagttgaccatggataaccgaaaccatgtgtgttagtttgtcctcatactgctatgaagaaatacccaatactgggtaatttattaaggaaagaggtttaattgactcacagttccgcatggctgaggaggccatggcagaaggagaagcaaacatgtccttcttcacatggcagtaggaagaagaatgagagcaccacgaagtcggggagcccccttataaaaccatcagatcttgtgagaactaactcactatcatgagggttgggggaaactgcccccacgattcagttatctccacctggtccctcccatgacacatggggattaagggaactacaattcaagatgaaatttgggtggggacacagccaaaccatataaccacggaaagtgcaaccttggattagagggacacctgtacatctaattgtccagaacttagtcatgggaccacctctattcacaagggaccctggaaagtgccgtgttttagctgggcacattgcacttcccagcaaaaactttcagttgggcctaggcacggtggctcacgcctgtaaccctacccctttgggaggccgaggcgcgtgtatcacctgaagtcaggagttcgagagcagcctgaccaatatggtgaaaccccacctctactaaaaatacaaaaattagccaggtgtggtggcatgtgcctatagtcccagctgctctgaaggctgagacaggagaattgcttgaacctgggaggtggaggttgcagtgagccaagattgcatcactgcaatccagcctgggcaacagagtgatactctgtctaaaaaaaaacagagaagtttctgttgggaaaggagaaattgtgtaggcagtcagtcgtctctgctgcatcccttctgcagaaacggttatatgttctttgttctttgaacacatgtggtttcttaggatatcgcaggatagataatgttttcaattgacaggtggagcatcttgctaagtgggagagctgagagtgcaacctcaagtctgtccaattccaaaactgctgttaccgctaaaggattaaccgcagcacaattgccagtagggatgggttgtttagatgggagcattccagctgcaaagcaaaacaagagtaagaaaccatgaggctcaccatatctcaaaccacgctgcacagctgttcaggtggcatccagggggccttggttcaatcatgtggcccctgcgccccaccacactgtggcccaatgattgatgagaacgaacagtgatggaatcagagagagtaggtccagttcctggagtctcgttatatcctcttgaaattggtgccagcttttttttttttttttttttcccctgcatttaccaaatatgttatctgtgttcatacgcaagctggaaaatttcctgaaagacccaaaaagaacaaaacaggccaaatgcagtgttgaaggcaacttaaatgtctgccaatagcaggaccttgggtacaccgtggagcaatgtggctttgagcagggataattagaagacgcagctgttggagcaccaaggatttttatttttcaacaacaaaggaaatgattttagcaaaggaccaagttctaggtgcactgtcgttatcaccgagatgaaatgcataatgtgtgtgggcaggactggaagggaggcagatacatgaaaacatcgtctttttaagggttgagattatagaatagttaattttttaatggcttttggctaaatttacatttatcctctcactaggcagtctcattcctaagtgtatattaaaaaaaaaaaaaaaaaaaaaagagcaaaggcagtgcttagaatgttctcagcatcttgattcataatcgcccaaactggaaacagctcaaatgtccattaacaggaccgtggagaaataaattgtgatataattatacaatttatggttgagtagtaaaaaggaatgaaatgctaatacacaacaatttgggtttatctcagagatgttatagtgatcaaaagaagccagacgaaaaagagtaggtactgtgagatttcatttatatgaagttcggtcgggtgcagtggctcatgcctttaatcccagccctttgggaggcctagacaggaggattgcttgggcccaggagttcgagaccagcctgagcaacatgggaaaacctggtctctacagaaaatacaaaaattagctgggtgtggtggcgtgaacctgtagtcccacctgcttgggaggctgagatggaagggtcacttgagcctcggaggcggaggttgcagtgagctgacattgtgccagtgcacttcagccttggtgacagggcgagttgtctgaaaaaaacatcagatcggcagggcaggtggatcacctgaggtcaggagtttgagaccagcctggccaacatggtgaaaccccatctctactaaaaatagaaaaattagccaggcacggtggtgggcgcctgcaattccagctacttaggaggctaaggcaggagaattgcttgaacctgggaggcagaggttgcaatgagccaagattgtgccactgcactccagccagggtgacagagcgagactgtcttaaaaaataaaataagatcattcctgaacaaatattcatctcaggttagatttttccagtaagtaaggttcagaggcagtggcaagtggaggaaagtgaacaggtaacacacttgagagcgatttgcatctggattgttcagaaagcaagctggtaagagaggaaggagatgtggtccagggtaagatggggcagatcacctgggccttcagccatgcagaggggtctggatttcatgggaggcggtgggaacagctggagaagaaattatatctgatccacattccaggaattggcagaacagctattctgagactgcgtggggttgtgcggtacctgggttcacttacatagcttctggggccccagaagactctccatctgtgggttgcaattaacgcccgtgccgccacccaggaagaagctgccaaccacagaggccttgtaaaagccacctgctgctattgatgctttttgttggactctgccccaaagcagcccagtacacctggcccagggcaggatgcagggaggccgagttcctagcaaccctttgttagttttcccagctctcctgtcgataagcaattgtaggcaccttgtggaatcaggaaccccgggctcaccagttccttttgcgtagatgagaaaaacctaggctaggagagcgcagtgtcctcacatggctggtgcagcctctgatccacagctccacaaagcttgcagaaggtggttggcttttgttctgaatctaacaagacttatcgggaggctcttggtgcctggcactggctgaatgcccaggttgggggaggcagagcagatgaagcatctgcccgcgagggtgggtggagctgcttgtgaaacgtatcatcgtagcccgggagctgggacactgaagcccggagaaggtgctcatggaggatgggaagggcttcccgaggaagtgacatctgtgctcccatctgctgggtgatgaggaatggcctggacgggatgggcatggtgggtggaggcaggcggcctgtgtgcagggaaggaaggggagagttacaggatgagatgagttgagggaagaagcatggttggcaactctaacagcgctgggaggccatcggaggggggtgacgagattgaccctatcctcatgggcatctcagctgggctgagtgtgctggaaccggccattgcatggacacagtcactcctgaggggatgtgatcaacaggcggaattctgtcacttaatgataacaatagtcaccagctaactgaatgcttactgttaggtcaaactatatgaaactgctaatacttatttcttatctacagaaacagctatttcctgtggttcaacctagtattaccaggcactgtgcttagtgacatcatgcatatctatatgatttatgaaataatgtgtccacgcaaatacacatcacatgtaagactgtaactcttacatgtcaccctcacaatgaccccgtgaagcaagctttgttttgtttcgtttgttttcttaataatattttatttttgtagagatggcattttgccatgtgcctgggctggtctcagactcctggcctcaagtgatctcccgcctctgcctcctgaagtgcgggtattacaagcatgagccaccccacctggccgagcaagccttgttgttcccattttacagataaggaaactgaggcttagagaagtaaagtgttagtcgtgtttatattgccagtcagtagttgagtcaggatttgaactgaggtctcgttgacctcaaagcctatgctgaaaaccacactgctggttccagaaaaccctagaggtgaaaggcttcagagaggcagtacagggtagaggttagcactttgcagcccagatggcctgggtttgaatcccagttctgccccttgctagccatgtgaccttggggaggagattaactagcttctttgtgccttagtctacccatcacatataggaatgagcacctcaggttttttgtgaggattgaatgaactgatgtttgtaaaactgcttagaacgatgcctggggctgtgggctttgtataagcgtgagctattattgtcactgtccttgtcattggtggtgctattcctgtggttcaccaggtgagtgggcacccctgtgagggcagcccggctctaacattttgcctcctggaggtatcggttacgtctagatgttctccagcacagccctgccctgggaggatggcaggagggaaccttcatcaactccccgcgtctgttctctaccccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtgggcatggtgggcctgcaggagcgggtggaggaggccgccttagcaccttgtctctttgcctcgatcttttcctcgcaccttgagctgggtataaagccaaaccccggccttgcagaaaggatggagaggcttgatgagcgcggaggacagatgaatcattaagagcagacagcggcactgtagacatgcagtgcccgcggcatttaagtgcagggacacagctcttctggagtcagaaagccctgcaagtgcttcccgttaactgtcatcctagtgatgcaagactgccagcgaccgactctgctattgagtatcttcataccgctgttcccgtctgggggtgatcatgcacccctgggtgatgtgtgtcagaagcaatttactaatactaagctaaaccatatgagattgtcatcttgtgggccagatgtcatggctcacgcctgtaatcccagtactttgggaggctgaggcaggaggatccattagattccaggccagcctgggcaacatagcaagacccccatctctcttaaaaaaaaaaaaaaaaaaaaaaagtagcccatcatggtggtgtgtgcctgtagtcctagcttctcgagaggctgaggctggaggatcgtttcagcccaggagttcaaagttgcattgagctatgattacaccactgcactccagcctgggtgacagagtgagaccctgtctctggaaaaacaaaaaaaggagatgggggtgggagattgacatcttgtggatcacagataatagcatcaatccaaaagaggcagaagtttgctaattatttgctgaatttagagaagtgtccctctcacccatttgcatccttatagacttttctgaaaaagtgacagcaccccagaggtgtcccataaccattagcccgtcttacacactctaatcccatagcgtaagtctgggtgggctaaccctgaatgattacagaccttgacttcccttcagaatttttagggagtttgtcacaatctggctgtgtctgtcggagtagtgaggatcagtcacttggttcataagggctgcaatggagaaaagatcaacaccccatcttcctagaatgctttatattttagaacattaaaataatagttctagtgctatatgatatcatacgaagcctagctttaaacaaataagatggccaggcgcggtggctcacatctgtaatcccagcactttgggatgccaaagtgggtggatcacctgaggtcaggagttcaagaccagcctggtcaacatggcaaaatcccatctatattaaaaatacaaaaaaattagccgggcatgatggtgggtgcctgtacttgggaggctgaggcaggagaatcacttgaacccaagaggcagaggttgcagtgagccaagaccgcaccattgcactccagcctgggcaacgagagcgaaactctatctgaagaaataatagaagagaagagaagaataaaataaaaagtaaaataaaatagttctgatggtacatgataccatactaaacctagctttaaacaaataagatgaccaggcacattggttgacacctgtaatctcagcactttgggtggccaaggcaggcgggtcacttgagcccagcagttcgagaccagcctgggcactctagggagaccctgtctctaaaaacaaaacaaaaaaccaaaaatttgccaggtgtggtggcatgggcctgtagtcgcagctactcaggctgaggcaggaggatcactggaacttggaaggttgaggcggcagtgagctgtgatcatgtcatccacactccagcctggatggcagagtaagaccccatctcaaaaaaacaaaatgacagaaaacatgatttctgtttctattttaaagggtaaaatagtatattttaacactttgaaatgaagagtctgggcttgggaacgttacaatgatgtttactcgtactagttacgcactcccctcccagatctgtctcgtaacaagagactgttattttctacttgtttttagccaaaaggccgagaaacgatggttattttaaatccctagtgtctcttacagttgatgtcttcttagtatttaggaatttccaggacatctttttgttgttgttaatgcactgtgtgtgtgtgtgtgtgtgtgtgtgtgtgtgtgattataggagtgacccactacgcccggctgtgtgtgtgtgtgtgtgtgtgtgtgtgtgtgtatgtgtgtgtgtgtgattataggagtgacccactacgcccggcctatgtgtatgtattttaaaggcttcaatgagaaaaaagttggttcttaaaaaggcaagcttcagattccagggaagattgcctctggagagctctgttttaatccatgggtttgccagattaatgaggatttactggcctcgtgccttcggccctccctaccctgcgcccattgtgcatgttttgaaaaagcagtgccaggaaggactctctctggaattactgcggagttacttgagttagcaaagaatccccttcctcccccaagagctgtaagccaagtctctgtagagctgactccatgcctgtttgtctgcctgtgtgtcttggcgcaggtggctggccgtgcggctggagtgtgtgggcaactgcatcgttctgtttgctgccctgtttgcggtgatctccaggcacagcctcagtgctggcttggtgggcctctcagtgtcttactcattgcaggtaagaggggatgctcttggctggattattaaagtctgttaatgggggagccagttgtccttggctttggattccagctccaacaggaatgggggagaggaacttgagaggtacggagtttgaggagcaggtacagtgccacagtgcctggtgaccaactagagcaggagacggatttgacatgtggccaggattttccccatcagtcacacagattccttagtggcccaagaggatacttccaggtacgaggggaatgcttttaaagctatgaatttccctctaagaactgctttagctgcatctcacaaatgatgatacattgtgttttcatattgtcacctggctaaaaatattttccagtttcttattatgtggcccatgagttattttggaaatgtgtgtgcttaggagatggcaatgtggcaggcctgggtgatggctatacctggggttgctaatttcggtacctttcttacctgaatgtttcataactcataaccttttatttttatttatttattttttttggagacggaatctcactctgtcacccaggctggaatgcagtggtgggatctcggctcactgcaacctctgcctcctgggttcaagtgattcttctgcctcagcctcccaaatagctgggtttacaggtgtgcgtcaccatgcctggctaatttttatatttttagtagtgactgatggggtttcgccacatcggccaggctggtctcaaacccctgacctcaggtgatctgaccgcctcagcctcccataattcatacttgttgaaaataatttgtttcctattatctcagtggaaaaaaagaaaaaggaaagtcaagtacgcccgcttactctagaaatgccacgtgactcttccactcacaggtcaccacgtacttgaactggctggttcggatgtcatctgaaatggaaaccaacatcgtggccgtggagaggctcaaggagtattcagagactgagaaggaggtaggcaagggcccctggctggacctcttggtctttggtgtagctttaccccaaggagatctctggaccctatcctgtgcacctctgcctctgagctggatacctcaccaggtagaagtgcatcttaacgcttgtccagtctttttgcagcacttatttagagcccggttttagggtgaaaatagtttaccggctttacccaagatctggggtatccatatacgagactgtgggatgctgtcagggcattcagaaggtattcacattgtgaagaagtttccccctctatttctctttcataacttctgatggtatcacagagaaagtcttagtctggggctagcaggtctttaacaccttagcaattgagatgatctcccttcaacagacagataaacagcagccctcacacttggagtcttcaacaggacggattctgtctatcagaaataaccttctgttatttgttatgaatttggtttttttgtgtgtgtgatggagtctcactgtcacccaggctggagtgcagtggcacaatctcggctcactgcaacctcctcctcccaggttcaagtaattctcctgcctcagcctcccaaatagttgggattacaggtgcctgtcatcatgcctggctaatttttgtatttttagtagagatgggggtttcactaagttggccagtctggtctcaaactcttgacctcaggtgatccgcctgcctcagcctcccaaagtgctgggattacaggcgtgagccactgcgcctggcctgttatgtatttgtataggggactcctgttacggaaaataatactacttttccttttgtgattgtaataaattttcctcttaagtaagttgagaaattaagtctaagtgacttgattaagcatattaaaacaacaagagaatgagtacatgcatactacacgaatgatgtagctgggaactgaccaaagtttgggaaaccctgccgttattgaaccccagtcccctttttatagatggagaaaaagggaacctggggagggacaacagctgatccaaggtcccacgtggcttggtagaacagctgggactaggacccgtgcctccagtctttgatgttgcgttgcccttaataactgccttcttaggccctgaacagcagcacaagtaggaacagcagtgataatagataatcacaataatgcctggcgacacccccaccctacattaatgataacagggacacacatagtgccttgtagaatgtcaggcccagacttaaacgtttaatatagagtaatgcactcagtctttaccccgctctatgactgatttttgagacacggtctcactcttgcccgggttggagtgtagtgcgatctcattcgctgcctcccaggctcaagtgattctcctacctctgcctcctgagtgtctgggaccacgggcatatgccatcacaccggactgatttttgtatttttagtagagacgggattttgcccagactcatcttgatctcctgagctctagtgatctgcctgccttggcctcccaaagtgctgggattacaagcgggagccaccatgcccagcccagccctataatttagatgctactattacccccattttacaggtgaggaaactgagacaaaaagctgaagttacttgcccaagatcacatggctggtaaatggcagacctaggcgttgagcctgtgcctcctcagagaccctatccagtgccatgggagtcatgctacccggcctcctgaggagagatgccccttgggagtgagaccaaggcctctgtaaggtctgtcctcctgaggaattcacagaggtgacctcggcccactcctttaacattctgactgggtgaaccaggtcccatgtcacgggtgagcattgtaagaatggcgtgagtgcccccgtgaggaaccaagggtgtattacaccggcggcttccaacttgacactgaatttaattcacttacaaggtatttcattaggttttttttttttttttttttagatggaatttggctttttttttgcccaggctggaatgcagtggcacgatctcagctcactgcaacctccacctcctgggttcaagtgattctcctgcctcagcctcccaattagctgggattacaagtacccaccaccccgcccagctaacttatttcattagtttttataatagcctcattgacatgtgaatttcacatgccatggaattcacccagttaaagcgttcagttagattgaattcagttttttttttgtttgtttgagacttaagtctcgctccagcctggagtgcagtggcatgatctcagctcactgcaacctccttctcctgggttcaagcgattcccagcctcctgagtagctgggattacaggcgatttttgtatttttagtagagaagggatttcaccatgttggcccggctggtctcgaactcctgacctcgtgatccacccgcctcagcctcccaaagtgctgggatcacaggtgtgagccaccacacccggcctgagttcagtttttaaaagcattttacttttgactgacttttatatttttagaaggatcgtgtttgacaaacccaagagaaagtaattgtcctcattagtcctaccactattctgtatttgcatgtatttttatatatagatagaaagttccacatacttctctccattccgctcactgtgttgttatagcatctccccttcaattatgtacataaattataaaatagagatacacttgttgttttaaaaaagaaaaaatcaatacagggctggacacagtggcccacgcctgcaatcccagcactttgagaggccaaggtgggtggatcacttgaagccaggagttcgagaccagcctggccaacggtgaatcccgtctctactaaaaatacaaaaattagttggcatggtggcaggtgcctataattccagctacttgggaggctgaggtgggaggatcgctggaacccgggaggtggaggttgcagtgagctgaagaaacatcactgcactccagcctgggtgacagagtgagactctgtctcgaaaaacaaaaaaacaaagaagtttatggtggagaaagacagtttgttcctgttcgccccgttcctctcctctccagagagaggccccattagcattcgggtgaatttcccccaaaactttcccgtgtggattcccacataccccaacacttttgtttgcttgtttctttttcttttaacgtaagtggaatctacctgttatcctgtgaaaccttttctttaaccatgaggcacctttgcatctgtgtatagtaacagtcactgcctctaagggctgctgtgaggctcagatgagatcatgggtctcaagtgctgagcagagcaacttgccttagttgcattgtaagcgctcaataataacatttattttttggccaggcgcggtggctcacgcctgtaatcccagcactttgggaggccaaggcagatggatcacttgagcccaggagtttgagacgatcctgggcaacatggtgagacatcgtctctacaaaataaaaaataatactttttgttgttggcggtggtggtggggtttttttttgtttttttttttttgagacagaggagtcttgctgtgtcacccagactggagtgtagtggttttatcttggctcactgcaacctctgcctcccagattctagtgatcgtcgtgtctcaacctcccaagtagctgagattacaggctcccaccatcaggcccagctaatttttgtatttttagtagagccagggtttcaccatgttggtcaggctggtctcaaactcctgacctcaagtgttctgcccacctcggcctccctaagtgctgggattacaggtgtgagccactgcgccggcaacgctgtgattttatagcacgtccacaaaagggctgcatgtcttgcctaaaagttgcccggcgttttcttgttatgtgccgtctgcagtgcccctgagcttggccatgtgctctgcagcctggttcagcacctgtgtgtgccctggacggggaggtgcattccccgaggctaaaaccagtgaacctggcccaggccatatccagctgtgggcctcaggaaatgctgaactgaactacttttcaaaaggagggttgtgtgtccctgggcaagttaccgcccctctctgtgtctcagtctccttgtgtgtaaactggggataatgaaaggaccctcccacatggggttgctgtgaggattggatgagacactgcgatacagatgctgcttttatccttgccttcctgccggggtgggcagccagggtaactcacttttattgtcgtgtctgtccagagaagaccactcatttcattgactccatttataaatatttatttaaatttttttttatcaaaaagtaagttttattggcatctaaaaacaaaattcacccaacactgaaacatacttcaatatttatgttattgttttcttgtttcttttttactcactgcagtgtgaggaacaaatcacatttactttggagaaacagagaccatagtgtagattttacaaaatcactttttaaactctctgtattgcgctcctcaaatacctagagccagtctgtgcataacatggcacactgttgtctaaaccgtaaaattttgcatcagcctaaagatatggataagatatacctccacttgctcttttgaaatacatctattaccttatccagcctaatgatagttacctaaaaaattctttgttccgtaggaagtctctgacaagctgttattcatttccttgacgttaaaagaatctgggggcaacatttatattttatcagaaaaactttttaaaagtttacctatcatgttcatattgagaacaatgtctgtggcgggcatggtggctcacgcctgtaatcccagcactttgggaggtagaggtgggtggatcatgaggtcaggagttagagaccagcctggccaacatggtgaaaccacatctctactaaaaatacaaaaattagctgggtgtggtggcgggtgtctgtaatcccagctactcaggaggctgaggcaggagagtcgcttgaacctgggaggcaggggttgcagtgagctgagatcatgccattgcactccagcctgggcgacagagtgagactccatctcaaaaaaaaaagaacaatgtctatacaaatcagttgtacaattattttaaaagaatggtgagcatgaacgtcacgttaattctggcagacaaaaatgaacaactatggtccattgagccattatctgttacacagagatgacagctttacagaaggtatctctgacctactgagggatgatcatgtcctctcagtttctgtgccttctaccactagttcactttctatatcagcagctgtgtcactcttcttgtttatgttcataaatgtgtgttgaacacctactatgtgctctgagccctgggatacagcagtgaacaattagagcctgtcctcattgagtggatggtgcagtgggtgtgggagacagaatacactcaagcatgcgagccccaagagggctggggacaggcagtgccctgaaggagaaggcagtgcgggaggggacagagggacacagggctgagagggtgctctgtatcgaccagagatccacaggatgcaagggggtcatttggggaataacattccaggaagggcaaccccccagtgctgaggcctgggaggccaccttgggcagcagagtgagtgagaggggaggtcaggggagtcacagctttaccagatggactggaaattccttactctctcccttcactgcgatcgaaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtgggtacacatcgccccattccctcacccattcccagtcgggcacagggtgccatcgggcaggtgaacctagctgcagcgtctccccagtcactcacggctccacacctttgcttgaatggctttttggggggctgggagtggactgtggcagtaaaagctgttcagagcgcatacagcttgcagaagtgaaggcttttaggtgaactgacagcctgaagaccaaatgagccccacagatttgttttggaagattttttgttgttgttgttgagagagggtcttgctctgttacccaggctagagtgcagtggtgtgatctcagcccactgcagcggcagcctcccaagtggggggactacacatggttgggagtgcaggtgtgtgccactgcacctggctaatttttgtattttttgtagagatgggggtcctactatgttgtccaggctgatctggaactcttgagctcaaccggtctgcccgcctcagcttcccaaagtgctgggattacaggaatcagccaccattcctggcccctggaagaagttctttttttgttttttggttggttgtttttttttttttttttttttttttttttgagatggagtcttactctgttgccaaggccagagtgcaggggcccgatctcagctcactgcaacttctgcctcctgggttcaagtgattctcctgccttagcctcccgagtagctgggactacaggcatgcgccaccatgcctagctaatttttgtgttattagtagagatggggttttgccatgttggccagggtggtcttgaactcctgacctcaactgatccacccgcctcagcctccccaagtgctgggattacaggtgtgagccactgcacctggcctggaagaaatttgaataagttgcaaatactgaaaaatctggaagacttaatataaaaatttattttctgctttttttggaagatcagaacatctggcaacatcaggtcaatcctcccccgcctggctctttctagtcaacctgtgagcctcctggttcaccccagtccctccctgtcccattcattgcctagttggcccctccaaaacattagaatttgtgatctctagaataaggtgtcaccatcccttctagggggatggctcaagggaagtgagaaattgtcagaattttggaaccttctcttggttccgagctgttcttggaagaggttccttgacctgagtgatacccttagactttcctctggaattggtctgacagtcttcctggccatttgctgggggacaaggctgctttcacctctgaacatatggacttattgaactgttcctacgtacctcccacaaagctcagaacattctgttcccagcagataatttctctctgagttacagagaagagcagagtgggtgatgttcttgctgtctttttttgtttttgtttttgtttttgtttttgttttgttttgttttgttttgagacagcctctcactctgtcacccaggctggagtccagtggtgctatttcggctcactgcaacctccgtcccctgggttcaagtgattctcctgcctccgtctcccgagtatctgggactacaggtgcatgccaccacgcccagctaatttttgtagttttagtagagatggggttttaccatgttggccaggctggtctcgaactcctgaccttctctgatccaccttcctcggcctcccaaagtgctgggactacaggcatgagccaccgtgccccagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtgtgaaaaacagtggggaaatgaggaaatgcctgattattacttaatagtttcttgagtctaaacaaatagggctttgttggaaattccttctgcctcttctgtatctcttttgaggtctctagtaacttataaaaagccgagtcattccttttgggagcctggcaaagggaagagagtccttcttgaccttcggccgaaacacccttaaaggagtgtctctgggcagcgcgcaagggagagggctgtcgagttgggttgaccagatgactgatgcctgaggtggggccgagatgagggcactttggggcagggacaagtccggatgccagcattcccaccacacctgggcccttctgtcctgcaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggtggggtctgggtgtggcccagggggtgagccagagctggcaagccctatgattgcactgacagtggtgtatgtatatttttggggcaaacatacatttggccctacttcatcgttcttttttttttttttttttttttttttcctgaaacagggtctcgctctgttgcccagagtggagtgcgctggcgcaatctcagctcactgcaacctccgtctcccaggctcaagcgattctcccaccccagcctcctgagtagctgggactacaggcacatgccaccacacccagctaaatttgttttgtacttttttgtggagatggggttccactgtgttgcccaggctgcccttgaactcctgggctcaagcaatccacccaccttggcctccaaaagtgctgggattacaggcatgaggcaccgtggctggccttcattgtttttattgaagttaggctgtgctgctgcttccctgaatttcctcttagtatatgattaacaacgtgggaattaactgactatcagtcccgacttcctgtccccgggaggggtagtttcagagcatctagaaaaatccaaaaagacaccgtcttctctctctgctgccagagtcagactgagcatctctaacccttccaagagctagacaagaaataagactttttaattttcgattcacggggtgcacctgcaggcttgttacgtgggtatattgtgtgatgctgatgcttcggcttctatggatctcatcacccaactattgaacagagtacccgagagagagtagtttctcaaccattaccctcctccatctgtccccacttatggaggctccagtgtctatcatttccatctttacaaccatgagtacccagagtttagctccctcttacaagtgagaacacacagtatttggtgagaaataaggattttctttttctttctcttttcttttttttctttttttaactgagacggagtctcactctgtcacccagtgcagtggcacgatctcagcttactgcaacctgcacctcctgggttcaagcgattcttctgcctcagcttcccaagtagctgggattataggcacgcaccaccatgcgtggctagtttttgtatttttagtagaaacggggtttcaccatgttacccaggctggtctcaaactcctgacctcgagtgatctgcctgcctcggcctcccatagtgctgggattacaggggtgagccaacatgcttggctgaaataaggattttctagaccaatccccgcaggtggattccttaatatgttgccttttagtgtaatcttccctaaagtgtcttagaagattctcttctgtggttggatgacgggagaatccacgggactttactgttaggaatcacctgtgctgcgtctcatttctggaggttctcaacccacttgcatattgaaggctccaggaagttgtatggaaaggaaatctgttgtattctgccaaactcagactttccagacttttttttttttttccattattaaggcaattttttttttggagatagagtcttgctctggagtgcagtggcacaatcttggctcactgcaacttccgtctcccgggttcaagtgattctcctgcctcagtctcctgagtagctgggactacaggtatgcaccaccatgcccagctaatttttgtatttttactagagacagggtgttgccatgttggccaggctggtctcgaactcctgaccttaagtgatccactcgcctcggcctgccaaagtgctgggattacaggcgtgaaccaccgtacctggcctttttctccattattaacatctccagaaatagtgattccaaggagctctgataccccaccttcaacagtcctggccagaagtccttaggtcgcctccatccatgtcagcgtgacacaggtgtcacatgccgtccactctcttctctctgaacaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcaggtaggcgggggtgaacaaggagacaccgggtaaggtgtcctaggcgccatctcggtaggggtgtttgaagattctgtccagatctgtgtcacctggatttgagtcccagatgaccatttgtcccttcacctcttggagcctcagtttctgtatctgtaaaacgggtctcaatccaggctctttgtaccatgaggtagaataaccaggatgaccagtacatttccttttatacacaccagctccattcagttgatagtggctgtcagttgttaagctatggaaagtcttctgtaccagttggtcactagcactgctctgagcccccaggtccccatgcactaccccagctgtcttggtctctaccaggatcctggagctctgtccatgacccagcaactaaagcattaatgcctggcacaccagcggaacctctggggtcctgctttggtggtgtttgttagtgcctggttctggttctgttatccgtctccatgacaaccaaccataaagcctcaggcatgttcaaccataaagcaacgatcattgctgccatacgagggcagtcagccaggtggctctgctgatctcggctgggctcacatgcatgtctgggagtcagctggctgttggctgatctcggggtcagctggcttttggcctcaggtggggcaagaagggtatgttccgtgcatccctcattctccagcagaccagcttgggcatgttgtcatggcgatggcaggggcacaagagcgtgcaagcccctattgcatctaacagtattcttttggctgtccttacttttgctggtgtcccattggccaaagcaaggaacatgtctgattccagagccacctctcatggccccacagttggataagggatgcatgggtatgaggccttttttttttttttttttttttttttttgagacggagggtctcactctatcacccaggctggagtgcagtggcgcaatctcatctgcaacctccgcccccaggctcaagcaattgttctgcctctgcctcctaagtagctgggatgacaggtgcctgtcaccatgcccagttaaattttgcatttttagtagagatggggtatcaccacattgtccaggctagtctcaaactcctggcctcaagcgatccacccgccttagcctcacaaggtgctgggatactaggtgtgagccactgtgcccggctcttattttttttttattttattttttttaagagacagtgtctcactctgttgcctaggctggagtacagtggattgatctcggactctaactcctggactcaagcaatcctgcctcagcctcccagtaactgggactacaagagcatgccaccacacccagctaatttgtttatttttgtttttggagagatgggggtcttgcttttttgcccaggctggtctcaaattcctggcttcaagctatcctcccacctcagcctcccaaagtgctcagattgtaggtgtgagctgctgttttgagaatgattctgaacctgcatcttgctgaataggagatgtgctctgattgattagtgatgtctgctgcagacacagatgttgggagtggacatgctttcctggtcaagcaacatagagtgtctcctttcgcttctcccagcctgggcctaggttcagggtcaggggtggtttgacccaacactatctcctggtttttttcttccggtcaagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaaggtgatgccactggcacagtggcctctaggctttgggagtttgccttactcactggctcactcattaattcattaattcattcaacactgtccttatccctagtgacagccccagtgggtggatcctctcttcatcctggatggtaccagctatttctttttttttttttttttttgagacagagtctcgcttcatctctggagtgcagtggtgtgatctcggctcactgcaacctctgcctctggggttcaagcatttctcctgcctcagactcccgaatagctggaactacaggaatgtgccaccacgcccatctaacttttatatttttagtagtgacagggttttgccatgttggccaggctggtctcgaactcctgacctcaggcgatctgcccgcctccgcctcccaaattgctgggattacaggcatgaaccgctgtgcccagtggtaccaggtatttctaatatcatctagtcattcattcacgtcagcgcacctgcggtgttcccagacactggggactctgtaggctgctgtcagacaaagtccctgcctccaggaccaagtagcttattagatggaggagacaaaaaatatacagagcaataaaccaacaggattccagagggcagcaggtgctgggaaggacgcttgccaaggagacgggatagcgagtgctgggcagggccactgtttccattgaacactgcaggcccagtgcgtggggcccacaaaaaggttttattttttttaaaaaatcagaagcaggccaggtgcggtggctcacggctgtaatcccagcactttgggaggccgaggcaggcagatcacctgaggtcgatagtttgagaccagcttggccaacacggtgagaccctgtcaccattaaaaatacaaaaagtagccaagtgtggtggtgcgtgcccataatcccaggtacttgggaggctgaggaaggagaattgcttgaacctgggaggtggaggttgcagtgagctgagattgtgccactgcagtccagcctgggcaacagagtgagactccatctcaaaaaaaaaaaaaaaaaaaaaaagaatataatccaacctggattttatttatactaacacagtcataaaatagaatttctagcattttgtgtggagaaagccacctccgtaggcatcagtgccggggaccacaaaagtcagaatgctgccatagtgccagggtcctggggggttttgagttttgtgtgggtcatctctgaagaggtgacattttagctgagacctgaacaatgaaaaggagtcagccttgagaagatctgggacagcgatctgcaaccttgttcttaagggccggggtagtttcagctttgtgggccacatggcctctcagccacttgactccagtgttgccgtgtgaaagcagtcatagatagtgcacgaatgaatgagcatggctatgttccaataaaactttattcataaaaacaggcaaggggtcagatttggcctgcaggccacagtttgccaaccttggatctaaaggaagaacattctaggcagccggtacagccgaatgtaaaaatgaatgcgcttaatgaatttgaaggctagcatgaggaggccatgtacctagaggttggaattgagtggacaggggcaggagattaggccagaaaggtaggcaggggctggatcttagagcaccatgtaaccacggtgagaagcttggaacttactctaagagccctataaagccattggaaggttttaagcagggaagtgacatgagtttctattttattttatatatttttgagacagggtctcaccctgtcgcccaggctggagtgcagtggtgggatcacagctcactgcggcctcaagtgatcctcctgcctcagccttccaaagtgctgggattataggcgtgagtctctgcacccagctgacatgatgtttctagttcactgagtaccacctactaagtggcagatgctgagttggtgcttttgaaatataggacatagaaatgaggacagaagtgggcagtgtcaaatcttacaggacctaaaatattaggggtcagccaactatggcccacaggccacagatctggccccctgcgtgtttttatgaataaagttttattggcacgcagccacatctgttcattttcctgttgtctctggcagctttcacactataaatacagcagagatgcgtagttgtaacagaaagcatatggcctgcagagcctcaagtatttactatctggcctttttcagaaaaatgttgccaatcgttattgtagactgtggtaagatctttttattttactctgaatgtaatggaacagtgaatgtgaacagtcaacactgttaataccattcacaccatgattgatgtggggtagatattaaggagctggcctcatgggaatctgacattgactagaaatagggattgagggtgagcaaccagctggaaggtactgcaccagtcctagcaaaaagtgttaggggcctgacccgaagcagtgacttgcccaggtcagttgtcccaggggcacgaggtgctcacccctccccttcccctcatgtctgtatcccctctccctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaatggttccctttcctttggggcctcggcgagggttccagccatgtcctctgcagggtcaggatgtggcatcttcctgtttctgttctttccttttgacaacaagtcgcctctagtgggagctgttgccagaaagggcaagttgtagagatcactagtcagatggggtttagtgggaaggcgggacagccgcaaggtggacggagcccaggttttggggttggacagaccctggcttgagtcctgctcttgtcatttgctgttcttgtgaccctggggaagtcactcagcctctgtgcctcacttgctttgtctgtaaaatgaggctgatcgtacttaccctgtgagcagtgatgtgtgcggtactcgtagcctcggtcaggttctaagacacaggcgaggcagaaatcacatgtggccagaacgatccttgaaaatcctgccctccccctgcccttttttttttttttttttttgctagaggcacggtctcactctgttgcccaggctggtgtgcagtggcacgatcatagctcactgcagcctcaaactcctgggcttacgcaatcttcctgcctcagcctcctgggtagctgggactacaggcatgtgcccagctaatttttaaaaatttttatagagtcagggtcttgctatgttacccaggttgttcttaaactcctgggctctggggatcctcctgcctgagcctcccaaagtgctggggttcaggcacctggcctgaaaatccctttatgttagtccagagaggcgaggctgcgctgcagtaacaaattcgccgtaaaatcttcggaaatgatcacaaggctttatttcttgctcacgcagttcttggtgagggtcagctgcctctccagggtaggtgacttccctgtgacaagtgatccaggctgtcctggttttgtgacatggcctcccaagggttggcctccaggtccccacagtgggagaagggagagtggacgactctcacccactcttctgtgtctgaaaccggaactgacgcagttaatcccactcacagcccattggccaaaatgagtcacatggccccaacccaaccactgcgggagctgggaaatggagcggtgcctgtggaagagaaggatttctccctttcctaactgatgtggttctggagttttggatagcggagtagtcagactagtgtgttcggtttctaacttcgaactgggtgagtctgggcagtaaggaatgtctgtatttggggagcacaccatttctgccacacctaaaaccatgcaccaagtacatgtgcagatagaacgttctagcactgccattgttccctcaagctttcctgtcccctgattgaaattgttggcttgcactagggactgtggtgtacaaaggtgctcagggaagagccggcgaggtggtgaccattagaatgagtagtagtgtctgggtgcagtgactcatgccccattgaaactgttggcttgcattagggactgcagagtgtgaaggtgcctagtgaaaagccagtaaggtcataaccattagaataggtagtatcagccagccgggcatggtggctcatgcctgaatgatgtcattggcttgcattaggaaccacagagtatgaaggtgcccagtgaaaaactggtgacgttgtgactattagaattagcagtattggctagacgaggtggctcatgcctgtaatcccagcactttgagaggctgagacaggaggactgcttgagctgaagagttcaaaaccagcctaggcaacatagtggaactctttctatataaaaactttttttttgttaaattagaagtagttgaggctgggtgcagtggctgacgcctgtaatcccaggactttgggaggctgaggcgggtggattgcctgaggtcaggagttcaagaccagcctgatcaacatggtgaaaccccgtctctactaaaaacacaaaaattagttgggcatggtggcacatgcctgtagtcccagctactggggaggctgacaggagaattgcttgaatgtgggagataaaggttgcagtgggctgaaatcaagtcattgcactccagcctgggcaacagagcaagccgagactccatttcaaaagagtagtagttggatctaccagcgggaatcttaatagggatgtgagatgtgtttagatctcaaagcctgaccctgagtcttaaaatcccaggtcagatcctaagcagtcccagagagctccacctggtgtgcatctgtgccagtgtcttggggtggggcagctgcatgctcaggtggaatccggggctgagttcaagtttaatccactttatgaagaggaggcagagtgaggcataactcctcatccaggggagtggaagtactgtggaaggaagctctgttttgtacctactacgtgctggccctggcctcactgtgcagaactctccacattggaaaggatccccccagaccagagaggcgtaaggagggggctggtgctttccagtgttgaactgttcatctgtcctcacacccaccatcgggtcctacagcaaatttgtttgattttctgcaaaacacccagaatctatccactccccgtcctcccattgccaccacgctggtcccagccaccccactttctccctgcatccctacaacagctgccacagtggtctcgaggcttttgcccccagccccccacacacacatcagtgtcctcaacctggtggctgtagtgaccttatgaaaacacgcactggccgggcacggtggctcacgcctgtcatcccagcactttgggaggccgaggcaggcagatcacctgaggtcaggagttcgagaccagcctggccaacatggtgaaatcctgtctctactaaaaatacaaaaattagccaggtgtggtggcgagtgcctgtaattccagctacttgggagactgaggcataagaattgcttgaactgggaggtggaggttgcagtgagccaagatcacgccactgcactccagcctgggtgacagagtgagtgactgatggtgaggacacgggctctgaagccacactgcttgggcagagatgccactcattctgtttgttttctcatctgtcaaaagggcctgatggtagtaccttcctcatcaaaacgttccagtaaggggcccagtgaggtggcttcctcctctggtccactgaatgcgtgcgtggcgggcatttaaagcagtgtcaggtatacgtagttacgtgtttgcagtggcgaggtggactgttgagttttaaagagtctactgggcgcaggcactgaccagagaggaagtctgcagccttgatggatgaaattcgtgttccacccaccagccagaccctactggcagcagcccatggcgggggtattaatggcctgggcatcccctctggcgcgtctccagactgccgtggtgtgggcccaacagcagtctcgttagcaggctggcaggtgccggttcccacgtgctggccgcctgtggcccaccctctgctccctggcacacagcctaggaaagagagtctggtggccctgggtcatccccagctgagtttgccaaatgcccacatggcagcccctgcctagggtcactctgcaaggcaggtggctcagctccagccagagaagacaggctgcatctgccgcccttcctttctctaaaggacaaatgtgtcctgtgcaatgactttggtattacacccagaaacagatccccactctgtccttactgactgggtcaacttggcaagtcatgtcaaccccttgagcctcagtttcctcacctgtgaaatggagctaggaataggtagttgtgggtccacagctttgcaggcatgactaggggcaggtcaagaatgcggacttcctgccccactttgaaggtggtagaagctgcagttagaagtttactccaggccaaaaggggcatcacaaaacctgtgaggatgggccatcagaaagtcccatgacctgatgggcggagcaggccctgtgtccttaagaaaaggtggagttcttgccctgccacccctgacaccagcaaagccactgctcaagtatctgtggatgatggatggcagcggggcaggttagaccggggattctcaaccaagtgggtctttttgttttgtgttttttcagacagtcttgctctgtcacccagcctggagtgcagtggtgtgatcttggctcactgcaaccttctctgcctgggttcaggcgattctcctgcctcagccttcagagtagctgggattataggcacctgctaccacacccggctaatttttgtatgtctggtagagccaggggttcaccttgttgtccaggctggtctcgaactcctgacctcaagtgattcacctgcctccgcctcccaaagcactgggattacaggcatgagccactgcacccggcccaactaggtggctttgaccccctgggggattaatggcagtgtcacaagtctggtggcggtagaaggaggatgttattggcatctagtgaagaagaggccaggggcgctgctgaacgtcctacgatgtgcaggacatgtccccacagcacagaactatctggccccacgtgtcaataaggttcagaaagcctgggggattgccttctgtgcttccacgaacacatatccatgtattatgtcattcttgcggcaatgccacgaggtcagtgagactccctgactagcatacataatgttaggatctagggagttgtctaatgtctcacgctgcccttcccagcgatctatgtgtggccttaggcttggctactttagacttagtccctcttttccggtgcctgcagctggtttggtgagtccagtattaatatactgaccgctgtcagaaagaggagtgaggaggctgggcatgatggttcacgcctgtaatcccagcacttttggaggccgaggtgggcagatcacctgaggtcaggagttcaagaccaacctggccaacatggtgaaaccccgtctctagtaaaaatacaaaaataattagccaggtgtggtggtgggtgcctataatcccagctacccggcaggctgtagcaggagaatcgcttgaacctgggaggcagaggttgcagtgagccgagatcttgccactgcactttagcctaggtgacagagtaagactctgtctcaaaaaacaaaaaaagaaatgtgtgaggaatgcaacaagctgtgcattgaccacccttggttacagcaagttctccacgctcagccgggtccagcctttggctgtcagcagcatctggagcggaactgtgaacagaaacactccaggtgttccgacgggtgctggggcgcccccagggagctggaatttggtttttagcaaccacatataggaaatgaacccgccagccacagtatctcacgcctgtaatcccagcactttgggaagctaaggccagcggatcacctgaggtcaggagtttgagaccagcctggccaacatggtgaaaccccgtctctactaaaaatacaaaaatcagctgggcgtggtggtgggcgcctgtaatcccagctgctccagaggctgaggtgggagaatcgcttgagcccgggaggtggaggttgcagtgagtcaagattgcacccctgcactccggcttgggtgacagagtgagactttgtctcggacaaaaaaaaaaaaaaaaaaaaaaagaaccaagtcctcgggcaaattctcccattgagggctgtgaagtcttggctcctctgttgtttgttttggaaaccaaacttgcatatttgactttctcatgcgtggagaggacccatgcttggcatgggggggcacctggtttttgtgtccttggagctcatctctggtgggggaggaggagcagcaggagatgcgagggctgtagttctcagtcctggccgcacattggaatcctatgggggagctttaaaattatacaccaaactcggccaggtgcggtagctcacgcctgttatcccaacactttgggaggccgaggagggtggatcacatgaggccaggagttcaagaccagcctggccaatatgctgaaacctcgtatctaataaaaattacacaagttagccaggcatggtggcgcacgcctgtaatctcagctgcacgggaggctgaggcaggagaattgcttgaacccaggatgtggaggttgcagtgagctgagattgagccactgcactccagcctgagcaacagagtgagactctgtctcaaaaaaaaaaaaaaaaaaaatacacacacacacacacacacacacacacacaactggagaacagagcatggtcactgggggcaggagcgagagtgatgggtgtggtcggaaaatggtggtggctattccgtatcctcaccctggtgtggattcatgagcctacatgtgtgataaaactgcatgggacaaaataaacacacacacacacaggagtacaggtaaaacgggaaatcgagcaagattgttgtgtcaatgtcaacaccctggctgtgatgctttatcctagagttttgcaagatgttaccattgggtgaaatggggtaccaagtacacgaatctctctatattattgtttctttaactgcatgtgagtctgggattatcccaaaataaaagtgttaatttgtaaaaagtacacacagcatggcagttcccagcctcagagattctgatttaagggtctagccgggagcctgggcatgtgcttgaggcccccaggtgagtccagagtacagcggggctgagagtcgctgttgacattggctgcagggtggacagggcgagatgggccctgcccgggcagacctgtgtattgctaggtccttccggctctgatgctctgtgataattggccactttctctgccattttcctcccagagagcaaacacaggtctagactcaatatcgtgtggagctatcgatgaccacgggtcacttccatctccagcactgcaggctgtgcgggctggtccaactggggtacggttgagggtcctggctcagaccaggcctgactcctgggccagtctgtaaaacaggcccttctgggccagcagctgggccgggctgccgctctctgccacctgccccttgtccatgaccagaaccctgtgggggagagggagacagagaggctctttggacaccagcccaggctctcggcagctgtgagagcccagtgtgtctgcgctgaggttttctccatagaagtcctgctttccatgcggctccctggccctcacagctgggttggaagcgtgtgctgggcgcatgtccttgggcagctttcccacttggcatgtgttcccgggcattcctcccgctctggccccattcaggacccctccagctctaacccgaagcccagtggcccaggactgcctccgcctccttcccccaccactgcagggctgctgtgaggtcaggccggggcgggagccttaccgggcacagtccatcacggagcgcaggcggtgggcaatgagcagcacagtgcactgtgcaaaccagctcccgagcatggcctgcatctgcagctccgtgccagggtccacggcagcagtagcctcgtccaggatgaggatctgggtcttccggagaagggcacgtgccagacacaggagctgtttctggcccacgctgggaacgattgggacaattagctgggacgtgcgtttgtcggcacatggtgatgtgtgggtgtgcccagaaacaggtccctgaagcagtgcaggagtgaggtgcctgtgttcaggcatccccacacatggggtctggggtctgtggtctgcagaactgataggaagcctgttcctgccatctttgagcaggctgactgtaggcaggtcattcaaaccctttgtgcctcagtttccccacctgtgaaatggctattttcttttttctgtttatggctctttttttcttcttcgtttttctttttttttttgagacggagtcttgctctgccacccaggctggcgtgcaatggcacaatctcagctcgctgcaacttctgcctcccggttcaagcagttttcctgcctcagcctcccaagtagctggaattacagtcatgcgccaccatgcctggcttttgtatttttaaagtagagatggggtttcaccatgttggtccgacttgtttgaaactctcaggtgatccacctacctcagcctcccaaagtgctgggattacaggcgtgagccactgcgccccggtagttctatttctagtttgttttttgagaaatcatcatactattttccatagtgactgtactaatttatatttcccccaacagcgaaagcacagctttcacttcagtcatgccgttgcaaacaaacctacaatgactgactgctgcttcaagaatcaaatctacagtcttcctaagacattcaaggctggtgtcacgtgggccttaaatacagatgtgtacaacacctgggtgggattccaggcgtgatccaccgtgcctggcctgtttatggctatgtccagttctatttctagtttccaccttgtgccaaacacattctaagtgcttgtatatattcactcaatcctcataatgtccaccaaggtagatattattgttctcttcttttgagagaagaggacacagatacagagaagctcagtggcttgaccaaggtctcaaggctagtggtgggtccataatttgaacccaagtcctctgaccccagagtctgtgctcctaatggatccgtcctcgctgaatcgtgacgacatggcacataaaagtgtgtgggtggcggggcacggcggctcacacctgtaatcccagcactttgggaggctgaggtgggcggatcacgagatcaggagatcgagaccatcctggctaacacggtgaaaccctgtatgtactaaaaatacaaaaaattagccgggcgtggtggcgggcgcttgtagtcccaggtactcaggaggctgaggcagaagaatggtgtgaacccgggaggcagagcttgcaagtgagccaagatcgcgccactgcactccagcctgggcgacagagcaagactctgtctcaaaaaaaaaaaaaaaaaaaaaaagtgtgtaggcttgtcacagaataagcccttggcatggagtagcacccttcgtggagggtggaggagttgagattccaggttgtgagcccagtgagcccctgacccaggtgggaactgacccctggggccccagcatggctgtcttgcacagtaagcccttccatgaaacagcatccttttacatgatcagaacctactatggtcatgcaggcgttagagtgcctgggtcttgtcccaacctcactacttttaagctgtgtgacgtcaggcaagccccaggcctccaattccaactctgtgaaatgatgttatcaggagtgtgactcaggactaaaatgagtatttactctttgctctatgcctgccactgtttcaacaactttgtgcatataattcaatccttgcaaggtaggtaggtgctattattcccaccttacagatgaggaaactgaggcacacaagataagttgcctaagatcctacagctagtaagtggcagggcggggcgggggtgggggtgtggggtggggggcctggatttgagcccaggcagtctgtcacctgtgtatactcttacccaccaagcaacgctgcctctctagtgctggaaattattgcctaccacaagcccttcggacaccctcagggtcagaggggtttataaatccagaacaccttaggtttttttttgttttttttgagacggagtcttactctgtcacccaggctggagtgcagtggcacaatcttggctcactgaaacctctgcctcccgggttcaagcgattctcctgtctcagtgtcttagcctcccacgtaactgggattacaggcgcctgccgccacacccagctaatttttgtatttttagtagagacggggcttcaccatattggtcaggctggtcttgaactcctgacctcaggtgatccacccgcctcggcctcccatagtgctaggattacaggcatgagccaccgcgcccagccactttggtttttctaaaggcatatacctatacacctatgttcatagtggcattattcaaaacggccaagaggtggaaacagcctgggtatctactggcagataaacggataagcaaaatgtggtctatccatgtagtggaaaattattcggccttaaaaaggtagagaatctgacacatgctacgatgtggatgacccttgaagacatcatgctgtgtgaaataagccagtcacaaaaggacagatcctatgattctgcgtctatgcagtgtctagagtagtcacactcagagagacaggagaatgctggtggctgggcgctgggggaggggacaaggagagttagggtttcatgggtacagagttgtagttctgttgtgtaacagtgtgaatgtacctaacactacagaaactatacactgaaaaatgggtgagatgggcccggcgtggctgctcacacctgtaatcccagcactttgggaggcctacgcaagttcgactgtagcctgggcaacatggtgaaaccctgtctctacaaaaaataaaaagattacctggccctggtggctcacacctgtaaccccagctactcgggaggctgaggtgggaggaatgcttgagcctgggaggtggaggttgcagcgagccttgacctcaccactgcactctagcctgaatgacagagccagaccctgtctccaaagaaaaagaaaaaaaaaaaaaaaggttgagatagtaaattttatgtgtatctttccacacagctttttgttgttgagacgaagcccaggatggagtgcagtggtgcaatatcggctcactgcaaccttcgcctccctggctcaagcgttcttcccacctcagcctcccaagtaactaggactacaggtgcatgccaccatacctggctaatactgttgtccacagagatagggtcttgctatgttgcccagactagtctcgaactcctgggctcaagcaatcctcctctctcagcctcctgaagtgctgggattacaggcatgagccactgtgcccagtccacacttgacatttaccaaaaaaaaaaatcctatattatagtcccagtgagtggtgaggttaccacccgatatcaaacaatattttcatagcaaaataaatactgagcaagagcaataaaggctatcagtagccctgtgtcagttgaggttgggttttgccaccaagtaaatatagaagactaactgctaatttaggggggaaaaccttggtattcagagactgtgtcagagcttggaattgcagataagagacatgtggttattaatgtaacagagtgataatcctatcgggggaggcatttcctgaaggcccttggggagggcatggccatcccctcctctcccacctgcaggtcccagccatggtgggacgaccatacctcaggtcctcgcctcggtcagcacacttgtactgcagctggccgggcaggctggccaccaaggctttgagctgcaccgtctccagggctgcccagatagcctcgtccgagtgctcctgcagcaggtcgaggttcatccgcagagagccagggaacaggatggggtcctggcggggaggggcggtgggtcagagccgggtcccaccatgcctcccatctttgcccaccccctccaccagcctcacctgggggatgatgctgatcctggagcgcagtgtgtgcagccccacgtgggcaatggggaccccgtcgatccagatcccaccctcagctgcctcctggagccgcagcagcccactggccagggaggacttccctgccccggtcctgccaacgatgcccacctgcccggggttgggaggaaaggcctgctctgaccagagggtttgtgggcatttattggggagatctttctgctgtacccgagatctgtctatccatccctcattgtgtaaaggtctaccttccatctctctttccatctgtctacctttctatatatccacccatcaatccatccagtcttccatctgtgttcttctctatctttcccttatcctgatatctctctcccatctttctccccacccttcctttagttcctccatctttcctcatccttctatttacacctctccatcatctctcatccttttttctaccccatcccatccatctgtctgtccgtccatccatcccttatccttttttccaccccatcctgccatccatccatccatcatccatcctcaatcccatccctccatctctcttccaccccattccattcatccatccattcatctgtctatccgtctctcgtttcttcttccctattcatccatcaattcactaatcctttcattcatttattttctcccatccatccatccagtccatccttccctcatccatccttccattcatcctccatcttatccatgtgtccattctgttatccatctcccatgctgttatccaccctccatccttatctctcttgctactattgcatcctcagtgtctgacacatggtgtgggttcaacattatttgtttaattaatgatggaaacatgtgggtcaccccactgtatgccaagtacctgtttaggcaccggaagtatagaaattaaagagtccttgctccagtgtgcccatcatccggtctaggaaacagtgcaattgagtaaatgtaatacagtgtgatgaacaatgctttatttatttatttatttatttatttttgagataaagtcttgctctattgcccaggctggagtgcagtggtgcgatctcagctcactgcaacctccacctcccaggttcaagcaattctcctgcctcagcctccctagtagctgggactgcaggtgcctgtcaccatgctcggctaatttttgtatttttagtagacacgggatttcaccatgttggccaggctggtctcaaacttctggcctcaagtgatctgcccaccttggcctcctaaagtgctgggattacaggtataagccacagcacccagccaacaatgctgtttattatcaaggtctggacctctggcaattaagggaagcaaggcagtgctgctcatgctgcctgggatttgacagaggtaataagagaagacctcatggaggaagggatacttgcatggaagcttgaaggatcaataggagttcaaggaaggggaacactccaggtaaaccacaccaagtgggtttccaaaactagaagctcatggagctcacagcaccatgtgcccccctggccgagaggcagctgctccacaatgttggctaagccctggcagagcaatgaatgagagggggaggttggcagggcctgggttgggtagagccttgaatgccaagctcaggaattcacactttaccccaagggaagctggaactagtagaaggttttgagcaggggaatgacatgcagtgtcattcatgctgataaaggtcacaggatggctgggcatggtgggtcatgcctgtagtcccagcactttgggaggccgaggggggtgattgaggtcagaagtttcatagcagcctggccaacatggtgaaaccctgtctctactaaaaatacaaaaattagccgggtgtggtggcaggtgcctgtaatcccagctactcaggaggctgaggcaggagaatcacttgaatctgggaggcggaggttgcagtgatctaaggtcacaccactgcactccagcctgggcaacagagtgagactctgtctcaaaaaaaaaaaaaaaaaaaaatcacaggagagcagattggagctggtgagacaggatccactgctttttaggggacaaggagaggacagggaggaagcctctgtaggttcagagggagggaggaaagggattcagtgaaggggcctgatgaggcatctgtaaaatgggatagtactagcacctcacttaggggttgttgtgagagtgaaaacgcaaataataaaagcattagtaaacatttctggagcactttctatgagctaagcatgttctatgtattaactcaaacttcacaacaactcagagatcagtattaccagtcccaatttacagatgggaaaactgagactgagctatgaagtgcttttcccaatgtctcccagctgaaagcaaatatcccatttgtgcaaactggaaaatgtacctggagcatttaacacactgcccagcacatattaggtgctgggttaatgttaaaggaagaaggaagtcacggagttgcttcctcatctggggacaccaaggtggatgaggaagtcaccagatggaagcaggtttggggaaggtgaggagttcattttagggggtaatgggtctgaaagctaggggacctgaggtggggacactgtggaggtggctggtgcccagggtttagggccttgtccctggagtcctttggcctaaactccatgaagaagacattgtgagagaaccactcaccttctctcctgcgtggatcttgaaggacacgccctgcacagccagcgggagctcaggtcggtatcttagcccaaagtcccggaactcgatctgcccgccctgaggccaggggggctgagctgcacatgtgggcagcctccagggagcctggagcaggaggggaaactgagtcagaggagccttcctctaagacttcacacaagatggcccacctctatcagcttcagttttctcttccgcaaaatggacgtatttattgctgttttacagggttgttatgggaattcaacaagagagggcatggactatgtcaatgctaaaaacagatggtggtggctacttttagtctattttattgttattattagccactgtttattataaaataatctctttttctatagtgggagcagacatttctctttgtctttgtgaaaggacatgactgtgcagtgggaagaccaatactgcctttgctgttcccgtgaccttgaacagatcattctacccccttgagtcttggttttccaatctgggaaatagggctaataagagcagcagacatgtattgagtgtttgcaatggaccaggcactctattaaatcatttctttgcaggatctcatttgatcctcccagtaaactcaacgctgttatgttactgttacattagtgctatgctgctgttcttatcctttcttccacccaatcccatccatccattcatccatccatctcttatcctttatccaccccatcccacccatccatccatccatgcatccatccatccatctccaatcccatccctccatctctcattcttccatcccattccatccattcatctgtccatctctcaccatttcttctaccctattcatcaactaattaattcttccttgttctgttactgtaatgttactgttatattgctaacacattatatcatgttgctgttttgttaccgttgcgttgctatgttgctgttctgtccttataatgctactgttatgttgctggaattttgccatcatgttactataatgttgctgttttcttactgttacattgccatgttgctattccgttactataatttcagttattttgctggaatgttgccatcatgttactataatgttgctgttttgttactgttacattgttatgttgctactctgttactctgttacagtcgtgttgctgggatgttgctgtcatgttatgatgttgctgttgtgttactattgcattgctatgttgctgttttgtttctatcatgttactaaaatgttgctattacgttactattacattgctatgttgtggttgtattgctggaatgttgccatcatgttactataatgtctctattatgttactattacactgctatgttgctattctggtactgcaatattgtggttatgttgctgttacattactgttacattgctgttgcattactctcatgttctggaatattgccattgtgttgctgttgccattatgttactatcatgttgcagctatgttgctgttgcaatgctgttccttgtggttccctgcactcccatgggtgacctgctttcctcaagctcagaagcaaaggaaccaagatttggcctggctccaaaccttatgctcctaaccactgctgccaccctgtctgtgactctgacctatagtggtgggggttgagtgaggggagaagagggtataaactccaaagcctgtagcagatgtcaacagggacccattgcccccccccacaatatgtccttgctgggaccccctccccacctcccgcccatcacctccttgggcgtccaggcatagtcctgcatccgctccactgacacgatgctgttctctaggtctgtccagttgcgaacaacccactgcagtgtctgggtcacctggtgcaagaaagcctctctggctgggtttggcaaggccacttgagggcttgcaacagcccccctggtttcccaaccttttctgggaggccagacccaggggagtaaagaggggaggcaggaatgggacagtctgaggacctgggcccaggggattgggatttggatacaaccaacaggtccctctcttccttcagtagaaccagagcatgcagagcaaaaagaagccctcagacatcagcttgtacaaactggcttgatgcaggtgagtagacaggatcagagagggtgtgtggccctcccaaggacacacagcaggacccaggcccactgattccattctgacggctttctcgcagcgactgggtggccaccaatttcccatgacacttagaaccactccaagctcctccctatgagccattagcagctctagccctgccatcccatccccaaccttgtctcccagcacccctgccttcacccaccctctccagccacacccgtcttcttgctgttcctctaacacaccagggatgaaccttcaactcccaggccttttcttcctgctgttaacctcacttcctcctaagtcacctcctcagagaggcctttctggatgcagtaggaaagttccctcactgccacccaacatgctccagcctcttacttcatccttaagcttagcagccttgactgtaaaatgaggataataacagtgcttctctgatggggttgtgggcagtattaagtgagttaatatttataaaattcttgtgcacagtggctcatgcctataatcccagctttttggaagtctaagcaggaagattgtttgaacccaggaattgaaggctgcagtgagctgtgatcacaccactgcactccagtctgggcaaaagagtgagaccttgtctcaaaacaaaacagctgggcatggtggctcacacctataatctcagcattttgggaggctggggcaggcagaccacttgaacctagagtttgagaccaggttgggcaacatggtgaaactgtttctaccaaaaaaaaaaaaaaaaaaaaaaaaaaaattagccaggcatggtggtgcatgcttgtagtcccagctaattgggaaagtgaggtgggagaatcccttgagcctggagatggaggctgaagtgagccaagatcatgccactgcactcaagcctaggcaacaaaatgagatcctgtctcaaacagcaacaacaacaaaccaaaacgaacaaaaacatataaagctcttagaataatgcctcctccataacaaatgcttatgagtgtatatatatatttttttcatagatgtcatgaactgacattacatactgttaatagttaacaaaaattagccaggcatagtggctcacgcctgtaattccagcaacttgggaggctgaggcataagaatcgcttgaacccaggaggcagagttctcagtgagccgagattgcaccactgcactccagcctgagtaaaagagagagactctgtcttcaaaacaaaacaaaagttaacaatgcactagaaatgtcctccacaggatatgctttgtctcaactagtctttataacatcagaagtagtgggatttctggcctgtctttccaaggagcacactgacactccacaaggaaagactcttgcccaaggttgcaagttcaccttagctgagtctggctcttgtagagctgcgtgtccctccttggtggagggactccacacaccatgttggtttggacacagggtcttcaaaggtcccactagcaggggtccgacagtctctgcctctgtctgtccctcaagcccagtttggggatgtggggagtacctggagggcagcagagacagagaagcccacgaggccagcactgaggtgggctttgctcagcacagcacacgtggcagctgcaaacaccaggccattccccaggagctccacattggccgcaagccacctgcaaagggaagcgacagcagggtgagtggttactctcatctgcagggagatgcttctctgggcacaaggactggtcatcacaccagctttgtacacacaggggtcccagcaatggcctccacatgcaacccaggctcagggagtagaggaagatgacaccgtcctgtctcaactaagcccactttagggtctggggtacactcggtgttctgaagagcatccctgtgtggctgcttttctgtccctggaatttgccaagccatgtccacctgccattcccctggcctgaaccatggcctccatggtttggctctgtgtccccacccaaatctcatctcaaattgtaatccccacatgtggagggagggatctggtgggaggtgactggatcatgggggcagttttccccatattgttctcgagatagtgagttctcacaagatcatatggcgtaaaaggatgcggcagttcccacctcatgctctccctctcctgctgccatgtaagacgtgccttgcttccctttccaccatgattgtaagtttcctgaggcctccccagccacgtggaactgagtcaattaaaccttcctttctttataaattactcagtctcaggtagttctttttagcagtgtgaagatggactaatacacagccccagctggctggggacctgagatgaaaggaaaaaggacttcacatgtattgagcacctagtgtgtacttgaccctctccacactctggtaccagactgcttggattcaaatcctggctctgccagtattagctgtgagaccctggacaagtttccaaacctcactgtgcctaggatttatcatctatagaacagtttcttcctggtgaagctgttagcagaattaaataaattaatctacatagattgctcagaacagtgccaggcatgcagtaagcatgttacaggtcttacctatgagtgtctgtatttaatcctcatatccactccatgagcacgatcccagtttgacaaatgaggctcagagaggttatgtaacttgcctgaaatcaaccagctggtaagtggcagagctgggatttgaacctgtgtctatttgtgcttaaagcttgtgttcttgttcttgcttagtacctaaagatggctgaggatgcttatatggctgctttatcaccaaggcaaaagaggttgatccagttgcctggcaacagaagcttcttcctgtaccccccgcccacctgctgttgagaatctctcggtcatgttccatctgcccacggtgagaactgatagactgcctgtgggatctagcctcaactatgtccctgactctctgggtgacctctctaccatacaatatgacctcaggtctcaccctctaaggatatggatgaattgcaaggtcttctctgccctggctcttcctacctgtcagccaccagtcgcgggaaactgatcctctggctttcatctacgcgagcattgttctgagccacaaagggggcctgggttcggaatgcccggaccactgtgctgccctggaacgtctcagccatgtgggagcagacagacgagtagctggctgactccaagcgtctcagctggcatgagctaaccacatacaggctctgagaaggatggatgggagagggaagaggagaagccacagacatagagaggtagtttccagaagcacagagagccccaagtacaggattccagaccaggatctgttaacagcttactgtgtgaccttgggctagttgcttgccctctctgggttctcatttccttgcagaatcagagttctatggtttttttgaaaatcacctggggagcttcaaaaacctctaatgccccaccccagaatgactgaatcggaatctctggaaatgtcaccttgactttggtgctgtttaaatagccttccagatgattctaagggacagccagggttgagaaaccaccaatttagtttaagtgtctcacttcccagcactgaggccgactacttcatttacggctggtcagtgggagaacaaaactgtaaggggcaatgaaggcagttggccaagtcagtttcactcatgtaacccaagggttacatgccaggtgatgtgcagaaaatattcgttatttggtttgcagctgcaggttgggtgcagctggcagacaggcaggcagggaggaactgaatttgctgaacacccaactgtatgtgccaggcttttcacacagtgtctcattcattgcagagtgagcattcgcgtcattcatcagttagtggtgagaacatccaaggctcgggggattcagcagctgtcctgagtgccacagtaagtgatagagcctggatttaaacccatctttgcttgactctaaagcttgagacagaaacagcccatcctcggagtcaagtgaacttagagaagacctaggacaattgtcggggacagtggtagccatgggttttgttgtttgttttttgagatggagtctctctctgtcacccaggctggagtgcagtggtgcaatctcagctcgctgcaacctctgcctcccgggctcaagcaatcctcccgcctcatcctcccaagaagctgggattacaagcatgcgccaccacactggctaaatttttgtatttttagtagacggagtttcaccatgttgaccaggctggtctcgaactcctgacctcaagtgatctgcccacctcagcctcccaaagtgctgtgattagatgtgtgagccaccatgcctagccctagccatggtttttatctgactaccatgttttctacttctggtttcctgtgggaaagggctgggttggggtgctgtcaatcatgggacctgatcagagaggtggtcacatgatgcagcctagtgtatcagaatctactatccattcagttactgtgacgagttcagagatggacacatgatccacaaagggccaatcagaaccttccctgggattaatatatgactactgagctgaagaaacgttttttgcatgttgagttgctaaggtgagatgatatgatagctagtggccataagacctgccctggaaagagagcgtgtacaaaattagaccagaggtaagccagtggttcctaaacatttgtgtacatcagaattacttggagggttaattaaaacctagattcatgggccgacccacatagtatctgaggcagtagtcctgggctggggcctaagaatgtactttgctaactagtccccaggtgatactactgctggtcctggggtcacactttgagaagcactgagtgaagatatggagagagtcactgtgtcctgatgacaactgggcccatgcccccaaggaaatataagccattaaattctattcttttggttaagctaattttagttggttgctggtcccagcaattgaaagaatctagcttcatataatagcctttgagaccttgcaatgcctttttggcttccagataattggagaggaagaaattacggcaggataaaaacattacgcgtgaaaggctctggcccttaatatttaactgtgccgtggggcacaggggctcatgccctgtaatcccagaactttgggaggccaaggtgggaggatcacttggggccaggaattcgagaccagcctgggcaacacaggaagacacttgtcctacaaaaataaatttaaaaattagccagtcatggtggcacgtgcctgtagtcccagctacttgagaggctgaggtaggaggatcacctgaacccaggagttcaaggctgcagggagctatgatcacctattgcacttcagccttggcaggagagcaagattctgtctctctaaaaaaaagaactttgatgtgaacatttagagacagacactagtggagataccagaaagactgtagtgtccctgtccctgggaattctaggaacagcccctagatgtccagctgggtgaaacctcatatatggagtcttccccagagacaggggactggctgagttgacctcagccggtcccggaagcctccctgacctctccgtacctgaaacccagcgtagaggagaaacagtggcaggatggccacagtggccagtggggtagccactgccaccaccaggctgacctccaggagtccaaaggcgtacatcagcagggaccggagtttgtctggaatgtccacgtcaaccgtgtctgtctccttggagaagcggtttagcaggtgaccaatgggtgtccgctcaaagaagctgatgggagatcgcaccacatcccacaggagcctctggaagagcaacctggatgcccgggccccacctaggagcaccgcagccatggaggcaaacagcccaatggctggggagggagaggaggtaagagcatgagggctggagaccctcaggagcggcccacggggccctgcgcaggtctctcccgctaccccatggtggacatcttatggcttggccaccctgattattatatttttttgagacagggtctcactctgtcacccatgttgaagtgcagtagcatgatgatggctcagtgcagccttgacctcctgcactcaagcgatcctcccgcctcaccctccgagtagctgggaccacaggtgtacgccaccatgccggctaatttggggtatttttgtagagatgggatcttgctatgctgtccaggctggtctcgaactcctgggatcaagtgatctgcctgccttggcctcccaaagtgctgagatgacaggcatgagccactgcgcctgtaccctgcttgtttcttgatgtaatgggttgaagagtgtcccccaaaattcatttgggatgggtcctaaattcagtgactgccatttatataagaatactagaggatactcagagacacagcaggagatatgaagatggcgacacagatgggagggtgtatctacaagccaaggaatgccagcgactgccggcgaccaccagaaaccaggagagaagcctggggcgtattctccatcagaacctccacgaggggccgggcacagtggctcatgcctgtaatcacagcactttgggaggccaaggcgggtggatcacctgaggtcaggagttcgagaccagcctgagcaacacggtgaaaccctactaaaccctactctctactaaaaatacaaaaattagctgggcgtggtggcaggcacctgtagtcctagctactcaggaggctgagtcaggagaaacactggaacccaggaggcagaggttgcagtgagccataagccgagatcgtgctactgcactccagcctggttgacagagcaagactccgtctcagaaaaaacaaacaaacaaacaaaaaaaccaaaaaaacctccacaaagagttaacactgctgacaccttgattttagacttcaggcctcagaactgcgacagaacaaatttcaattgtgctgggctcccaagtttgtggcaacttgtttggcagtagccctgtgagagaaatgcacatccttcctcccagtgctaatctgtatgcctggggtggggctaacttctcctctggggtggggcaaatttcacccatggccaatccaaaccactgcagttggttcagggatgaacacataacccaagtcaggccaatgacagggagacctgggacttcactagaacttttggaaaagtggtacttggttgttggaggtagccaagctggagccgtggaatatcatcttactgccagggggagcagctaagctggacaggaagctgtcacagaggagggaaataaagcgatttcttgtttggacccctacatccagccatacctgaagccagaaatctagggatactggtcccaagagccaatcaattctcttgttgcttaaacactttgaattggagctgaatttgtttattttcagacggagtcctgctctgtcacccaggctggagtgcagtggtgcaatctctgctcactgcaaaccccacctcccaggttcaagcgattctccttcctcagcctcccaagtagctgggattacaaacactgacaccatgcctggctaatttttgtatttttagtagagacggggtttcaccatgttcgccaggctgatcttgaactcctgacctcaagtgatccacccgcctcggcctcccaaagtgctgggattacaggcatgagccaccgtatctggcctggagctgaattttttattctttgtattcgagagtcataaccaatttctctctctcagctcccatctctccatctttaggggagagtaagacttgcccttagctatcaaatgagggatggaagtggaaggattttgaaagggctatttgccacccaaatgaggatttgggttaattccagggctcggctgactctgagaatccctaatttcctcttggttaagtaaccattcgccttgagtattccactgtacatgcagttgtggtgagtaggtgtacaggttcttaggactagaagagtcctcaagttcaggcctggcgccccctattttacaggggaggtcacaggctcacagcattttggtgatgtggccaatgtcacccagtgaatgaggacgaatcaacatgaaaacgaggcaactgtcctttaaagatgaagccaggccgggcgtggtggctcatgcctgtgatcccaacactttgggaggttgaggcggaggattgcctgagcccaggagtttgagaccagcctgggcaacacggcgaaaccgtctctatcaaaaacaaaaattagccagcatggtggcatgtgcatgtagtcccagctactcgggaggctgaggtgggaggattgcttgagcccaggaggcagaggttgcagtgagccgagttcgtgccactgcattccagcctgggtgacaaagccagacccagtctatatatatgtgtgtgtgtgtataaataagaagccaaactcacatgtgcactcctgttactcccttcagccaggccacgtattaaaaggagaagaaccaggggttggggacagggtgggcgaggcaggagaagggtgggtgtggttgcaaaagggcaacacgagagcgcctcgtggtgagggggttgttcagtatctcaactgtcaaccatcgtgatggatgcgagagactgaacaggggatacgactgcacagaggcaaacatgcgcacacccacgtgcaagcaaaactggggaaatcacaatgagatccatagggccgggtgcgggggctcacacctgtaatcccaacactctgggaggccgaggcgggcagatcatttgaggtcaggagttcgagaccagcttggccaacatggtgaaaccccatctctactaaaaatacaaaaattaaccaggctgcacacttgtaatcccagcttccagctactcaggaagctgaggtaggagaactgcttgaacctcggagatgggggttgcagtgagccgagacggcagcactgccctccagcccgggcaacagagcaagactctgtctcaaaataaaataaacaaataaataaataaataaataattgagatccatggattgatgggtgtcaggatcctttgtgtgatactttactatcagtttgcaaaatatcaccaatgggagaaactgggcagactgttcaaggtagctggctgccttatttcctagaactgcatgtgaatctacaattatttcaagaagaagtctttccatttttgaggaggagaagaaggagtgatagcggtgatgcatttgttagggagggtctggctctgtctggaggtttgggggcaggcactgaaagccaccagcaggcaggccttgcagacgccttccgctagtggggagggactgggagaggttctgaagcttccagaaaaggagggatgtgccctgtccttcccgttccctccagcctcatcttaaggacgcagatctttgcctggaccccagacgttttgcacactgttccagggggacagggtgacccagggaggggtggggtaaaggagtcctgagcaccccttggtgcagctgggaggagagggatgaggagggcaggtgaggcgtaccttggagacagccgaggagcccgaagatcccgccacgcagggctgcctgcgtctgctgcccacctactgcagggtcgtccgcccacaggctcagccagtagccccggcagaaggaggccacttgctggcagaggaagaggaagagtgcgtagaggcagaggggggtgcccacggcacgcaggtaggccaggtgcactgtggccttcacctgtagcacacatgagggagagggaggcagagagagcccccagtgggaggggtgggttgaggcaaggccaggcgaggctcccagaaaacatgcccatggcagatgggaccaccacgcagacctcactggttctcccgctgtgcctcccaccagaagcaccatttccccgacaggccccagccagccttagaacccccatctcctatacaatccccagggagctagtattaatattttttcttttgttttttttttgaggacagggtcttgctttgtcgcccatgtcacccaggctggagtacactggcatgatcatggctcactgcagccttgaactcctaggctcaagtaatccccccgcctcagcctcccgagtagtcaggactataggtttgtaccaccatgttttgttaattttcatagttttaaagagatggaatctcgctgtgttgcccaggctagtctcagactcctggcctcaagtgatcctccctcctcggccttccaaagtgcttggattacaggtgtgagccaccacacccagctagaagggttttcttgaacacccaccataggtcaggcatgtgtctctccttataacaacctccatttcacagataaggaaactgaggcacagagaggttcagccactggcttaaggtcctgctcctacaaatctgaagttctctgcacagctgcagccagacgggactgttgaaaacattaatctaattatatcttgtcgttggcctgtccatggctatctcttgctcttagaagaaatcccagccaggaggggtggctcatacctgtaagcactttgggaggccaaggcgggtgtgtcacctgagctcaggagtttgagaccagcctggaccaacgtagtgaaaccccgtctctactaaaaatacaaaaattagccacgtgtggtggcaggcacctgtagtcccagctactcgagaggctaaggcaagagaatcgtttgaagccaggaggtggaggttgcagtgagctgagattgcaccattacactcttctctgggcgacaagagtgaaactctgtctcaaaaaaaaaaaaaaaaaaaaaagaaagaaagaaagaaagaaagaaagaaagaaattccaagcttcttatctcgcccccactcactgcctgccagcctcatgggacccctttctctggcaccctaagctacttcccacctcggagccattgcacctgctgctctctctgcctggagcgctctttctcctgccctttgtatgactggttccttcacacattctttggggaagctcaaatgtcacttctcagagcatcctgtccataccaaccatggtagggtttctcagtggtctctatttcatcattctttcttttaagaggcagggtctcactctgtcacccaggctggattgcagtgacatgatcatagctcactgcagcctcgaactcctggcctcaagcaatcctcctgcctcagcctctgaaagtgttgggattacaggcatgagccactgcgcctgatcattcttattttctttatagcacttattgttattggacatagcttacttattagcataattatttactctccgtctatcctcactagtgtctaatctctaccagacttagcctggcacatagtgggtattgtgtacatgtttgctggatggatgagagggtaggtgggtgaataaatgagcgggtgggtaggtaggtaggtgtgtgaatgagtggatgaatggatggaaagatcaatgaatggatgaacagctgaacagacagatgcataggtgagggaatggttggatgtattgttaggtgggatagatggatgggtaagcgaatgggatggataaatgagtaggtgggtgagtggatgggttggacagataaatgagtgggtgggatagatggataaatgagtggatgggatggacagataaatgagtgggtgggatggatggataaatgagtgggtgggatggataaatgagttggtgggagggatggataaatgagtaggtgggatggatggataaatgaatgggtgggtgggtgggtggataaatgggtgggtgggatggataaatgagtggttgggtgggtgggatggataaataagtggatgggatggataaatgggagggtgggatggataaatgagtaggtgggatgcataaatgagtgggatggataaatgagtgggtgggatggataaatgagtgggtgggatggctaaatgagtgggtgggatggataaatgaatggatgggatgcataaatgagtgagtgggatggataaatgggtgggtgggatggataaatgagtgggtgggatgcataaatgagtgagtgggatggataaatgggtgggtgggatggataaatgggtgggtgggatggataaatgagtgggtgggatgcataaatgagtgagtgggatggataaatgggtatgagtgggtgggatggctaaatgggtgggtgggatggctaaatgagtgggtgggatggctaaatgagtgggtgggatggctaaatgagtgggtgggatggctaaatgagtgggtgggatggataaatgagggggtgggatggatggataaatgagtgggtgggatggataaatgggtgggtgggatggataaatcagtgggtaggtgaatggatgggatggataaatgagtgggtgggatggataggtgggtgggtggatgagcatctaggtggatgatggaatgggtaagtaggtgggtggagatacatagcagtatagaagatgagaaacagtgtaagcttcagactcagattggcctagatttgagtcccaggttgtgtcccaggctagatatgaaaacacaaacaagtctcttaactgtttaagacttcagtttcttggctgggcacagtggctcacacctgtaaccccagcactttgggaggcagaggccagaggatcacttgagcccaggagttccagaccaacctgggcaacatggcaaaacccatctctactgaaaatacaaacattagctgggcatggtggcacacgcctgtagtcccagctacttgagagactgaggtaggaggattgctttagcccaggaggtcgaggctgcagtgagctatgattacatcactgcggtccagcctgggtgagtgagcgagccactttctcaaaatcaaaataaaataaattttaaaagaattcagtttctttatgtctgaaatagacctatcatatctattttttagggtggttgtgaggattaagaaaatgaacatctagaatgctactggcacatagtaggtgctcaagaaaggtgagtatcactgccaagtgctacatttggtgggaagacttgggcccctggaggtggcagcagtgggtggggaggggtgggtgaagctggtggttaccctgccgtattggatgctgtcctttcctgctggccatcctgccctgtcagggtcatccagaggaacctctgtctgggcttctgaagtggtacggtccttctcagggactgacttgatggacctgtcatttagaggaaatgaagacaaagtcagtatctctcccaatggtggggtgtatgtgcctaaccctcaggcccactgacagccactgagctctgggtacactctgtactctttcattcattcatttatctaacagaatactgaccagatatcacacttcccttcttcccatatggtacccagctaaatgccatctattaccccagggtcaagcaagcccattcttctgatgccaattcacaggatgaacttaacttgcccaccattggaactctgttctcagaattttcttttttttttttttttgagatggggtcttgctgcattgcccaggttggtctcaaactcctgagctcaagcaatccacctgcctcagcctcccaaagtgctgggattacaggcatgagccaccatgcccagcctgttctcagaatttttattttggcttaagctttcgtgcaattgttttgttcctactgtataccatcagatttgtcagtccaactggcagaatataaattatgcacaattcagatgctaaagactctttgaatgttttatctgtggatgagtgggctgacttaacctctgtgcctcagtttcctcagctgtaaaaataggaatattatctatctatccatccatccatttatccattcatctacatacctgtatatctacatatacatgtctacctaccttctattaaattgaggttagcccaaagctgcctccttacatattttaagtttggcctaaaggttttccccgtacatagtgaactgtaacctaattggactcaaacagactgcaacctactcctgtgtcaatcactgagtttcagccaatcaaaggcaaccaaccgttcaaaccatgttccaataaagcaaacgctgagctgtaaccaatccggctgtttctgtacctcacttctgttttctgtccttcaccttcctttttctgtctattaatctttgaccccgtggctgtaccagagcctctctggacgtattctggttcagggactgcccgatgtgcggatcattctttgcttagttaacctctgttagccaggtgcagtggctcacgcgtgtaatcccagcactttgggaggctgaggcaggtggaacacctgaagtcaggagtttgagaccatcctggacaacatggcaaaaccctgtctctactaaaaatacaaaaattagccgggcctggtcacatgtgcctgtagtcccagctactcaagagactgaggcatgagaatcgcttgaacctgggagacggggattgcagtgagccgagattgtgccattgcactccagcctgggcgacagagcaagattctgtctcaaaacccccccccgcaaaaaacaaaaaacctcagacacattaaatttgctagaggttaatttggcacaatctcggctcactgcaacctccgcctccgaggttcaagtgattctcgtgcctcagcctcccgagtagctgggactacaggcacatgccaccacgccggctttttttttttaatttacttattttttatttttagtagagacgggttcaccatgttggccaggctggtctcgaactcctgacctctagctagtgatccacccgcttcagtttcccaaagtgctgggattacaggtgtgagccaccatgcccagccttaatgtgtctactggttttcttttaacatgactacctatccatctgatcttacttcagattcttgtgcgctgtgaaggtggtgggatttctcagtgtgtgtgtgattgagaagtgccctcagggtggctagctgggatgggggtcagccccaatggtccctggggactgaggcccctcaagatcgctgccgcccaccacccctgtatagcaggcacttaagctcaggccatctggtatcagtggcctgttgttctgcttcccaagacccctctcattaagaggggagagtatcaggcagcaggtccttctgctgccgacagctccacagtgagcccagctgtgtcctggctggagggagctgagaaaagaggggaccggaggcctcctcctggccccttgcccacgtgttctggccagcgtcaagtgatgctgtgcatacagacccaagccctgtgcatagccagcctgtcaaagcataagtggccaggcctggcatggtggtttacagctatggggaggaaccagtcctgccctactgcagcattcagacaactccagcaagctggcctcggcccacttgaagacatccatcaattggaaggcatattgttcattccatgaactggccttataggggcctaatcatcttggctaactggaccaattttggtaaattatccctcagcagggcaccatgggggggacttcagcaggttctctatccataatggttttggttgcccgcctaactgcccgagatgcgggtggtcccttcagctacttcagcttcagcctgtgcccttctgagtgtggcaccatggtggactcacctctcgcgtctaagctcgggcctcctgcctgcagaggtgcctctggggtccttggtgctggtcccaggttctgtttctgcaaggtcaagagagtcctgtcacgcaacacggcccagatacccactttgacacccactgactatgtggccttaaccgctctgaccatccatttcccctgatctggctcctgccacgtctccagcaacctctctcaacaccccactctgagttcttccaggaacatccttcaggcattcactcactcattcatttcttcaatcagtgataactgagcacctactatgaacttgaggttggaaaaacagcatttaacactgtacaaagtcaagttacctctgtttcccccaacagccttgctcaagcagttccttgtgtctggaatgcttttttctggctaactctcacctaccctcaggtaccatctcccctaggaaggacacctccccaccactatcccccaggtgtggccagtaactgaaagcaaatctgtagtagtttaaccacagacctgtaagcaacaagtaactgctactgtaagctgctaggatttggggggctatttgttacacagcatcatcacagcaaaagctgaccaacacaaacaggcaagttctatcttcaagcttcaggactgtgacattgtgaatcaacacttaaggttttaaccaggttgggccagtgctaagcagatgttctcagaagaagcaaagcctgagattgagggagacctggatgtgaatccttgctttgtcatgaagggatagtgtagagggtagcaattaaaaaacacattctctggaatcaagttgcttgggttcaaatcccagtgctgccacttacaagccatgtaacctgggactagttccttaacttctgggcctcagtttcctcatctgtgaaatggaaatgattctagtaccagcctcacaggggcattatgttgattaaatgagctaacctctgtgatgtgctgttagttgctacttttcagtcattgtgagtgagcttggcttggcaactttacttccagaaccttgccatgtatccagcacactgtttttctggattattagaaaccctagctagcatggtgtagcttgctaggcatcaaagtccttcttgggctgtctccatagcaactgcaagcatagactctggagctggacatactcaagttctaatcttgtgaccttgggcaagtgatttaactctctttgcctcagtttgctcatctgtaaaatgacagcaataacttcacatgcctctggggcatgtgtgagaatcaaatgaaatagtgtattttttacagaagcacttagcacaacccctggctcatggatgatgttatcggctattcttggagaaaggtgacctattaagagagctgtctgcttccaggcctaggcctgcagacagggtgtggccagagcactccattcatgccagtaggacccttcgagccttttcccccaagggtggcaggagccaggcctggagaatcagcaaagcccacctagtacctccttctcctctatctcctggctgtctggcttgatccagaagacacatgagggcccccttcctctgcagaagctcctggtaggaacccatctctgcgatggccccatttgccagcactatgatccaatcagcctggggcaggatgtggagtgcgtgcgtcacgagaatccgtgtctgggcagggaaggggtagaagttacacacatgtggccgggtgcagtggctcatgcctgtaatcccaacactttgggaagccaaagcatgtggatcacttgaggccagaagttcgagaccagcctggctgacacggctaagccccatctctactaaaaatacaaaaattagctaggtgaggtggcgcacacctgtagtctcagctactttggaggctaaggcaagagaatcacttaaacctgggaggtggagcttgcagtgaggcgagattggaccacagcactccatcctgggtgacagagcaagactctgtcaagaaaggaaagaaagaaagagaagaaaagaaagaagaaaagaaaagaaacaaaggaaggaaggaaagagagagagagagaaagaaagaaaaaaaaaatgtacggccgagcgcagtggctcatgcctgtaatcccagcactttgggaggccgaggcagatggatcacctgaggtcaggagttcgagaccagcctggccaacatggtgaaaccctttctctactaaaaatacaaaaaattagctgggcgtggtggcgggcacctgtagtcccagctactcgggaggctgaggcaggagaatggcgtgaacccgggagccggagcttccagtgagcggagatcgcaccactgccctccagactgaaagacagagcgagactccatctcaaaaaaaaaagaaaaagaaaaaagttacacacatgtgcttggccagcctcctgagctgggggttggggtgggggtattgtccctggactcagagtggggacagctccccttcttgtgctcctgccgcctttcttgtaaacagcatatccaaatagagaaacagaggggactcccttagcctgtgtctcaaaacaagaagacaaggagtacatctgaccctggccaatcatccaaggcaaagctgtagtagttaaatcacagatccataaggaagaaacacctgctgttgtaagctgctgggatctgggggttgtttgttacatagcattgtcacagcaaaagctgaccaatacaaagaggaaattggactcaagtggaagggggaggtgagataaacttgggttaggactggatgctaagtgcttcctctgcctttgccctgtactgtctgacacatgttcccaaacttactgttccctggagtagtccaccaggcccaatgacctggttgaagacatgctggccaacgtgggcatccagggccgccagggggtcatccagcaggtacacagctgcctttctgtatacagcccgggccaggctcagccgctgcttctggcctccggagagattcatgccctgtggccacaaaaggaacagtggcctgagtcagcatctacagggtgaaactggggtgcccaggctgtggcaggtcagggcacacctgcccatcagggtgaggtacagctcaacatgcctattccctggggacaggcccagcttccaaggcactcgctctcaagccaacaatgcctccatccttacccgacctcacttctccacttcccaagcacgcttcctggaggagttacctacacttcccaatccactctgtctcctcctgctcactctctctatctctttgagtccaactcttgtttccctttctccactgagaccaccatccatttccctattccctcatccagtggcagcttttcagtcctacttttgtattttaaattttaattgttttcttttagttttcattgatatgtaatagttgtaactattcgaggggcacaagtggtatttggatacctgtagggcagtggtccccagcctttttggcaccagggaccagttttgtagaagacgatttttccatggacctgggggcagggggatggcccgggggatggtttcaggacgattcaagcacattacgttgattgtgcacttctattattattattactgctgttgtcgttgttattattgagatggagttttgctcttgtcacccaggctgggagtgcaatggcatgatcttgactcactgcaacctctgcctcctgggttcaagcaattctcctgcctcagcctcctgagtagctggaattacaggcacccactaccacgcctggctagtttctgtatttttagtagagatggggtttcaccatggtggccaggctggtctcgaactcctgccctcaggtgatccgcccaccttggcctcccaaagtgctgggattacaggcgtgagccactgcgcccggcctacttgtattattattgcattgtaatatataatgactcaccatcatgcagtatcagtgggagccctgagcttgttttcctgaaactagatagtcccttctggggatgatgggaggcagtgacagatcatcaggcattagattctcataagatccctcacatgtgcagtttacagtagggtttgtgctcctatgagaatctaatgctgccactgatctgacaggaggtggagctcaggcggtgatgggaacaataaggaatggctgtaaatacagatgaaacctcactcgcctgccctctgcccacctcctgctgtgctgcctgcccagttcctaacaggccacagactggtgctgatccatggcccgggggttggggacccctgctgtagacaatatgtaatgatcaaatcagggtaactgagatagtcatcacctcaaatatttatcttttgtattgcgaacacaaccatccttctcttctagctatcttgaaatatacaagtaaatgatcattaactataatttcccttgtgcactattgattactttaacttattccttctatctaggccttcttgtctttcattcattcttttaaaacttatttttatttatttttgagatggagttccactctgacacccaggctggagtgcaatggcttgatctcggctcactgcaacctctgcctactgggttcaagcgattctcctgcctcagcctcccaagtagctgggattacaggtacgccaccatgcctggctaatttttgtatttttagtagagatggggcttcaccatgttggccaggctggtctcaaactcctgacctcaagcaaccctcccgccttggcttcccaaagtgctgggattacaggcatgagccaccgtacccagccattcattcattcttacattcagtcattccactaataaccactgcctcgttatcataaaccaggcatggttctaggctctggagaaacagcaatgagcaaaacaaagttgctgctctcttaatggatccatcattctcatgaaggggacagagacaggcaatccataaacaagtaaggcagacagcacatcaggtggaaagtgctatgaagaataaatagtaaagcagggggagccaggttcaggggctcacgcctgtaatcccagcactttgggaggcggagctgggtggatcacttgaggtcagaagttcaagaccagcctggccaacatggtgaaaccccatctctactaaaagtacaaaaaaaaattagccagttgtggtggtacatggctgtaattctagctactcatgaggctgaggtgggaggattgcttgaactactcatgaggctgaggtgggaggaatgcttgaactcaggaggtggaggttacagtgagccaagattgtgccactgcactccagcctgggcaacagagcgagactccgtctcagaaaaaaaaaaaaaaaaaaaaaaaagagaaaaagcaggtgcaggtgtagggtgcactaacaatagtagggtggctgtggtggtagataaggtggtcaggaaaggcctctctgtgaaggtgatagaagtgagggatgagccctggggactcctggggagagctttccagcagagggaacagcagtgcaaaggccctggggccagagtgtgctgtgggggatcagggaatatcacagagactaaggtggctgcagtaaagctgagaggtgatgatgggagatggggctaatggataccagagccaggtcacagggaccttgccagggattgtcatgacttgggctttgtctctgaggtaaatggggagatcacctgaggtccggagtttgagaccagcctggccaacatggtgaaaccctgtctctactaaaaatataaaaattagccaggtatggtggcatgtgcctgtaattccagctactcaggaggctgaggtgtgagaattgcttgaacgtgggaggcggaggttgcagtgagccgagattgcatcactgcatgccagcctgtgcaacagagcaagactctgtctccaaaacaaaacaaaaaacaaaaccacaagtggtgggctggatttggcttggggtcacagtttgccaacccctgcccaatccatagctccagatgcatatatcctgtttcttggacatctctgtccagaccccttggtgaggcccagagaggggaagcaattacaccaacattactcagcaaggcagggcagagtaagacaggagtctaggtcttctcactctcagttgtcagagagctcctcactgccaatccctgccacaactccctgcctctctctttgtgtctatttctgcttatcaattagtgattacgtattgagcacctagcacgtgcttgacgctgagctgagccctttttctccgctacttccctaaccattcctctcatttctccatcatactgcccatgatgagtcggggacccaaatgactcccaactgcaatgtctccctgtcccaaaaagacccccaaactctcacctgctccccaattgaagtgtggattccctcagggaagctgtccacatctggctgcagggcacaggcttctagtactctctccagccagggtgggtccagctcctgcccgaagcacacattctctaccacagaggtgttctgcacccaggcctcctggggcacgtaggccacagcaccctaaaacacaacttactttggtcacaggaggatgatggggacagaggtgggataggttttgaggagcagtgggagctgggctctcagtggtgggtgagaggtggagagaatgagtgaaagtgaacttggctgggatggggagggtgggaaggcagcgaggaagtgggactttcaggatggggacatcctagcagacaggctgggggtggcctcacctcgatgctcacgaacccctccacctttgacagctccccaaggagggcggacagcagggaggacttccctgcccccactggaccgacaacagccagcagacagccctggggcaccgtgaggtttattctggacacgcaagaggggagacatgaccttggttagggttcagcccgcctctgtgaggaaggatgagccccagacggagctgagctttcctgctctgggagtctccaagaggacctgtggggctgttctttttcccagtccttgtctagctatttgaggaactatcctgtgcacatctgtgcatgtacacatgcacacaaagcgtgcacacatgcatgcacatttgcacactcatacaagcatgctagcatgcacagcaacacaatgtgggcacgcatccacacacacacaagtgcatgcacatacccaatcaatccatgctcacacgcatacatgtgtgcacacatgcacaccacgcacacacacacagggttgactatagcctgagggtttcaccagcctggcctcctgccttggctcttgcgataaataggctctttcctccctccctcccgctactcttggtcccgccccactcctgtccacgtcccacagcccatcctccacccagtgaccagagggatctgttaaaacccaagtcagatcgtgacacttcccagctaaacccgccagcactcccatttcactcagggtcaaagctaaagtcctgacgatcaggaatgacatctcccgcctccttccgctctgtgcctcagctgctcggccctggccttgctgacctccttgctgtttcttgaacacaaaaggccagtggttctcaccagggggtgactgcatcccccaggagtcatttggcaagatctagagatatttttggatgtcacaaccagtagggggtgctgctggcatctagtgggtagagactggggtcagctaaacatcccacaatgcacacgacagcccccaacaaaggagtttcagcccaaaatatcaaccgtgctgaggttgagaaacccaggtccaggcactctcctgccccaggacctttgctgatgccattcccaccgcctagaaggttcttctcccaggccgggcacggtggctcatgcctgtaatcctagtcctttgggaactgaggcaggtggatcacttgaggtcaggagttggagaccagcctgacgaacatggtaaaacccatctctactaaaaatacaaaaattagctgggtgtggtagcatgcgcctgtaatcccagctactcgggaggctgaggcaggagaattgcttgaatccggaaggtggaggttgcagtgagccgagatcatgccattgcactccagcccgcgtgatagagcaagactccgtttcaaaaaaaaaaaaaaaaaaaaaaaaaaaaagaacagctcttctcccagacactccttccttatgatctcggcttgaatgcaaagccttccctcgctagacatgccatcgtactctgttcccttgctctggttttctgtttgggcctcacctctatcagcatgtcaccccacgagagcagggcccttgtctgtttccttcgccctatccccaatacctagaacagagcgtggcccatacctagtgctctatcgatgaagtgagtgaatgacaaccaatacaaatactacctggggcatattccttctcttcttagggagtttcagggctgtctgagatttttggccacaaagaccaagcgatagagttggagactatagatgatcatgacctcggactgatacaggaggcacagaagtgagcacagctgatagggctgaaccttggggctcctctcagccagccctcccttggcatcgtcttggccagcctgggagcacaggggtgtctccccctaatgggggaggctcagatgccctggtccccgtctgcaggagatactggtctatgctgtgcaggtccccaccttcaggaggtagagatgtatcctgagaacctccccggcagagccccagcccagccaaacccaccctccagtcccaggctggaaacctacaccacctctcaggtgggaggcagcaggagccccatgcatcttctccctaaaaacatgaggctggttactacgggtgtcgttctgtacctgtggaggcagggagggctttcctgggaccaggcgaaggtggcactgtgtatggtgatgcaatccttcccggcagctgcagggcacaagaggccatttacaggagacccctgacctggccggcctctgcatcggagaggcccccaggcaccatcccccgccccccccaggggcagaggctgcaggaagaaatctctcccactgaacaaattgccctgctactcactggcttgtgggtgaccccgcagggttcttgttctgtccgtgtcccatggctacataatccagggggaggcaaactgtggcccagagaccaaatcctgcctgctgccttttcttataaataaagttttattggaacacggccacatccattcatttctctatttcatgctttgagcagttgtgacagagactgtgtggcccacaggcctaaaatatgcacaatctggtcatttatggaaaaagttagtgaatttctgaaataaattatcatcaaatcccagccttcccagagtgaagggggtgttattaatttcactgtggccggcacagtgtctcatgcctgtaatcccagcactttaggaagcagaggtggtaggatcacttgaggtcaggagtttgagaccagcctggccaacatggcaaaaccctgcctctaccaaaaaatacaaaaattagccaggcgtggtggtgggcgcctgtaatcacagctacttgagaggctaaggcaggagaattgcttgaacccaggaggcggaggttgcagtgaaccaagattgcaccactgcactccagcctggatgacggagtaagactgtgtctcaaaaatactactgctactactactaattattattattatttcactgtgataacaagtgtaattagattagtggttcttgatccttaagacgtagttagaattgcctgaaagattttctaaaaatcaaagctctcatggcttagcccagatcaattaaattcatcgtcacaattagctgctataacgattaacatgcccattttggagatgggaacacggaagctcagagagatgatctacttgtcaggatcacccagctagtcagtgctggggctgggatttggacctgggcagttgaatgccacaggctcggcttcttaccactatgtgggtgttttccaggtacacagtttgcccaggttcttcagtgcaacaagggggagggtgtcttggcccgtggcataaaagaaggatggggtggagggggaagcccaggtaacttgagcttggtaagtctcatcgtgcaatggtgcttgaaatgctgctattttccagcttgatcaaaatgctgtcatgcttattacctgggactttctgcatgaggacaaggacctggtctgttagagcaggagtcctcaacccccaggccacagactggtaccagtctgcagcctcttaggaactgggccatacagcaggaggtgagcgcagggcaggtgagcagagtgtcatctgtgtttatagccactccccatcactcccatcaccgcctgagctccacctcctgccaaatcagcagcagcaatagattctcaaaggagcacgaacacttgtgaactgtgcatgtgaggaatctgggttgcgtgttccttataagaatctaatgcctgatgatctctgtctcccatcacccgctttggggccatctagttgacggaaagcaagctcagggctcccactggttctacgttatggtgagttgtataattatttcattatatagtacaatgtaataataataaagggcacaataaatggaatgtgtttgaatcatcccaaaaccacgcgcctctccccggtccgtgggaaaactgtcttccacaaaaccagtccctggtgccaaaaagcttggggaccactgtgttagagtgttccctgttgtacacccaggatggtacaaagtgggcgctcagtgagtggtcgctgaatggctagcagaaagaagagcagcacggtgccagtttccaagtgacacgcagatggcgtgatctgcacgtgtcatccattgcccgcagcccccatctccccccagtactgatgctggcttgccattatgggctggggtggcccccacatcccccatccctcccacacccctcctgccagactcagcactcaccgcttccagaggaacttgagtctacgacaccagggtcaacttcttccaggcagaggaaggtgaccagacggtcaaaggacacccgggcctaggaaaaccgaagccgcaggtcacccagcaagaagagcaaagaactcaggttttgggtgtcggtgtctcaagatgtgtggcaacagcttcctgtctaccaagctctgtgcataggaggcgtgaggacaaagctttctagttcatgggaaacgatgcaacccgagtggtgaccttgatggtggtgatctcccacctctgcgatcctacaaatcagtgacaccgaagcaagccagctgccattctgcagacaagatctgggaagaggatggtggcttttccaataaggttatcaagccattgtgtggaacaatttcaaatgttgtccacctgggggcgctctctcccagtcacaaacccatctttggggaagaaagagaccagtcgttaaaatagagattaggccaggtgcagcggctcatgccggtaatcccagcactttgggaagccaagtgcaggaggatcacttgaggccaggagttggagacctggggaacatagcaagactctttgtttctacaaaaaattaaaaaaattagccggatgtggtggcccatgcctgtagtcccagctactcaggaggctgggaggtagaagcatcacttgagtccaggagtttgagcatgcagtgagctgagatcgtgccactgcactccagcctgggtgacagagtgagacactgtctcaataaataaattaaataaataaataaataaataaataaataaataaataaggcggccaggcgcggtggctcatgcctgtaatcctagcactttgggaggctgaggcgggcttattacatgaggtcgggggttcaagaccagcctggcctggccaacatggtgaaaccctgtctctactaaaaacacaataaataaataaataagactgggtgcagtggctcatgtctgtaatcagcactttgggaggccaaggtgggcagatcacctgaggtcagcggttcaagacctgcctggccaacatggtgaaatctcatctctactaaaaatacaaaaaaaaaaaaaaaaattagctgggcatggttgtgcatgcctgtggtcccagctacttggcaggctggggcaggagaatcacttgaatctgcgaggtagatcttgcagtgagccgagattgcaccactgcactccagcctgggtgacagagtgagactccatctcaaataaataaataaataaaaataaaaaataaaaaacatggagatggctcaggtatgccgccgtttcttgttttcaccatgctgaaaggactagagatagcaaaggaagagaaacaaaatcgctttgtataaaaaagggaactgacatgattgcttgtatgtggaattgctgggcagatggacaagtatgcatgttctgaggtgtgtgtggaaaggtctgcacattgccctccaaaggctgaccccttccagatgtatttgctgtactctctgcccgcctctgttcttgcccctacccgcctcttttccagctccacaccatccctctccctcccactctgtcttccctctcctctgcaaatggcaggggtagggaagctggagccaggtgtagcccacgcactctcccaggatggctccagcccttgcacccacctcacctggacgagggagtggatggagaagggcaggaaagcctgggccttgttgaggatgttgagaactgtgagagtcacaaaggctttctctgcattcatagcattctcggccaccagagtgtggacagcaaacaccaccagtgcgacctggggggtgggggggacacgtggggcaacagtgagacacgcaagcatggatagggcagcctgggcaagctgtggtgcctgcacggtccatgtggcccacccgccatgtccgcatgtgcttccctccgtagatcccactcccagtcctgctaacacatgtcctctccgcagtcataagctacataaggctctctctaaagacacagcgcattgctaatggtgatgagtgcgcagccccacggctctaggcatcactagaacctaggggagaacctaatgcctctaggttccaggcatcgggggacagcagagtttttgatcttggtagccctgttgttctagacgtggtggaacttgtgattctagagtcccttggaagatgactctaaagttgcaggcaggagcagcacttgagggctctaggtgttggtgccatttgtggtgcttttttttttttttttgagatgaagtcttgctctgtcgcccaggctggagtacagtggcatgatctcggctcactgcaacctctgcctcctgggttcaagtgattctcctgcctcagactcccaagtagctgggattacaggcgcccgccactgcaaccagctaatttttgtatttttagtagagacagggtttcgccatgttggccaggctggtcttgaactcctgacctcaggtgatccacccacctcggcctcccaaagtattgggacgacaggcatgagccaccacacccagcctacgtatcaaattttttaaaactgtggtttaggaaggttgttctgacagcaatatgaaataaattacagaatggcaggacaaggatcacgtccagtgacagggtggctatggacatctgctggccaggatcagggaagtcactctgacccaggattctacctctgccacccccctgcatctgtaccctcctccccacatcggtagaagcctggaactctctctgagagttcagcagactttatcagccactgccacctttgctagaataatatgattaattagttcttgtagaagacagcagggacccagagagaacaggatccagaatgagtgggttttgatggacggggtggtaggatctggggggctccacctacctcaccctgcccccacccccgcactccttccccagtgctgctcagcatagagactagagtgacgtcaccagaaatgtagacacttggaaggacaccagcgacacagagaagaggaggccggaggtccgcaaggcgcccagctcctggcctcggatgcccaggactctgtccagaaaggctccctcccagccatggaacttgatggtcttcgagttcctgaggatagagctggtgagccgtgcccgtgagtccttctgcctcatttgctcctcctgggatcggagggaaaaagagagatgaagacagggacagttgagaactcttccctgcaccctgacagccacccttcagcaaatcccattcatctcaccaaactgcgtcccaaacctgtctgcctctcagcacctctgaccctcactcctggtccaaccaccatcatcctgtacctggacttctgcaggagtgcccctgggataatgtgccccatggaggaagcctctgatgcccggagaacagaggcagcctgagcccacctgggtatgacaccatcaggaaggctacctggaggtggttgatgcctgagctacgtctttttttttttttaccttttacattttttgtggagttggggtctcactatgttgcccaggttggcctcgagctcctgggctcaagtgatcctctgccctcagcctcctaaaatgctgggattacagcctgagctaaatcttaaatgaccaggaagtgcgtgctgagcaggcagaggatggggggatggagctggagaagagggaggggaggggcttgagatgggggtggggggtgggggctggggggtaggggggtggcgggggcacctaaaacccaggcacagggaatagcatgactcagaggacactcagtgtgaccagaggagcgtgtgggcagggtcacttggcactttaaagtcaggcagaagaattcagggtctcctgtgcttcaccatggggcggggggcatcatcagaggggcagctgcctggagaaggttttactttttgagaccgagtcttcctctgtcgcccaggctggagtgcagtggtgtggtctcggctcactgtaacctccgcctcctgggttcaagcgattctcctgcctgagcttcccgagtagctgggattacaggcgcccgccaccacgcccggctaaattttgtattttttgtggaggcagggttatgccatgttggccaggctggttttgaactcctgacctcaggtgatctgcctgcctcggcctcccaaagtgctgggattacaggtgtggcctcccaaagtgctgggattacaggtgtcagccactgtgcccagcctagaatgttttagaggagtccacgcaggaggctgaagaaacagcccaggtgacagacggacactgggacagctgggccaagagaggaaataagttccttccctccatcccccatctctccctctctctttcccgccttttctttccttccttccctatctcctttcttcctctttcctttgctttcttccctctttccttttatttccttccctccctcccccctttcttccttctctccctcattccttctcttccgccctcaattctttccttccctccttccctctgtccttcctcccctttcctatctttccttccctccctccttttctctccttcccctccctccttcctctcctcctttccttcttccctccctcctttcttccatagttcacaaacacttactgagaaccttctgcctgccaagcactaactagatgccgagttggccacaatcagtggcctgtgctgttgcaaagcttccagttaaggaaaacaaggcaatcaaccctgccgggtgcttcctgtaggaccctgtaggttgtgggaagtgctgtggggggaaaaaagcaaaaacaatcccagggcaggcaaaggagaggctgctgctgggaggggagggatggacgtgccatttccttgctggagggtggtgagggaagccgccctgactgcagggaggtgacagaggatcttcgggagtgagggtgatccaggtggagggaacagctaaagcgaaggcctgcagggatgtgtgagatcgggcaggtttgaggatgggagatgtgtggggaaaggcagggaaggaggggagatgggtagaaggtgaggttggaagcaataaggccagctcagggcgggcctggtgggccactgtggggtctttggctcagtctgaggaaaatggggccgctgtgggtctgagtagaggaggggtacaacgtatttggtttgcataggtctcctctggctgggagtggagagaggctgagggcagaggcggggagtgagccaggggcttgctgctgtgacctgggttagagatcatggggttcggagagcctatgctgggaagtgtgacattttggatgcattttgaaggtgatgccaagcaaatctgctgacagatgggatgtgagagaaaaaggcattgaactgacccagggcctgtggcctgaacattggagggacggagccactgtccattgagaggatagggggagggggtgcaggtctgagtgatgggcagctcacagacgacaagaacaaagccagacccgtgggctcgcactcagctctcccctccgcatctcccacaccaggacctgtggcttcctccctacttcctgcctggtccgtccctttcccaaaagccaaacctgatggtggttccttttcttggagatgaagaaattcagagggaggaggctcaggaagacagcgatggcagtgagggcggagggccccaggagctggggatagaaggggcaggatgtcaggagatcccgaggagcccagctctcagaggcacgtgaaccagagcaactccatcttgaatagggactgggtaaaatgaggctgagacctactgggctgcattcccagacggttagggtattgtaagtcacaggatgagataggaggtcggcacaagatacaggtcacaaagaccttcctgataaaacaggttgcagtaaagaaggcggccaaatcccaccaaaaccaagatggctacgagagtgacctcccgtcatcctcactgctacactccaccagcgccatgacagtttacaaatgccatggcaacatcaggaagttaccctatatggtctaagaaggaaaggcatgaataatccaccccttgtttagcatatcatcaagaaataaccataaaaatgggcaaccagcagccctctgggttgctctctctatggagtagccattcttttagatctttactttactaaaaaacttgcttttggccgggcacggtggatcatgcctgtaataccagcactttgggaggccggaggcgggcagatcacctgaggtcaggagtttgagaccagcctggccaacatagtgaaacacagtctctactaaaaatataaaaactagccaggtgtggtggtgggcacctgtgatcccagctactcgagaggctgaggcaggagaatagcttgaacccaggaggcggagcttacagtgagccacgatcgcaccactgcactccagcctgggtggcagagtgagactccgtctcaaaaaacaaacaaacaaacacttgctttcactttatggactcgccctgaattctttcttgcacgagatccaagaaccctcttttgggatctggatcaggaccccttttctgtaacacagctgcagaccccgaaggtggtcagacttgggtcctaagatggggatgtcagggaatctgataagggcagccaccaggtcccagggatctgtgctcatggggtctgctgtgtcaggagatgcctgctgaaggtggggtccttcaatgtcagggagggaaacagccctcttacacgatagggagagagttatattcaagacagattgtgcacacacacgagtgggactggggggtgttcccagccacaacagtaaagttgagacctatggaatcaggggacctggttcaaatcctgaccctgagagttttgagtgtggccttggggcaagtcatctcccttaggtgcaattctcttgtctgcaaaatgggaatagagttgttctcatttggcattttctcttattgcgtttaattattttcctaatcttcatttcatccctcgcaagggttgtcagatttagtaaatcatcatacagaatgcccagttacatttgaagataaagagtgaataaggttttagtctaagtctcgtgaaatatttgggacatacactgagaaattcttccgtttgtctgaaactcacacttcactgaatgtcctgtgttttctctggcaaccctgctcccccaccaacgtggtgattttgggatggttatcttccccctctcggctttggtttctatatctggaaaatgtggaagtggggggtagaataaatgatttttaagttgctgtgactttctgagatttctgcacaggttatttggacccattctcttgacaagccccaccccaactccagtctgtgtgcctcagtttcccgtctcagtccttaggaacactatgtttatttatttatttatttgtttgtttattttgagatggattcttgttctgtgacccaggctggagtgcagtctcatgatcttggctcactgcaacctctgcttcccaagcgattctcctgtctcagcctcctgagtagctgggattacaggcatgtgtcactcggctaatttttgtatttttagtagagatggggtttcaccacgttgcccaggctggtctcgaactcctggcctcaagtgatccacccacctcagcctcccaaagtgctgatattacaggtttgagccaccccacctggcctgggaacactattttctaacattgggccagtttgtttcatttatgcggcaatggcgctacctagtggctcaatggagaagggcgcagagggtaaacaccagcccacagcagggcttggaaaaacactcaaggaatgtgagcagaagatgaacatctctgtctgggggaaaaatggtatcattaaactgtagcaacctcagtgtccactcctccttcaccaagacctcacggtgatgttaggaactgtctaccaagaggcaggaaaagtacacaagcaaagtaacatggtgcattatctatggatatcttgttggtctcatctaattttttttttttttttttttttttttttagaaggagtctcactctgtcgtccaggctgcagtgcagtgatgtgatctcagctcactgcaacctccacctcccgggttcaagtgattctcctgcctcagcctctctagtagctgggattacaggcacatgccaccatgcccggctaatttttatattttcagtagagacagggttttgccatgttggccaggctggtcttgaactcctgacctcaagtgttctgccggccttcacctcccaaagtgctgggattacaggcgtgagccaccgtgccccgcctggtctcatctgatttttagcaacggtggggtcaacctgatcaattgccctgaattttcccatgttcttcctctctccctctctttcttcctaatgatgacatttatgtactgcacatgaagccctgtctgagtgccttatgttgtaattgctaagcacctgcctattgtttgcaaggccctggaatacaaggtgaagacactggaaaaagtcctggcccctagccttagcaaaaacaatcatatgcatgagcattcgagttttttttggaatattcagcaattacaatcaaaatgccattaacagtttttacaaggccaggcacagtggctcatgcccgtaatcccagcactttgggaggctgaggtgggcagatcacctgaggtcaggagttcaggaccagcccagccaacatggtgaaacccagtttctactaaaaatacaaaaattagccagatgttgtggtgcacgcctgtaatcccagctactcaggaggctgaggctggataattgcttgaacctgggaggtggaggttgcagtgagccgaagttgtgccattgcaccaaagcctgggcaacacagtgagactctgtctcaaaaaaaaaaaaaaaatcaaaaggatactatttcacgacatatgaaaatgatatgcacttcaaatgtcagcatccataaatagagttttattggaggaataccatgcctgtttgcttagtatggtctacagccacttctgcactccaagggcagagatgaatatttgcaggagagatggtgtggcctccagtgtaaaaagcatctactgtcttatcctttatggaaaagtaactaatgataatattacaaatacctacagggtgcagttgtgtgcccggcacccttttaagtgctttctacatatgggctcgtttaatgcctcagcccctctggggcaggagtgctactgttaattatgatcctcacgttggagacaagaacaggaggcacagagagagtagggtccttgcacacagattcacaactgataagtggtcagaaggaggatttgagcctaggcagttcccgatacagagtctaattttatttttacttttatttatttgttggagacagagtctcactctgtcacccaggctggagtgcagtggcattatctcagctcactgcaacttccacctccaaggctcaagcgattctcctgcctcagcctcctgagtggatggggttataggcacccaccactatgcccggctaatttttgtatctttcagtagagacggggttggccaggctggtctggaactcctggcctcaagtgatccacctacctcaccccccaaattgctgagattataggcatgagccactgtgcctggcccagagtctgattttaatttaaaaaaagaaaatcctataccacaacgttaaaggaatgaagttggaaagtaaatgttttgtttgttttgtttggttgtttcctgatggctactttgtgttttttgaacactaagtagcaatttttccccctaaaatgttctcctcttgtgttttgtggacagtggctatggtggtgcctcagggttactggtaacttcaaaacatggttaacttgcctactgggtaccctaatagcacatggggaagtatcaacgtcatcatcatcatctttctacagaggaaactgaggcccagagagggtgaacttcctgcccaaggtcaagtgaaggtcatccttattgaggacttttcccatcgtatcagacaatagtaggcaaattgagacaggattggaggaggaggagaaggaggagatgggggtggaaggggaggagaaaaaggaggagaggaagaagaaagggaagagaaggagagggaagagcagagggaagagagggaggacggtagaggagaagaagggagaagggaagaagtgggagggaagatgacagggagcagaaaggaagaagaaggtggagcaggagagaggaagaggaggaggagggggaaggaggaaaaggaaggggtgcaggaagaggagggggtgcgtgggcagaaggtgggagagatgcaggaggagggagggtgcagggaggggtgcaagaggaggggggcaggaggaggaggctggggcagagggagaggggaggaagccttatgagcttctacaccaggaatggaatccagggtgatgaaggcagaacaagggtaaaacctttcatgtgcctctctgacaccaacctggttctcccacagcctcagacttgccctaaccctggggtcacagcggacctcttccagcctcttgaatgctaagtcaggaggaggaagggtgggagggggaaggaggagggggagaaggagggggtgggggactccgttcaaatcccgtcttcctcctctggcatacctgccagagatagacgaagcagaccacgatccagacgagaggcagccacagcccgttgaggtagaggacgctctcggtcagccgctgcacgtccacggacaccagattgaccacatcacccaccgcactggcctttctggagccgctggacagagccaggacctggcgggtgggcagaaggagagaagtaaagtggggaggccggggcagagggatgccccaggtggcttctccacccactgagccccacctcacacgtctgcgaggtgggtgagtaaagtctcttaggccaacctctcagggctctttgaggatccacagagatgacaaaaatgaaaatcctccaagatccctaaagcacgggaggcataataatgaataacatgcacgaaaacaccagattaacacagataacggtggtcatctgcccagtgctcaccatgtcgcaggcactgtgctaaatgaacagccttatcctttcccggggtgctcacagccatgaatggtaccaagcaggcactaccatattcattccctctaatgccaggccaggtgcagtggcctctgcctgtaatcccgccactctgggaggctgaggtgggaggattgcttgatcccaggagttcgaaaccagcccgcgcgacatagtaagacccaagctctacaaaatactttaaaaaattagccagggggccgggtgcggtgcctcacgtctataatcccagcactttgggaggccgaggtggacagatcacctgaggtcaggaggtggagaccagcctggccaacatggtgaaaccctgtctctaccaaaaatacaaaaattagctgggcatggtggcaggcacctgtaatcccagctacttgggaggctgaggcaagagaatcgcttaaacccaggaggcagaggttgcagtgagcccagatcaagccattgcattccagtctgggcaacaagagcaaaatccatttcgggggggaaaaaagaaaaaattagccaggcatggttgtggtgcgcctgtggtcctagctagctactggggaggctgaggtgggaggattaattgagtacaggaggttgaggctgcagtgagccatgttggtgccactgcactctagcctgggcaacagagcaagaccctgtctttaaaaaaaattctatggataaattgctctctattattctctcaccaaggaaaataccacttccagttaaattaagacatgtaagagacatctcgattttggaagtattagagtgaaaaaaaaatgtgagacgagaatcaatgaaatgaacatttactaaccccattctatggctaaagaaactgaggcagagagaagttgagcaacttgcccaaagtcacaggccttgtaagctcctacacaaggaatggaatccagggtgacgaaggcatgacaagggtgagacctttcatgtgcttctgtgacaccaacctggttctctggcagcctcacatctgccttaaccctggggtcacagtggacctcttccagcctgttgaatgctaaattccaaatgcagccctccctttgtgactgcgtgagggtgtgaagaagtgatccaggaatgactggacatagaaattctccacttagcaagtctttgaagagtgctcactgtgtgactcacactgagctgggaactgaaaatacagctgtgaacaacagagatgaggcttgctctcccgggcctggagtttgaggtggggaacaaggctctataataaagatttatataactggccgggcacagtggctcacacctgtaatcccagcactttgggaggctgaggcgggtggattgcttgaggccgggagttcgagatcagcctggccaatatggcaaaaccccatctctagtaaaaatacaaaaattaactgggcatgctggtgggcacctgtaatcccagctatttgggagggtgaggcaggacaattgcttgaacccaggaggcagaggttgcagtgagccaagattgcaccgctgcactacagcctgggtgacagagtgagactctgtctcaaaaaaataagacaaaacaaaaatatttctaaaactcatgctttaatggcagttatgatgagtaacataaaaaagtagcccaggctgagcgcgttggctcatgtctgtaatcccagcactttgggaggctgaggtgggtggatcacctgaggtcaggagttcgataccagcttggccaacatggtaaaaccctgtctactaaaaatacaaaattagccgggcatggtggcgcacacctgtaatcccagctactcaggaagctgagacaggagaatcacttgaacccagggggcggaggttgtagtgagccgggactgtgccactgcactccagcctgggcaacaagagcgaaactctgtcagaaaaaaaaaaaaaaaaaaaagcccagaggttagagaggagggatctgatctcatcaggagatcaaagaaggcctcctggcgtgtgggtggggaataggaagatcaatgcctgctcaccaggcggccttcctcttaggctcaaggaaatgtggactctcaagacaggatagggcacacctagctctggcatgctcaggggaacaggagcctgggatgcagcactctggcaggaaagcatcaagagctgccctctcggccacctaggagctgtcccctctgtcccctcctcccctaggtgacagctcaggtgtcagggaatgacacttacatgggacgggacctgccctggctcagatgctccataccccacaggagccaatagctcttggggcagcagtccagggacttagcttccagagtcccaggaacggacaagagccactgcacagagagaagtctaaagctatggcctccaaccaggtattcacagtcaatggacagaacttccagcccagatgcaatttgggtttttttgttttgttttttttttgttctgagacgaggtctcgctctcttacccaggctgcgctgtagtggcgtgatctcagttcactgcaacctccacctcccgggttcaagcgattctcctgtgtcagcttcccaagtagctggaattacaggcacatgccaccatgcctggctaatttttgtatttttagtagagatggggtttcgccatgttggccaggctggtcttgaactcctgacctcaagtgatccgcctgtctcagcctcccaaattgctggaattacaggcgtgcaccactgtgcccagcctaggggtcatttttaccccaagcagtattgtctgggaacacagctgacaggccaccttatcagaaggttaatcctttatcctcaagggggaatgagtggaagttaaaatcaggctcaaaaattaaaattagattgggggagtagaagtggtgcctagacagtgagaacagctgcaaaggccccagggtgggtgggggcctggagtgtttgaggaactgaaaggagacctgtgtggctggaggagagtgagcatgggaggaggtgacgggatgaggtcagagacaccctagggacagatcacacaagaccttacaggaataactaaggagctgagacagatcacttgaggctaggagttcgagaccagcctgaccaacatggcaaaaccttgtctctaccaaaaatataaaaattagctgggcgtggtgacacgtgtctatagtcccagttactcaggaggctgaggcaggagaatcacttgaacccgggaggcggaggttgcagtgagccgagattgcaccactgcactccagcctgggtgacagagcaagactccatctcaaaaaaataaatacatataatacagagaaataactaaggaagtgagaatgtatggtgagtgactctaataagcaaggactgaatgcgttctcagctgctgataacattactgcccgctcagtgatactgcttttcctggctgggaagacctgcccttgtcccccagggctcacctttctgtacaccaggccagtgatggccgaccgcaacctcatctgcagcaccttgagcctgtacatgttctgctgctcaaacagcgtttgcaggcaggctgagaggaacatcagcacggcgaggaggtagcccttccaggctggaggcttgggatcaccaataaactccaggaaaaggcttgcaggggaaggagggagaaggtacagctggtgagaggaggtgcctaagggtgttgcctttgcccaaaccagtccagatgtggaggatcagtcggcccaaactagtccaggtgtggaggatcagtcagtgtggttttttttgcaataatggtctccgttatttcccccactgtccatactccttttcaatctgactgcagctcctcaagatcaagaggtggagtttttgttcccacttgttataggctaaattgtgtcctcacaaagtttatatgttgaagccccgacccccagtacctctgaatgtgactgtatttggaaatagggcctttaaagaggcaatgaagttaaaaatgaggtcattaggctgggccctaatccaatctgatggggtccttttaagaagaggaaatgtagacacacaaggagacaccagggggcgcaaacagaggaaagaccatatggggacacagggaggaggtggccaactgcaagccaaggacagaggcctcagatggaaccaccttgcagatactaatctcgaacttccagctttgagaatcatgataaaatacatttctgttgttcaagccactcagtctcagtctgtgatgctttgttatgtcagctgagcagacaccacttgaatctgggctggctacaaaaccggctttggccaacagagtacagtggaggtaaagccatgctggctctgagcctaggcctcaagagaaaatgtggtttttggtctatttcttagaaccctcccaagcacccacatgaacaagtctgagctagccttttggaggatggggacccacatggagcagagacagccatcccagtctcagatacacaactgcaggcacatgagaaaacccagccaagaaaagaaccaccacccagctgagcccagcccacattactgacccacattaccatgaactaaataaaagaatgtttgtcattttaagccactcacttttggggcattttacagcaaaaactaattgatgcagtcaggtaagagcttgcttatttgcccttctgggggtcagtcactttctcattaatccatttcccttcctcagtgtccttctcacccaccatccagtgtcccgagcaccagacgtataggcagaggcaggagagctgaagccccctggccctggaaggatgccactaagagaccacccaccttagcagggcacttgaggtctgggactcacctgagcagcttggggacagtgaacctgaagacatcactgatgatgaggctgagggtccccaggaggaaggtagaatggaacacctgccagatggccttcagcagtgggcgccactggctcccttcttgccgtaggaagggctcggtctctggagccttcatgccactgccgcctttccttttaaatgctattgccttgttgtgcctgaggggaagggagagattagctctgggtcccattttatactctcagccgccagcggcagggccaggcattaaagggttgttttcccaacagtggagatgggtgggtgtggatctagcctggctccctcacctgttcctccttatcaccctgagtacccacttaagaggcaatcatgggagttggggggcagggcaggagggcactctgaggcctcttagatggccatgggaaagcacacctgttgagcacctactatgtgccaggcactccccagtcatcctaagaccccctgagaagccaggtgttgttcccatttcacagatgagaaaactggggctcagagaagcgaacttgcccaagggcacacagctgagaagtaaaagaactggaatttgattccagctctctgcctccagagcccatgcacttttcttttttcttttcctttttttttttttgagacgaagtcttgctctgtcgcccaggctggagtgcagtggtgtgatctcagctcacggcaacctccacttcccagttcaagtgattgtcccacctcagcctctcgagtagctgggattacaggcaagtgccaccatacccagctaatttttgtattttcagtagagaaggggttatgccatgttggccaggttggttttgaactcctgacctgaggtgatctgctcgccttggcctcccaaagtgctgggattacagatgtgagccaccacacctggcctctcatgtacttttcaacctatcgtgttgtcaacctggaggaagaacagcaccccgtccccaacacacacaatcagccagcccttaggtggttttgaactggtggagaatcacggctgatgggcatggggcctggtgctctagctctgggtgaaagtgcagacagaagctcaggctgcctcaaactaataagatccccagcctttggctataaccaggggccacagagaagagctaaggtgagggagggagaggaggagatgggggaggcccgagggcccctgtgaggcaggtcagaagccctgggccagaaaggagaggctggggcgatgcagctgctgacagtccggttgctgtgtggtcctgggcggggacactgctcctctctctgtgtgtgagaggatgggtgtggtcccctgctgagtcccctgtggctctgacaacctataaggttatcagtaatttctttttctttttcttttctttttttttttttttgagacagagtttcgctcttgtcgcccaggctggagtgcagtgtagcaatctcggctcaccgcaacctctgcctcctgggttcaagcaattctcctgcctcagcctcccaagtagctgggattacaggcacacaccaccatgcctggctaatttttgtatttttggtagagacagggtttcacaacgttagccaggctggtcttaaactcctgacctcaggtgatccacctgcctcggcctcccaaagtgctgggattacaggtgtgagccaccatgcccggccacttatcagtaatttcaatccccattacagatctgtgacccggggccacgtgctgggatcagctctttacacgaaggagctcactgactcccctggatccccttgccaggtgagcattattaggttttccattttacagaaggggaagctgaggctctgagagatggcgacagccgcccgaggtcacacagcaagggcagagcagggatttgagcctagatcttgatttatggtttgtaaagggtttcttgtgcactaaggacccccaacctcaccataataaaataataataaaaaaagaagcataagaaaaacctctggtgagctcaggtggccagacccttcaaggccaaggtctctgtcccacattattggtctgatctggtgtttggtttggcatctatggagggttgtggttcagctctgttactgagtgggtgtggcctgctgctcacaaatattttggcatttggatctcaaagccaagaagatgccccttccatacagagagcatccctgcccaccctttcctgtttgatcctgccatttaattcattgccttcacagccatgtccatggctccaaccctctctttgtctcgttagaaccccaggtgggtagactttgcctgtgttttccaccaagatgtccctagtatagagtccagctcctgcacacagtaggagctcaataaacacttgtcaaatgaatgggaaaaacagattgagtgatgtgtgcaaagggcctaataagagtgccccctgcacatactgttataaaaatttatagaaggaaggaaggagcttggctgggtggacagaacttggctttggagccaggagactgtggttccaatgcctgctctgtctcctctcctctgagccttagtgtttccatctgcaaaatggggtcggggaagagttcactggaaagttttctttctggctgaggttctgctcagttctatttgagctgtttaacccagagagtcagtgtgttcagcctgcaggctccatagcaagtgttttcctctcctgcaggtctcacctcccatcaaggaagatgtccagattgctgtctgacgtctggtctctggactgaaggccatttagtgcagatctcacaaatgatggtggggcaaggcagggggtatgcatgagtggcatgggcaaggtgtgagttgggggatacaaaagggagtggtggaggccgggcacggtggctcacacctgtaatcccagcactttgggaggccaatgcgggcgaatcacctgaggtcaggagttcagggccagtctgatagcctgagcaacatggagaaaccccgcctctaataaaaaatacaaaaattagtgaagccgactggaccagcaggtggctgttgtgtggcctctcaggaggacgccctctcccttcccccagtggttgcaaaatacttcagaaagaaaaccaaagttctctgtgggtgcagtcggttgtttcagaagctgacggagcctggtctttgtataaccccatctttcccctttctttctgtcaactgtttatgggaggattctcaaactgttctggagaatgtttctaccctttagttctagtgttgggtgacctgtaattttcatgttggctggggatgccaggagttggcagaggctccttccagagcccctgtggactggattctgccacttccgtaaaatcattcaaaagtagagggtgagtcaggtgcagtagctcacatctgtaatcccagcaccttgagaggccaaggcaggcagatcccctgaggtcaggagttcaagatcaccctggccaacatggtgagaccctgtctctactaaaaaaaatttaaaaatcagctagatgtggtggcacacgcctgtggtcccagctactcagaaggctgaggcaggagaattgcttgaacccaggaggtggaggttgcagtgagctgagatcataccacaacccagtgaagggggtccagcaagccatgcctggggtgagagagaactgatgttttggttctctcacactacttattctgtttggaaaaacacatgcccttcctttgtgggaacagcccctacccacttctgtggctctgaagggaccaccagtcatggcaccagccccctgggcatgggattggcccctgacaggcacatgacttgagccaggccaattagaggccttccttgggatttactatatggacgttaggagagagatgctctcttattctgctggagtttgctgaacttgcatgggaagggataggccttatggagagaccaacacatagataatagttgggatgggagatgaaaggagagaatcctgacatcatttgagtcccctgatccagcaacacctgaggctagatcctcttagctgtgtgagcctatagtatcagtctctgtctcctctgtctctcttaatgtgtgggattcagccatctgcaacaactaccacaaaatcccggagtatgcagggaacttcccacagagctaacttccttttttgttctgtctcctaaaacaccaagatccggtgaggttaagcaacgtgtccaaggtcatcactatttgaaggcagggcagcatttaacccaattttatctaatcctatgcaggctcatttatctagaccagagtttctcaaatgaggcatcccaggctctaagggctgcagagaagtttccagagatgccactgagggcaggagtggacagagtggataactccaaagatcttaacaccctctggatgactaacagtgcttgagcacttcccatttgcaagacatttgcaagttcttttccataaatcatccttttttttcatccccataagctatgagctggggctaatgacatccccactgaacagatgagaaaactgaggcccaggaaaggaattgctcaggttatatagtaagtgagcagctgcttgtgtgttgagtcacctcccaaccctccaccccggccttaaaatacctcttctgtttgctgcctgtcattctgccatttccccatttgtaggaacctgtttgttccccgtttgtaggaacctgtgatgcgttctgggaggaaccatatcttaagcctgatactacttagtgggatcagctggaaggcaaggtggggaggcggcagtgccgccagagtagcgttgggggctggactgggggtcaaatgatgaggtttttttgtttttgtttttgtttttgtcttgtttgtttgtttttttttttgatacggagtctggccctgtcactcaggctggagtgcaatggtgacatctccactcactgcaacctctgcctcctgggttcaaacgattctcctgcctcaagcctcctgagtagctgggattataggtgcctaccaccacgcccagctaatttttctatttttagcagagatggggtttcactatgttggccagattggtcttgaactcctgaccttgtgatccgcctgcctcggcctcccaaaatgccgggattacagtcgtgagccaccgcacccggccaatgatgagcttttctgaagtagcatcaggtgagttcttgacctccacccacttacctccgggctgcactgcggttcctcatccactccttttcaagccgggaaacaagttcttctgaggagttttctctcccaagcgaccagaggtcttttggtctcagtggcctcctgtatcccctccagaccaggctgcaaaagaggggcaccagggaaagcttttcctgccattcacccctgcaggatcctggccaggcgagtagctgtgtgaccctgggtaagtcactttacctctctgtacctctactggcccctgggtaaaaagaaagcaattcactaaccccacctaatgtctgcagggcatttctcgtttcacaaagattgtctcattaattcttacatgaacccataaggtaggttattattgtttgtttgagatggagtcttgttctgtctcccaggctggagtgcagtggtgcaatctcggctcactgcaacctccacctcccaggttcaagcgattctcccacctcagcctcctgagtagctgggattacaggcacccaccaccatacccggctaatttttgtattttttgtagagatggagtttcaccatgttggccagactggtctcgaactcctgacctcaggtgatccacctgcctcagcctcccaaagtgctgggattacaggcatgagccaccacacccagcctgtaaattgatagtttataattgtataaatgtatgagtatattattatagatctattttacagatggggaaggaaatagaagtgcagagagattcagtggctaaaccaagggatagcccttggcaagggaaacagacatttccctgggaatcagaagtccgttgaccaaaactatcattgtagaagaagcttgaactcctccctcagctttttttttttaattattattattttttttgagatggagtctcactctgttgcctaggctggagtgcactgatgtgatctgggctcactgcaacctccgcctccctggctcaagcgattctcacgcctcagccttctgagtagttgaaattacaagccaccatcacacctggctaatttttgtgtttttggatggtgtatcaccatgctggccaggctggtctcgacctactggcctcaagcaatcctcccacctcagcctcccaaagtgctaggactacaggcgtaagccaccacacctggctaatttttttgtttatagtagagatgggatttcgccatgttggccaggctggtctcgaactcccggcctcaagtgatctgtcagggttggccttccaaagtgttgggattatgggtgtgagccactgtgcctggcctcaggtctctttaatctttctgatgacaccagccagaaggtcttgcctggttctggtctctgactcttctctaagccttaccaagttcccttttcttttttatttttattctttttatttttttgagatggaatctcactctgttgctcaggctggagtgcactggtgtgatctcggctcaccgcaacctccacctcctgggttcaagtgattctcctgcctcagcctcctgagtgactgggattgcaggctcccaccaccacacctggctaatttttatatttttagtagagatggggtttcaccatgttggtcaggctggtctcgaaatcctgacctcaggtgatccacctgcctcagcctcccaaggtgttgggattataggcgtgagccactgcgccaggccaccaagttcccttttctaatgcagagccaacttggggaagcaaccgttctgacatagaaattattaacgtggcttgattttccctgaaattatttttggagttctcctatatggcaagtgatgctatagatttttcctattttagcagtgatagagagtttctttttaaaaacagtttattcgagtaaaaaaagtgactcaatttagtttttgccccagtaggacaaaaaagcatcaagagtggtccataaatgcttaagtttgggaagcaggggctggaccccccagtagagctgtttcgaaaacctctaagctctttctaccagttccacacattcaaagcctgatatttttcatttatttaatagccatttaggccgggtgcggtggcttatgcctgtaatcccagcactttgggaggtcgagtggggtagatcacttgaggtcaggagtttgagaccagcttggccaacgtggtgaaacccggtctctacaaaaaactacaaaaattagctgggcatgatggcaggcgcctgtaatcccagctgctcgggaggctgaggcaggagaattgcttgaacctgggaggtggaggttgcagtgagctgagattgtgccattgcactgcagcctgggcaacaagagtgaaactctgtctcaaaaaaaaaaagagaaaatgaatagcccaggcacagtgggtcacacctgtaatcccagcactttgggaagccgaggcgggcagatcacctgaggtcgggagtttcagatcagcctgaccaacatggagaaacactgtctctactaaaaatacaaaattagccgagcatagtggtgcatgcctgtaatctcagctactcgggaggctgaggcaggagaatcgcttgaacccaggaggcggaggttgcagtgagccaagatagtgccattgtactccagcctgggcaacaagaacggaactccatctcaaaagaaaaaaaaataattaccacttaaactcattatttgccaggccctgttctaagtgctttacagatctcatcttatttaagcttcacaaccctatgagctaagtgctactatcaatcccattttgaaggagtggagactgaggcacagagaggttaagtaactgtccaaagcaacacagctaggaagtggtagggccaggattcaaatccatatgtcaggtgctactgaggtctgaatgccgtgtggttaggagagagcacatcctcaagtgccttgtgagctggccctggagaagcagctgttttctcaatctgcctggaaccctctagaaagtagacacttgctcctttatctcctcacccctggggcttagcacatagtaggtgcctattaaatgttggtggaatgactgaaatcaagtattggagacaattctaattactattaagcacccgctgtgtgcaagcactaagcactttccgtctcatgcaggttgagtcatccccattttacagagggaaaactgagactccggaggtttgcgacatggcctgctaacaggcagagccgggattcaaatcaagatctcactccagtgagtgaatgggaacaggatgcagatggtagacactgaacacgaagaagaaagcactgaggctgggatgaagaaagacttgctggcctttgtaagcacaggggaagggccatggctgggaatcagagcagcaaatgcaggcgggtgaggcaccaccccaacccttccgtgcgactttacttacccagaaacccaccagaacgtggctttggaggggaaggctgccccagtctctggacaggggttctgcaacagacaaaaatggagaagggaagtatgtggcaagggtaggaagacaggacgaactgtgtatttttttttttttcgagacagggtttcgctctgttgcccaggccagagtacagcggtgtgatcttggctcactactacctctgcctcctgggttcaagcgattctcctgcctcagccttccaaagagctgggatgacaggtgtgcgccaccacacacagctaattttttgtgtttttagtagagacagggtttcaccatgttggccaggctggtctcaaactcctaacctcaagtgatctgcctatctcggcctcccaaagtgctgggattacaggcatgagccactacacccagccctgacggtgtatttagtactgaaagtaaacatcgaggtgccctgtctccttgccaggggtgtagaccagtgagcttggtgcttcccagcaggcagcgtaaaaagaggttgggccacaggcctgacaatgtccacaaggtaagaaataacagtggctcagaagaacaactatgattatactgaaaccaaaaccttgctttgcttctcaaaaggaaggacactgcataacgaagaaattagatccttgacaatatccctcggcaaatgttgtgaagacagacctgtcgtgcgatttttgtcaggtgctccaggaagattacaacagtctgtactctttaccaataaggcgtgaaggtgcccatttcaccacgtttttgccatcacagcttattaatttttaaattttgttgctactctggtaggtacaaaaaagattcctatgatagttttaactattctcaagccttcgagcaatttttttttttttttttttgaatacagggtctcgctctgtcacccaggctggagtgcaatggtgcaatcatagctcactgcagcctttatctcttggattcaagcaatcctcctgctttagtctccacagagctactctgtagtgggactacaggcatgcaccaccacactaggctatttttaaaaacctttttgtagagatggggtctcactacattgcctagtctgatctagaacacctgggcacaaacaatcctccttcctcggtctcccaaagtgttgagattacaggcatgatccactgcatctggccccatttgaacatctgtttatatgatgtcagatcagtctcttccacaaaagaattgtttcttgatttcacagactgcttcactgttacctattgtaaatctctcaatctctcatgagcttcttctatggagcacttaccccaagggtaattttctttttccttctttttttttttttttttttttggtggagttccgctcttgttgcccaggctggagtgcaaatgcacagtcttggctccctgcaacctccacatcccggattcaagcaattctcctgcctcagcctcccgagtagctgggattacaggcgtgcaccaccatgcctggctaatttttgtaattttagaagagatgaggctttaccatgttggccaggctggctttgaactctcgacctcaagtgatccacctgccttggcctcccaaagtgttgggattacaggcatgagccactgtgaccatccaattttcaacatatttgtttaattttgtgaccagtgtctggttcccctgcttgaccagtagctacgtgagaacagaaactctatctgcttgttcaccatagatccttatgcccttgctagggcatagcggggtttggcaaactatgaccaaatctggcccactgcctgtttctgcaaatagtgttattgcaacacagccatgcaatttgttgacatattctgcttttgcgttcaatggcagagttgagtaattgccactgagatcactgtatggctcacagagtccaaaatattttctcttggcccatatagaaaaagtctgccaactgtggcatcgagtagaaatgtggtacactttttgctgaatggctaaatgaataaaaaaattaaagacttttggtcacctgggggagactgagacctcaaagtggaacaggaatgaggttggaacttggtgacttacagactgctgggggtcttcagggaagaaggggggttgatccgccaggcaggacagcacaaactgtgccaccaccagagacaggcataggtaggtggacaggtggcggacagggtcgctctggaagccctgtgggagggaaagcagaagataaggaatggagacagaggagggtgctcagaggagagaaaaggtttctgatcttgggtcagtgcccactctggggaccagggcaagagtatttgaaagccagagccctggctttcctagtggttctaattttctttctttcttttttttttaagacaaagtctcacttggtcgcccaggctgaagtgcagtggcatgatctcggctccctgcaacctctgcctcctgggttcaagtgattctcctgcttctgcctccttagtagttgggattacaggtgcccaccaccatgcctggctaacttttttaaaatatttttagtagagatggggttttgccatgttggccaggctgacctcaaactgctgacctaaagtgatctgcctgccttggcctcccaaagtgttgggattacaggcatgagccaccatgcccagcaggtcctaattttcaaatacccaatttataatattctgtctatacaaatggtgggccagggctgcgtctgggttttgtccttagccacatgatgattggccacagctgctgggacaatgagatgaagaaacaatttaccttcttctttgtgccacaaaagaaatcctttctccgttccaccctctaccccaatcttcaaccctgctcccccttggccagggttctctgttttgcagagatgagagctggttttattgagcactgaccctgccctgagcacatgcggcattcttgccatacacagtctcatcagctggagtttacttgcttcctttgactcagggggaaaccaaggctcagagaagtgacagcaccttgttcaaggacacgcagatgatctggtccaaattgtgatgctcctgctgccacaccacaatgatttttgcatctgctgccctgtcatctggtcagaaacaccctaattttctttctttttttaatttaaagcattttttattttttaattttaggtgtgtgtgtgtgtgtgtgtgtgtgtgtgtgtgtgtatactttttttttttttgagacggagtcttgctttgtcacccaggctgatgtgcagtggcatgatcttggctcactgcaccctccgcctcctgggttcaagcgattctcctgccttagcctcctgagtagctgggattacaggcatgtgccacgacccctggctaatttttgtatttttagtagagatggagttttaccatgtaggccaggctggtcttgaactcctgacctcaggtgatccgcctgccttggcctcccaaagtgctgggattacaggcatgagccaccgcgcccggcctgatatatatatttctggatgacgtgagatattttgatacaggcatgcaatgcataataatcacatcaaggtaaatgaggtctccatccccgcaatcatttatcctttctgttacaaatgatccattctactcttgtagttattttattttttagtttattattgagttggagtctcactctgttgcccaggctggagtgcagtggcttgattttggctcactgcaacctccgtctcctggattcaagtgattctcctgccttagcctcctgagtatctgagattacagatgtgtgccagcacgcctggctactttttttgtatttttagtagagacagggtttcaccatgttgcccatgctggtcttgaactcctgacctcagatgatcctcctgccttggcctcccaaagtgctggaattacaggtgtgagccactgtgtccagcctcttttagttattttaaaatgtacaattaaattattattgactatagtcaccctgttgtgctatcaaatagatattattctttctgtttttttgtacccattaaccatccccatttcccccacccactgtccttcctagcctctagtaaccttccatctactctatatgttcatgagttacattgttttaatttttagctttcacaaataagtgagaatatgtaaagtttgtctttctgtgcctggcttatttcacttaacatccatgttgttgaaaatgacagtacctcattcttttttatggctgcatagtacttcattgtgtatatataccacattttctttatcagttcgtctgttgatggacacttaggttgcttccaaatcttgtttattgtgaacagtgctgtaataatcatgggagtgcagagatctcttccatgtactgattttctttcttcctaagttttttgcttgtgttcgggcgtgtgatttgtgcagaactgactctactccgaggctgggtgggtgaatgaggcctggccaacgaatacgttctggtcttttggctaccatggcagggttaggaatgcacatagcaccccatgctgggtacttgagagctggaaccatcgggagattctgctggctttgctacatgctagaatgtaagtgtgaaggtattggtggctcttcttgccactccattggagaatcaagctaacatggcagagccaagaggcagaagtggagatctggtgatggtacctggtcccaggcctggatcagtcatgcctgggagatcccatgggtatgagctaataaatgcatgagctaatgaacccccttgacttacccttttcattaagctagtgtgaactgaggttttatggctttaaaccagagccctagttttaaatcatgattcctctactggattttatactcttctagttttgggtttttgtttgtttgtttgttttttggcagatagcagacaattggatattccaatgacaatatggcccatcttccctaaactcccactgttttccccactgtttctctcagaaagtttgttctgaatttgcctgagatgaactcgggctctgcactcccaagctttgtggccctgaggccgtcattcccttctcctagccttagtctccctcatctttaaaatgggacggctagaattcatcattggctggggcacattggctcaagcctgtaatcccagcactttgggaggcttaggtggaaagatcgcttgagcccaggagtttgagaccagccttgggaacataatgagactttgtttctatttctatttaaaaaaataaagaacccatcactgtgaactcttgtgagaatccagtgaggagacgtgtgtaagtgcctgccacagtgcctggcacatggttggaaccccagaatgtatatggtcccagtattattgtttctatgctgtgtcccaaaaagctgacttatgtcaactgtgggagcccaccatttcagaaattactgaataacctgtggaatttccccttagttacaaaggttactcttttaaaaactctgtcctcggtcaggcgctgtggctcacgcctgtaatcccagcactttgggaggccgaggcgggtgagtcacttgaggtcaggcatttgagatgagcctggccaacatattgaaaccttgtctctactaaaaatacaaaaattagctgggcatggtggcacatgcctgtaatcccagctacttgggaggctgaggtatgggaatcgattgaacccggaggtggaggttgtagtgagccaagatcgtgccactgcactccagcctgggcaatagagcaagactctgtctcagaatgaacaaacaaaaaataaaaactctgtccttaaggacagggtgatgcttctctaccttctcctttaggggcaggatggagtaaccactggactgaagaaatgatctgtgagtccagacgtggtggctcatgcctctaatcccagcattttaggaggctgaggtcagagaattgctcgagccgaggagttcaagatcagcctgggcaacaaagcatgatgttgtctccacaaaaataaaataatgaagtaaaatatctgaaacctgctgcagcctgttcattggtgttaagataactccctctcccagaagccttggctaagcacactgtcgaggccagtgcttctcaataggtgggtgactttgtcctcctcacccccagggacacttggtaatatctggagacattttgggttactgcaattggatggtatgctactggcacctatgggcagaagccagggatgctgtttcacaccctgcagcaaacaagacagccctgtccacccaacaaagaattgtctggccacaacattactaaagctgaggctgagggaagttggtctaggctacatgtttttctctttacagagaaaatgacccatcatgtctcctaatagagaaacgctgcttccggccgaatgacaagagctcacgcctgtaatcccgacactttgggaggccaaggcaggtggatcacttgaggtcaggagctcgagaccagcctggccaacatggtgaaacctcgtctctactaaaaatacaaaaatttttagtagaaatttagtagaaatttttagtagaaatttagtagaaatttagaataagccaggtgtagtggcacacacctgtaatcccagctacacaggaagcagaggcaggagaagtgcttgaacccgagaggcagaaattgcagtgagctgagatcatgccacttcattccagtctgggcgacagagcaagcctctcaaaaaaaaaaaaaaaaaaaaaaaaaaaaaagctgcttcccagattgggcaacagaaatacgagtggtgtgcagaatgagtgtgtaaatataggtgcataggaacatggggagggtgaatccatgacatgaggggaggtgtgcacggaggggtatgtgtgcacacaggtgtgtctgtgcccaggttgtgtgtgtgtgcgtgcatgcatgtacttgtgcgatgtatgaatcagtgcctataagtgtgtgcatcgtgtgcaagtggcacgtgtgatgtgggcctgtaagacaggaaattgtgttgataagaaatgtatgggatgatgggtactgacaggtgcgggagtggattttgtgtctctagagtgtaagtgactggcttgtgtgtgtcactgtatagagaataagttgtatgtggaaacaggaggagaaaggaagggacccaaggcatgagccaccattttggtttcccagggtggcccacgccccgacttaccgctccggaggcctgctgggcagcgttggtagctggcaagacaaagcagagaagccagtaaccaaacagcactccagatgactggactccctttttcctctcggtgtgaatcaggaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatcgtggtgagccacacagtaggatgaatgaggaattctggggcctcaggcgttccctgttggattttccaaagagcgacagccacgctggaggtacacaggactatgagggcgaatccaagcacctgaggatacaggcttagataagcttggggggcaataagagaggtcacagcaaactggtaggcggccccatgtccaactgggagctggttctgcaacatcctggctgatactgagtataccagggtcaccagctagcaacgtgccaatgtgaacaatgtgtaaagggcattgcagatcactcctgacctgtaactgtcatataaataatgcacaggaagggcttgagccaaccgagtgttttccaaaatgcaggaagtgctccaatcgtgcacatatgagatgactgtgggtatggagaaacagcaggaaatgaaatgtactcaccaggtaaaaaactatcctttctccaagtcatttttcaatccctgctatgaaatcaaggagcaactctctgttgggccagtaagtctctagggtctctctaatatattttggtttctctattgaataaaagaaaggaagaaaatgagagaacgtgggcacaccagagggaaggccagagctaggttacgttggaggaactgctcaaagaacctcagtttaaagcagaagttggcaaactatcaatcatcaaagaaaaacaaaaagcatatgtcatgacaggtgaaaattacatgaaatccaaatttcagtgactacaaataaagttttattgaaacgcagtcggccgggggtggtggcttacacctgtaatcccagcactttggcaggccaaggcaggcagatcacctgaggtcaggagttggagaccagcctggccaacatggcgaaaccctgtttctactaaaaatacaaaaaaatagcgaggtgtgggggtgggcacctgtaatcccagctactcgggaagctgaggcaggagaatcacttgaacccaggaggcggaggttgcagtgagccgagatcgcaccattgcactccagcctgggtaacaagagcaaaactgcatctcaaaaaaaaaaaacaaacaaaaaagtaacacagtcatgactattgtctatggttatgactattgcgttcattctggaatggcagagttcagtgttcggaaggaagattacctggctcacaaagtctcaaatactgtgtaccgcttggctctttaagtttgccaacccctgggttggtggcgggtgataatgtaaaaattaatacaatggcagaagaatgaatgaactctgaagaacattctttggaagcctacaagaatggagtagaagaggatggatgagcagaaaggctcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtctgtcgctaagtctctgggcagactgctcggccgcgatcctgccggagaagaggcggggctgggctggtcgggctgggctggtccggctgggattcgagctccgggatcgggaggccccgggcaaggtccagctgcgcggcgggagtgaggccacgggaggtgaaaacaggcgaggtgggggatgggggaagagaggcgctcggggagctgggacgggcaccgggttggggggtcccggaacccctgaaagttcagtgacacctccatagttccctcttccccctgcaacaagaatcactccagacttcctaaacactttggacccagcaatttccaggagttcatcctgatgagagaactgaaaggtgtgcacacgttagtaacaaggaggcctggtgaccgcctaagcgtccaatcgcggggaccaccgggtcgaggccgagaggatggagaccgcgtcacaggcacctcgctgctggaatggagggtggtggggagaacttagaagattatgcaatgggctggcagggctatacccagccgccctggtaagcagaaactcaagaaacctctagggtcctgttttctggtcgtatgatcccaggagtgcacatgggcccctcgggtgtctgaacagaagggcataggagggagggccgcagccctgcagtcttactctgctggtgtagcggtcacctgccaactcccaccccaccctgcaccgcgggctcctgagtcggcagattaagcattttataaattctattttaaatacgtgttttaaacttgtcagatatttgtcttcatttcagtccctgcgcctctacctcttgctgtggtcgcttatttaacactggggggctacgttctgctaagtcccagggagagactgttcctaatatccgagggagatattattcctaatatcacgctgggtgaacaccacgtgtgtacagcctctgatacgattggtaatatccaagggagatattatcctaacatcccagtgggtgaacaccatgtgtgtaaacgctgtggtattattagaaatatccaagggagatattactcctaatatcacagtgggtgtacatcctgtgatattattcgtaatatctgaaggagattttactcctaatatcacagtgggagtacacactgtgatattatttgtaatatccgagggagattttactcctaatatcacagtaggtgtacaacctgtgatattattcataatatgctagagatatattactccaaatctcatggtgggtgtacactctgtcatagaattcgtgatatcctagggagttattaccgctaatatcacagtgagagtacaccctgtgatattattcatactatcctagaaagatattacttttaatatcacagagggtgtacaccctgtgatattattcataatattctatgaagatataactcctgatataaccgtaggtgtataccctgtgatattatttgttatatcctagggagatactacacctaataccacagtgggtgtacaccctgtgatatgatttgtaatatcctagggagatataactcctaatatcacagagggagtacaccctgtaatattattcataatatcctagaaagataatactttcaatatcacagtgggtgtacactctgtgataatattcgtaatttcctagggagatactactcctaatatcaccttgagtgtacactgcgtgatattattcgtaatatcgtagggagctattgcttttaatttcacagtgggtgtataccctatgatattattcataatatcttaagaaggtagtactcctaaaatcacagtgcctgtacacactgtgatattattcataatattctagggagatgttactcctaatctcatagtgggtgtacaccttgtgatactatttgtaatgttctagaaagatattccttttaatatcacagtgggtgtacaccctgtgatatgattcgaaatattctagggcgatattactcctaatatcccagtgaatttacaccatgcgtgtacacgctgtgacctcccagaaagatatgactcctaatatcacagtgggggtacaccctgtgctattatttgtaataccctatggatatcataatatcacaatgaacgtacaccattgtgtacatgctgtgatattatttgtaatatttttgggtgatattacccctaatgtcacagtgcgtgtacatcttttgatattatttgtaatattctgtggagatattgcccctaatatcacagtgggtgtatactctttgatactattcgtaacatcctggaagatattatccatattgtcacggtgggtgtacaccctgtgatattattcgttatattctggggatatactattacccctaatatactgtgggtgtaccccctgtgatattattcactatatcttggagatataatattacccctaatatcacagtgggtgtatactttgtgatattattcattatatcctgaagagatattatttcctttaatatcacagtgcatgtacaccttgtgatattatttgttatatcctggggagatactactatattactcctagtatcacagtggctgtacgccttgtgatactattcattatatcctggggagatattattactcctaatatcacagtaagtgtataccctgtgatattattcataatatcctgggagatattacccatattgtcacagtgggtgtacatcctgtaatattatttgtaatatcctggggagatattattactcctaatagcacagtgggtgtacaccctgtgatattattggttatatcctggggaggtattattattcctaatatcacagtgggtgaacattctgtaatattattcattatattttggggagatattaattcctctaatatcacagtgggtgtacaccctgtgatattattcattatatcctgggaagatattaatccctctaatatcacagtgggtgtacaccctgtaatattattcattatatcctgggaagatattatttcctctaatatcacagtgggtgtacaccctgtgatattatttgttgtatcctggggagatattattatgtctcatatcacaatgggtgaacaccctgtgatagtattcgttatatttggggaagatgttattacccctaatatcacagtggtgtacactctgtgatattattcattatgtagtggggagatagtattacccataatatcacagtggatgtacaccctgtcatattatttgttatatccttgagaaatattattattcctcttatcacagtgggtgtacaccctgtgatattattcgttacatcctagggagatattgttacccataatatcacagtggatgtacaccctgtcatattattcgttatatccttgagagatgttactacccctaatatcacagtgggtgtataccctgtgatattattcatcaaattttctggagatattattacccataatatcacagtgtgtgtacccactgtgacagtattgattatatcttggggcgatattactcttaatttcacagtggctgtatccctgtgtttacaccctgtgatgttattcataatattttagggagatattactcctaatatcacagtcagtgtataccatgtttgtacaccctatgatattatttgtaatattttagggagatattactcctaatatcgttgtgggtgtacagcatgtttgtaaacactgtgatattattcataatatctgagagagatattactgccaatatcacagtgggtgtacaccctgtacaccgtgtgatacgattcataatatccgagggagatattactcccagtatcacagtgggttaacaccctgtggtattattcataatattcgagggagatattactctcaatatcacagtggatgtacaccctgtgatattatttgcaatatccgagggaaacattactgctaatatcacagtgggagtacaccctgtgatattatttgttttatcctggagacatattattcctattatcacagtggttgtacaccctgtgatattcttcgctatattcatggaagatgttattacccctaatatcacagttggtgtacaccctgtgatattattcgttatatcctggggagatattgttacccctagtatcacagtgggtgtacgccctgtcatattatccattacatcatgggaagatattattacatctaatatcactgtgggtgtacaccctgtgatattatttattatatcctggtgagatgttattactgctaatatcacagggtgtgtcaaattttctggagatattattacccttaatatcacagtgggtgtgcaccctgtgtgtacactctgtaatattattcgtaatattttagggagatattactactaatatcacagtgggtgtacaccctgaggagatattacttcctctgatatcacagtgggtgtacaccctctcatattattcgttatgtgctaagtagatattattacccctaatatcacagtgggtgtacaccctgtgatgttattccttatatcccaagaagatattattataactaatatcacagtgggtgtacaccctatgatattatctgttatatactggggggatattatttgtaatattttagggagatactactcctaatatcatagtgggtgtactcatattttacagatatattacttttaatatcacagtgggtgtacaccctgtgtgtacaccctgtaatattattagtaatattttagggagatattactcctaatatcatagtgggtgtacaccatgtttgtaaaccctaggatattattcataatatccgagggagatattactcccaatatcacggtgggtttacaccctatgatattatttgtaatatctgaggcaggtattactctccatatcacagtgagtgtacaccctcctatattattcataacatccgagggagatattacttccaatatcaaagtgggtgtgataatatctgagggagatattattcctaatatccgtgggagatattattcctaatatctcagtggttgtaccgcgtcacagtgggtgtgcactgtgtgatattattcatagtatccaagggagattttactcctgatatcacagtgagtgtacaccctgtgatattattctaatacccaagggagagctttctcctaatatcacagtgggtgtacactctgtgatatttttcataatatccgagggagataggatggagaccacgtcacagtcccctcactgctggaatggacactgtctacccgtggagtggtggggagaacttagtgagattatgcaagcgtttagcacactgccagatatacattaaatgctcagaagacttagcttttattattactgtcataattgaggccatgggttactaaccagtggtttaaaatgccattgcagctgggcacggtggctcatgcctgtaatcccagcactttgggaggctgatgagggcggatcacttgaggtcaggagtttgtgaccagcctggcaaacatagtgaaaccccgtttctactaaaaatacaaaaattagctgggtgttttggtgcgtgcctgtagtttcagcttctcaggaggttgaggcaggagaatcgcttgaacctgggaggcgaaggttgcggtgagccaagattgtgccactgcactccagcctgggtgacagagcgagactctgtctcagaacaagcaaacaaaatgccattgaagacatatatgaatatgaaaaggtgcttgctaaatgatgattgaataaaagagattataatataaaataggctttggtttttttaaagcaaaaaagaaaaggatatgcctaaattagggaacatggagaagaaggccaaggcatttaccttcctctcttgagtctttttctctctccgtctctgttttttttttttttttttttgagtcagggtcttgctctgtcacccaggctggagtgcagtagtgccatcatggctcactgcagccttgacctcctgagctcaagcaaccttccacctcagcctctccggagtatctgggactacaggcacacaccaccaagcctggctaatttttaaatttttttgtggagacttgtctcactttgttgcccaagctgctttggaactcctggcctcaagccatcctcttgcctaggcctcccaaagtgctgcgattacaggcgtgagccaccatgcccagctctctcttgggtcttaaagcaaagtgtcaaagacccagccaccacttcttagaaatgactcgatgtcatactagcataaatgcatcgataaaaagatggaaatgtggtaacacagtgatcttggggaatcctagttttcttttccaatttctttgttgttgcagtgagcaagtacttgtttcaagataggaatgaaatattcggctcttttagacagacaagcacaggtgctcagtttgggagaagaattaaaatcctctgcactctccatgctgccttgctaattcttggggtcctgtcctcatcttctactcttgccttctgcagggaccccacagtgtgttttccccgatctttttgtatcactctaaatccagtattgggcccagggagcaccccctcccctgcccccttcagctgtcctcctgcctgagtcttctggaagcttcgggacagaaagaacccaaggatttgtcatgaagctcagtgtggcaggtctactgtttccatgtaaatcatgtctgcttatctgagctggttttggtggaaactgatggaaattatggggaagctaaatccctgtctctctgcaagccactccccaatcccacccccatgaattggcattgtcacagtcctggtgcttcatttctttctatatttgaagatgaatttgagggaaatagtcagaaagtcaagaagaacacagcagaaatcaattggggtgagtccagaacaaaacttggggatcccacttcctgctttttttttttttttgagatggagtctcactctgtcgcccaggctggagtgcagcggcaagacctcagctcactgcaacctgtggctccctggttcaagtgattctcctgcctcagcctcctgagtagctgggattagaggcatgcgccaccacacctagctaatttttgtatttttagtagagacagggttttgccatgttggccaatttggtctcgaactcctgacctcaaatgatctgcccacctcggactcccaacatgttcatattacagtagtaagccacggcttctggccccaattcctgctctctagctccgggaaaacctgtggctgcatgcagagtcttagacaacttccttttcctctctgggcctcagtttcccattctgtaagatgagaggtttccataggcctacactttctaattggtggctttcaatcctctggtgatttgcataaaaggcatctatttcaattgtggttataaataacaaaccccaataaatagacgaattatttaaatggtttctcattatcactgaatagttgagagtctactgtatttgagtgaaaatgcagcacgagaaactgaaatcagatgcgctcatgattatgaccctgaggtcaatgtgtcattcccttcattccctccttgcccccatgaaggtttgactactgtatggtttgaacctgtgcttcttagttgtttattgcttaagttttagccacaacggcaaattgcagcgggaaattcagtcttactttgtcatttggaaacaaaatacaaaacctatcaaaataaagcactagcttttttttttttgagacaaaatggaagaaatcctaatattaggttagaaaagcaattttttggtgtttttaaaattttatttatttatttttttgagacagagtcttgctctgtcgcccaggctggagtgcagtggtgcgatctcggctaaccgcaagctccgcctcccaggttcacgccattctcctgcctcagcctcccgagtagctggtactacaggcgcccgccaccacgcccggctaagtgtttatatttttagtagagacggggtttcactgtgttagccaggatggtctcgatctcgtggcctcatgatctgccagccttggcctcccaaagtgctgggattacaggcgtgagccactgtgcccggcctctttggtgtgtattttgatgtggtgactggtagttaaattcagtgtacatatgaattcactcttgggacaaaatatgctggatttgagcttgttttcaggcaaatcatgtttcatcttgcagagctaattcaaagtatactgactgcatgcacttcttgcttaggggaagaaaactcatcaaaatttgtttctaggcatatgttattagagctaggattaaaataaatcttacatactttctttaatatgctaacattaacacgtttcgcttaaaaaagtatcgatcatttatcatggaaaaatacaccagcttacacaaattcctaaagcgtttttcgtgtgtgtgtgtgtgtgtgtgtgtgcgtgtgtgtgtgtagagatggggtttcgccatattgcccaggctggtctcgaactcctgggttcaagcgatccacccacctcagcctcccaaagtgctgggattacaggcgtgagccacacacccggccctaaagctttttgtgagattatatattttacctgcgaaatatatgggtcagaaagatttgagaaagttgttagataattccaccaacgaaatctcccgtcctttccagctgtgatggtgaattctaaagtagaattcatctttggagcttctccctgtaggcatgcaccttgcgttgcacctgccagatgtcgcgcggagtcctccaggcctctagaaggcagagatggtctcgtttccttgccgagcatgcgccttagttctctcttctggggctgtgaccgtggggtcgaagcgcgcgtgcgcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgaggtgagcgcccgccccgccgcccggcgccgagtcgccgggccggtggttcagcctctctgggccgcgctggcctcgtctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaacctagagaccacatgtcttatcccccaaactccacagcccagaaccccccgaagttctaatccactgctcctccaaaccccgcggcatgattttaaagagcatcaattcccatcccatagatactgacctagtagatcagtattggcaaccctggggccggaaagctattttttatttctccggctcccctccacttctgaaaatggagagttgccagctgccctgattgccttaatgagtagttaatggaattaccctagagatttgtgctgaaggttttttttttttttttttttaattaagttgtaaagtcctgttaaatgtttatcagcccggtgggattatgacccagaaaggttcccgtaaagaggaaagggatggatggaggtaggggcagaatgtcatttgtcccggtagatgggaggggaccagagcaaggcctgggcctcatttttgggaggggatttatggtggggtaggacaaggaagaggaaaagagcgggtgcctcggaggtaatttaggagaaaacgaaggaagaggctgggaaatgccaaagagagggattggggaataagaccccaaagatcgtctgaaagcacctttgagctgttccagggctggcagtgaagggtgaagctctgtgttctgcaaagcgggctgctgaggattgggggaggggtagggagtcagttccacaccccaccagctctgcgacctgcccttgctctaggtttcagtttttgtacctataggatggtgttgggagagaaacagtggaacccagcagatacatttctttaacaagcggatccgtgatcttcttcaaggcccccttgtttgctgctttttcagactgaagaggtcagaggtcaggcattgaatgaatctacccactggcagcggcagggctcctaggatttcctgggtacatgtttctgggtgcccatgccacctcctaggtctgcactggggacaggacacgttcagggtggtatggctgtagacggcacagggcatttcagaagctgaaatgcaagaggccgctaaggcctcttgcaacttgtagtttccaggggttctggaaggaaggaaaagacaggcacccccctccaccctcaccctcatactaatagtgaccttgagagcagagaacaggttttgtgacccatttcaaagtgtgttccttaagcccaagggctgcctgtccagatggtgtgggacactcattctttcataagtaattcagattctgaaatcagacatttcatactggccatcttgatgtagattacattgccatcctgtgtcctgattgtactttatgaaagatgtagaaacaatcatgatatttcacggttatttcttgattgtgttttttgtgttcctatgcaactgccgccattcttctctagctttctcccatcctgagtgtttttacatcgtgttcattgagtcaacaactatttactgagccccggcacatactgaagccttgtccccagtgtggatatagcagtacagtgaacagaacagacaaaactccatactctcatgagactgacattttgttctctaacagggaccttactgttaaaaaaaaaaaaaattatactggttgctaatactttaacaatcagcaggtttcacattaaaaactgggtgctttatttctctggaaagccagccgatctttaggctgccacacttggcttgggttttgtagtgatctgaatccttttggatgaatgtcccttgatgttgcctccctaaccggtctagtctggtgaatttccagtccctgccttaaatgcatgcatctgaatctctttgtcacctgtagcaaattcactgagtacctagagtaagctagacactgtctcaggcactggggaatgaagttgtcactgacctcagagaactttacatacaggcttaaccttatttcacacgagtcctttcccaaatgttcaaatgttcgttttatgagttagtcactttgtacatcatcttagctggtgagattcgactgtttcatagcggctcgtgtcatggtttgtttcatggtcatagagcattaacattttggaggtgaggcttttaggtgcatcagacccaactgcttccttttacagacatggaaactgagcctcagagtggttgagctgtgcaggtacatttaggaaattttccttgagcccagtatgttccctacgtattacactgtgttgcctttttcttcagagagagatattaaatagtgatacaaactgctttttccattttacttattttattttgttttattttgaggcagggtctcacactgttgctcaggctggagtatagtggcaccatcatagctcaccaaagcctctgactcctggcctcaagcagtcctcctgcctcggcctcctgagtagctgaggctacaggcacgtgccatcatgcctagctaattttttttctagtagggatgaggtgtggctgtgttgtccaggctggtctcctgggctcaagtgatcctccttctttggcctcccaaagtgctgggattacaggcatgagccaccatgcctggccgcaaactgatttttctttgaatccatattctgtagcaggtgcttaatatgcattgatgtgaatctgtacaaccacatgaaaaggagtggctctatgtctgcacctgaagaaaccgaacacgagcttgcccaaggccacgcaacacgtggaagactcagatggcatttgggcatcttactgggttaacacttcgtgtctggtaatgctcagaatgtaagagttttagagagtccttgaagagaggacagatattaaatgtctttttagtctctttttcttcggagaatgaaagtaatgagaaaattaagtttctagatgaatgttgctccaagtatttgaaattattcagagttagtaaggaagatttctggccctcattgcagacctttagttgagaaatagaggtgggccccaggaatttgcaatttattttactttattttattattatttttgagacggagtcttgctctgtctcccaggctggagtgctgtggcatgatcttggctcactgcaacctccgcctcctgagttcaaacaattttcctgcctcagcctcccaagtacctgggactaccggtgcctgccaccatgcctgggtaactttttttgtatttttagtagggacagggtttcaccttgttggccaggctggtctcaaattcctgaccttaagtgatctgcccacctcaccctcctgaagtgctgggagtactggcatgagccaccgtgcccagccaggaatttgcatgttaataagcaccttactaatggcaaagtttgcaaatttgttttagacccggaaacttacacgagcaacctagaggcagccactaaaataaacagaaaagcattgaaaaataaggcattgtaataggctgtaggtggtttctaatctgaaaaacattgagtcacatgatttgggagagagtttgttgatttccctctgtccccagtaatgccccgtgttaaaagctggcatataataggtcctcagtgaatgtatactgactgagtgcattcaggtgtaacatgtgtagttaattcccaaaggcaatgttatgatttctgttttccttccttcctttccagataaagctgtacaccaagcatgggactttgaaataccagacagactgtgcccctaataatggttactttatgatccctttgtatgataaggtaagaggggactgcttgtcacttatgatgggaagtcactagtgtgcctcaccaggctgcattaaccatgtcctttcctacactagcaaatgctcatctgttttgtaaattattagtggaatatgataatcctagccacatttggagggagacaacttacaaactgccttgacgaatacagtggctctctctgtgtttaggaccatttggcaatgtctagagacgtttttgttgtgacatctgtggctgtgcgctacagtcacccagtgagtagtggccaggcgtggagctaaatgtgctacagtgctgcctacgacagcccagatgtcagtagtgccagggctgagaaactctgatttcatggaacccgttacttgcaagcagcttaaagtattgttaaaaaaattgtacaagtaatacatgaattcatgaactttgtgaaaaagaaagtcaaggtctttagaagtatgtgaaataaatttgtacccttttcgctccaattttacctccctctgtagtgataacctctgataatctgataaaggttttttttgttgtttttttttttcttcttttgagttggagtctcgctctgtcgcccaggctggagtgcagtggtgtgatcttgcctcactccaacctccaccccccaggttcaagccattttccttcctcagcctcctgaatagctgggattacaggcatctgccactacacccagctaatgttttgtatttttaatagtgatggggttttgccatgttggctaggctggtctcgaactcctgacctcaagtgaaccacctgcctcagcctcccaaagtgctgggattacaggtgtgagccgatgtttccggccctcttataaaattttgatgtgcatcctaacagattgctttctatttatagttattcagatatccacgggtacacatgcatatgtatatatggaaatacacacaagcacacatgcacatcgatatgtatccacaaacacctctatacaatcccatcctcccacatataaaccttttatttggaaatacagattcataggaagttgcaaaaatagtcaatacacatagttttgattttgatatattttttaatacaaatgaaatcaaacaataggatttattctgcagtttcattttttcccctgtgttaatgctttcaataccagagggacatttggttttttcctcttgcatgctttcaacattagcatagatagatctactgacttttttttttttttttgagacagagtctcactctgtcagccaggctggagtgcagtggcgcgatctcggctcactgcaacctctgcctcctgggttccagtgattcttctgcctcagcctcccaagtagctgggattacaggcacccaccaccatgcccagctaattttttttgtatttttagtagagatggtgtttcaccatgttggccaggctggttttgaactcctgacctcaggtgatccgcccacctcagcctcccagagtgctgggattacaggcatgagccaccatgctcagcctactgacttctttttaatggctgcatagtgtgtcagagtcaaacccaaactgtaatttatttaactacttggacatatagactttccccaattttaaaataatagtaattttaacataacacaccaggaaatattcttgaacttaactcttcatccagaatgcataggattgatttctagagatggactagctgggtctgtcctgaaatctatttaattaatttttaaatagtatcagtatcagtctcaagaaaccaggaggctggacgtggtagctcatgcctgtaatcctagcactttgggaggttgaggtaggtggatcgcctgagctcaggagtgtgagaccagcctgggcaacatggtgcaaccccgtctctactaaaatacaaaaaaattagccgggtgtcacgtggatgcctgtagtcccagctacttgggaggctgaggcaggagaatcgcttgaacccaggagacggaggttgcagtgagccaagatcgcaccacttcactccagcctgggcaacagagcgaggctccatctcaaaaaaaaaaaactaaaacaaaaacagaaaccagggttgataagtaaaatctagttttatttattgaattaatgagttaacgtattgtttagagacaggatccccttccgctgcccatgctggagtgcaggggcacaattatggttcactgcagcactgacctcctgggctcaagtgatctttctgcctcttcctcctaagtagctaagactgtaggcgcctgccaccacacccagctaattttttaagaacattttttgtacagatggggtcttgctatgttgcttaggctggtcttgaactcctggcctcaagtgaccctcctgccttggcctcccacagtgttgggattataggtgtgaggtactgtgcctggccaaatctagttttagggggtgcctttagttcctgaagatacatgctaacttgtgcaactgtaggcatgtgagggcttaatgggagactcaattaatagaattatagtatgtttagtattaaaagacagtgagtggctgaacctagtgtctttagaactcatgaatgggcttcagcactgtcttctgattgtttagatgaaaacttctggtgttcagcttcagcttgtagcttctgaagagaatcagtgctcagtaccatgtagaagaacaaggcttactcttagaatttcatttccggtgtaaaaaaattttagattaaatgataacactaaactaaatttagccagagtcacaattctcatttcttgaaattacattttctttttttccttttagggggatttcattctgaagattgagcctcccctagggtggagttttggtaagttaactgaatcactagacattctttgtaaaagattagatgatatgccgaatattaatttaggctagcagagtgcataaactattaaaatattaaggatcatttccagtatggaagagggtttgtattcctcccctccttgcccccatcactctggtttagttcggatttaccttaatctacctcaagactttctgtcacctttgaaaaatagacatcttttcttctacctttctggaaactcttcccttgcagtttcactcattacgtggccgtggaacagtatagaaatcaagagtggggacttggttcccatcccaggatggcttcttttttagccccctcagttttttaagtttttatggaattaattgaaacatttaaagattgtgagatttgtcataaaaatccagatttatgtcccatgagatgagaagactgtcagccttataccttaccagttaaataactttgggcaagttacttcccccgtgtcagcctggctcctcactgtcgagcaagggtagttatagtccctgccccactgggtacttggaggattaataaaccaatactgagtgttcagaggggctggcacgtaattagcaagtactcagtattcagaaacagcccttctgcacacatcccaacaaaagctccaaactttcctcatataactgccttcaagcatagctggggagttggggatggggttgagatcagaagagagggtctgttttgatgtagtttacatttttgaagaggagagactcttgatgtttcagtagagcaggtgtgggtgaccccagtccatggcttggggagaggagtagggatcaccgttgttgatatcaggcttgctcgtgcattagacaaggaagaatttagcacctgccatcaccaaggctaaaatgaggctcaggcagctgacagctaatttggctctgtgagagcagctcttttatcagtttatagtcaggggtagggtcgggggtgcctggctggtacgttccagaaagctggagaggaatgcagccctgctcatggccaaagcagaagtccagattggtggcctggaggagtgttgtgtttgccaccccccaccctacccccaactggtgctgttgataagctttttaattgaattatactttcagaaaagtgccttggatgaattttcactaagtgaacacacccatgtatccaccatccagataataagatagcacttcaccagcaccccagaagtccccatcctgggtgctcattagccatcccgccccaccctccaggtgaccaccaccctgaccttctacaaattagagatccatttggtctgttttgaactttatacaaatgctatcatgcagggaactttttaatatccggtttctttcactcaacattatgaactttatctgtatcatttgtagctttagttcattctctttgctgttgagaattctgatgcataaatataaaattatttatattttataaaatacttatattttattttatttttttcttttttttgagactgagtctcgctctgttgcccaggctggagtgtgatctcagttcactgcaacttctgcccgggttcaagcaattcttgtgcctcagcctcctcagtagatgagattacaggtgtgcaccaccacacccagctaatttttgtatttttagtagagatggggtttcatcatgttgacccaggctggtctcgaactcctgacctcaagtgatctgcccgctttggcctcccaaagtgttgggattataggcaagagccaccacgcctggcctatatttatattttatattcatattttgtatcagtgatctcttctactgttgatggccatttgagttgcttaccgattttggccactaagagcagtgctcctgtgaacattcttgtatgtatattttgatacatgtgtctgcatttttgctgagtatatcacaggagtaaagtcgctgagccatagagctgatacatgctcagctttaggtgtttgcaaacatccaaagtggatgcaccagtttgtgttctcccagcagtgtacaagggtttccattgctccacatcctaacctacacttgatatcgtcagttttttttaattttagcccttctggtgggggtgtggtattatctcactgtggccttgatttacattccactgatggccaatgaggttgcacactttttcgtatgtttatgtttgtttgccatgggctagctatttttgtaagattcctgttcaagtcttttgcccattttttattggagtctttgtgtgtgtgtgtgtgtgtgtgtgtgtgcatgtacgcgtgcaagcacgtgtgtaattcatcttaactgaaaatctcatctcatggttttccatttttttctctactcattactccatattcttcctaacctttcaaaaactcaaccttaacccctattatgatgaactcttcagttaaaaaatggagttaattgctgatattgaaaaatcaagagatggtatataaaatccagatttccagtttttcggagaagttggaagctctggcaaagcatggtagtggttggcagacttgagtggcagttgtctcctttcaatttgccacagtccccctgaggatgctccgctcacttcgaacccatgaggcccctgtggccctggagtttgtgttcctggtttaacatggctgagctcatgtccttggtcagagaacagatccagagccagacttttagggttgaattggggctctgttactcagaagctctgtgatcttgggagctcctttaacctttctgtgccttaatttacccctcagtaaattgcagctattactgcctgtctcttaagataattgtgaggattaaaggcactcagctcagtgcctggtcggtgatgagcattcaggaaataaaattatttggtgctcactgaattttcactggaactctgagatataacttagctgaaaggcgttgtaaaattattttatactctaaacacgaattccctctggggcaggaaaccaggaggctagggggataggggtgagagggagacttttcccagaatactttttcgtacctttggatttggaaacacaacgagtgtattaagtgttcaaaagtaaaatgaaacctgaataataaaaatacgttctacttaggttcactgtaccccaaaactaagcttgcctttgtgtcttgtgccccggtttcctcccctgcttcgttcctcagagccgacgaccgtggagctccatgtggatggagtcagtgacatctgcacaaagggtggggacatcaactttgtcttcactgggttctctgtgaatggcaaggtttgtctttggaacttgattatttttcctgttcactctataatgtatactaaatccttttttaaaaaaatgcaggatattttaacctggggactttgatcccacaagggacccatggataagtggcaagtgagcctgtgaactctgtacttcatccgtgtagaacacagcaggtgtatttaggaatgagattgaggttgctggtcatcccctctgctcccagagcataggctgttggtgtttttatttttttattttttattttgagacagggtcttcctctattgcccaggctggagtgcagtggtgcaatcttgactcactgcagcctccacctcccaggttcaagtgattctcctgcctcaccctcccgctccttcaccctcccgagtagctaggattacaagtgtgtgccaccatgcctggctaatttttgtattttcagtagagatgggcttttgctgtgttggccaggctggtctcaaactcctgacctcaggtgatccgcctgcctccacctcccatagtgctgggattacaggtgtacgctgtgcacccagccgctgttagcgtttatgtcagggatggccttttacagggatgccgaattggaaggacacactctctaagccttgtggcatcttgctgtccctgtgggtgaattgaagtcagcttctcccagagagagcgtgcatctgcttctgacacttacgtaggaggattcctattatttaagttctgagatttttttggaccgccacggtggtgtgaatttagagtcctaacgggtgtgtgcccagctcccgtgattcagattctcaggggagagtcatttctcctccacccgccctgtgcctgcggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaacctttttttatttttatttttatttatttatttttttgagacagagtctcgctctgtggcctaagctggagtgcagtagcgcagtctctctcaccacaacctccacctcctgggttcgagcaattctcctgcctcagcctccccagtagctgggattacaggcgtgtgccacctgacccagctaatttttatatttttatttttatgtacatttacttttttttttttttttttttttttaagatggagtctccctctgtcgcccaggctggagtgcagtggcgcgattgcagcttactgcaacctccgcctcctgggttcaagtgattctcctgcctcagcctcaggagtagctgggattacaagcatgtgccatgacgcccagctaatttttgtatttttagtagagacagggtttcaccatgttggccaggctggtctcaaactcctgacctcaagtggtctgcctgcctcagcctcccaaagtgctgggattacaggcgtgaaccaccacacccacccagaccaataatggtgaatctataactgatgatgtcttagattcattgaaatagagtcttattttactgttactgttccctctcctacctcatccccaggaaacatatccatgatttatagcatcttttcaatgggattcttgacccaaagagggttcctgggctccacctgggagttgtaagcaggactgccagtgctttgagaggagggtgctttgctgggtgggccctaactttcttctccatggcaggtcctcagcaaagggcagcccctgggtcctgcgggagttcaggtgtctctgagaaacactgggaccgaagcaaagatccagtccacagttacacagcctggcggaaagtgagtagcgtcctgtctcttagtgttgccttagagccgggctctgacaggggtcatggagctgggtttgggagtttggattcagggagttctgggttcagatcctgattcagcctcttaagtttgggtgagttcatgcccgtcagagtgctgagttccccacatgtgaaatggaatccatttgacccatcttgcctagcattgatgagatgattaaatatgagttcatactggccaggcatgttggcttgcgcctataatgccagcactttgggaggccagtatgggaggatcacttgagttcaggagttcgagaccagcctggacaacatagggagactcagtctccacaaataatttaaaaaattatatcaagtagagtcccatgggggaagaaaattagctgggtgtggtggcatgcttctgtggttgcagctactcgggaggctgaggcgggaggattgcttgagcctggaaggttgaggctgcggtgagccgtgatcatgtgccactgtgctccagcctcggcagcagagcaagaccctgtctgaaacaaacaaaaaaagagttaatacccataaagcacctgcttcaaggcctggggcttagtgggtcttcatttagcagctcagcctggctctggagcctgccagcccgggcttgaatcccagctcccccatttgctggctggttgacctagggcaagttccttaacccctctgtgcctcagtttcctcttttgtaaatgaagataattgtggaacctatctcctaaggtactggaaagatgaaattaatattattacttcaagctgcctggcatattagctcaaataggttagctcagttatgattagaaaaaatcattatcattattatatcaaaactgctttgtagttggaacagatgcctagctgaccttgctgagtcagatttaaagcatttatttaatggatgtatatagttgagttgtaaatgttaacagatatgccaagattaataccagaatagttcaaactgataattccgaaagcgttcaaatcattactaactccgttaatatacaaactgagtaaattgcaaaatagaagtttataatgagtctgtcagtaagttattcaattttaaagttattattgttgaaactagttttcatttttgaaataacatttacttctgcttgactggtgcctctccaggcctggtgtgtagcaggaatatggagctgtaattttttttctgggctagtaatttggtgttgaccttactagaaaaaaatagtgtcttgagccttctgaatacctttcatctgcactaactgaaacaatgaaacatgtagcactgggctattatgaaaatgaaatagaacctcaatcttaccaatacttgtagtaatgtgatttccaagacctatccagttattgcaggcaagatttgacacaataaaataccacagaagaagaaatcaaatgcgttttctagttcatttcaccggacttagccttctcatttgtcagttgccttacaaatttgaagggataaacatgttagtatactggcagcagcatttccagctttagctcggctcactctggtgttagtctgtctatggctagtagagtaattttcatcagctgctggtttcttatctcagttgctttgtgcaaaaacccagaatgacttatctgtgtttctctaaagccttttttctgggattcaaagcttatcatagtttaccctgccctgtgtcatttgcatcatcttgggtcagcgtccccctcagcctgtgcatctgttctgttctttttcaccccacttctcccttcccatgtgtttccttggacacttctgtccccttctccttgtcagttcatgcctgtcacctctgtcaaacccagtcgaatgttctgtgactggtccctgctgtgctacaaggattggttttatgccagaaatccttgagattaagggagacgtaagcactcctctttccgatcagcacatggagcacccctcttggcacacagtaagtgctcaataagcgctcttttatgcagatttgtacagtgaaggattgaatttcattcatgctcatttaacaagctaatggaagtttgcgataattccaacattgttttcttgtgctgccaacattagtcatagaattagaaatacttgggttgtttggagaaagttaaatggttattttttatgtcttaggtttgcattttttaaagttctgcctggagattatgaaatcctcgcaactcatccaacctgggcgttgaaagaggtgagtgacagctacgtctatagccatgccaataatatgctggtcttgggacaaatgtagggcttttcaatttaggatatgaaaagaatttatggttcctccaggactagatgaagaaccaatggtgctgttgtttagtttggtagttatttataaggtgtaactcctcactgtagcagatgttgcttgtgttagtttcagttttaggtgacagtgttgtcttcctgctgtgaaatagatctgttttattaactatagctattttaaactaaatcaacaacagaaggccctgacgagatttatttgttgttcttttttcagcctgaaacagaaatctgtaaatatactaaacattctagaaactgtggtacgcgtgaccaaggagaatgtatgagaatgtttattgcagctttgtttgtaatagcaaaatattgtaaacaacctaaatgccttttaagagaagaatggattggggttccatcatacaataggctgctgtatgtcagcagtaatgaatgaaccagagctacatatatcaatgtaactacatttaaaaacagagttgaaggaaatatgattttaaatacttgtgataatcatttatggatacagtcttttttttttttttttttttttaaagacggagtctcgctctgttgccaagactggagtgcagtggcatgattttggcttattgcaacctcggccttctgtgtccaagcgagtctccggcttcagtctcctgagcagctgaattacagggatgtgccaccacgcccagctaatttttgtatttttagtatatatgggattttgccatgttggccaggctggtctcgaactcctagcctcaaatgatccaccagcctcgggctctcaaagtggtgggattacaggtataaaccagtgcactcggccagatacagtctttttttttttttttttttttgcaacagggtcttgctctgttgcccaggctagagtacagtgacatattcatggctcattgcagcctctggttcctggccttaagcgatccttcaccttggcctcccaaggatctggaactgcaggcatgtgccactgcccctagctaaggatacagtcttttttttttgagatgaagtcttgctcttgttgcccaggctggagtgcaatggggcgatctcggctcattgcaacctccgcctcttgggttcaagcgattctcctgcctcagcctcctgagtagctggggttacaggtgcctgccaccatgcccagttaatttttgtatttttagtagggacagggaggatacagtcttatgtagaaaaattataaagacatgtatgggaatagcagacgctgttcaaaatgatactgacttctagagaaagagggaggagggggacttcggggtacgccagcatcttgaattgtatttttttaaatttctttagctggttagaaggtatgtaagtgttctttagcatatctttttttgtttgactgaaatagtttatagtcaaagatcaaaaaaggaactccacctagtaggtgaggttctgtaatagccgtgaaagaccaaattgaaataagacttaagggacatcttgacatgttagcttctgtgttagtattgaagctgtatctcatttttgctaaagaagcattggaatcagtatttcagcttctactctatctgttttattattatttttactctgtaggttttacgcacttataattgatgatagtttcacacctagatgtctcttcttactgtttgtgacttttggttttgggggtttttctcttctgcagcaacatttaaaaatattttattcgaggctgggcgcagttgctcatgctgtaattccagcattttgggaggctgaggtgggtggatcacttgaggtcaggagttcgagaccaacctggccaacatggtgaaaccgcatctctactaaaaatagaaaaaaattagccaggaatggtggcatacacctgtaatcccagctactcgggaggctgaggcaggagaatcgcttgaacctgggaggtggaggtagcagtgagccaagattgcaccactgcacttcagcttgggtgacagagtgagactccatctcaaaaaaaaaaaaaaaaaaatttattcgaaatgaaagagcttacacatttataaatagaagagattttaaggtttacattgtatgttaattgtctgcatagaagaatctgagtttattaatatgagattgggattttcaagtaaagcatgttgttagaagtcaggataatgtttatcttcctggggtgttagtgaccggaagcaagtgtgagggcacttctggcttgctggtgctattctgttgggtaatcagtgcccaatttgtgacaagccctgtgctgcgtgcttagaatctgtacacttttctctgtgtttattgtaccttaacaaaaatgtttaaaaatatacacatattgtgaaaagaacaacttaaggcaaattaaacagagtttaattgagcatagaacaatttgtcaattgggcagctccctgagccagaataggtttacagcgactgtggcactgttgcgtgattggaaagggtttatggacagaaaaagaaagtgacggacagaaagtggaagtgaggtacagaaacagttggattggttacagctggacgtttgtcttatttgcacatggtttgaacagttggctgcctgtgagtagttgaagggtggctgcttgaattgggtgagacttggcaacacgtaagagaaacctttaggccaaacttaaaatatgtaaggaggcagctttaggctaatcttcagttaacactatatatcattaaaaatagaaaaaaaggcaaaatatgctcattaaaaaaattggaacatatagaggaatataaagcagtggaaacaaattttggaagctggaaaagtatacaagtaaaatagcaccatatagacaaaatcattattgtttacattttgccacatttcctttcacttcattttgggcattaaaaaataatgataagccaggcacggtggctcacacctgtaatcccagcactttgggaggctgaggcgggcggatcacctgaggtcaggagttcgagaccagcctggccaacacggtgaaaccctgtctctactaaaaatacaaaaattagccgggcgtggtggcgagcgcttgtaatccccgctacttgggaggctgaggcaggagaatctcttgaacccaggaggcagaggttgcagtgagccgaggttgcaccattgcactcaagcctgtgtgacatactgagactccgtctcaagaaaagaagtgatcatactgaataagcaattttatagattacgtttcccagttaatattttagcttcagcgtgtcctcatgttgttaggcactttgcaagtgtttatttttttacaggttaaaatctttttctgttacaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggtaagcaaagaaaagaacaaaagagatggtgtgaagggtaggagggtgggggattatagaccagaacgtactgttttaaaaaatgcaggtctgagttgatttatcattttaacacttaagaatatcgtctgtctcaggccgggtgtggtagctcatgcctgtaatcccagcactttgggaggccaaggtgggtggatcacttgaggtcaggagttttagaccagcctggccaacattatgaaaccccatctctactaaaaatacaaaaacattagccgggcatgttggcacgtgcctgtagtcccagctgcgtgggaggctgaggcagtagaatcgcttgaacccaggaggtggaggttgcagtgagccaagatcacgccactgcactccagcctgggtgacagagtgagactctcaaaaaaaaaaaaaaaattcaagaatatcatgtgtctctgttgactcacaagacattgcacatctacactgggaggcagtggtatgtgatggaaagtacacaggctttgaaatcagacctgggtttaaacaaatctcagatttaaacaaattcctcttcctagctatgcgaccctgggccggtcacattaccttcctgagcttccgtttccttatttggagaatggtgacccatgataaggaaggacagtcatgtcatctttcccgggaagactgtgccagtttttaactttgcaacttgaatgtcaagatttttgttccttttatctgtattaatgtttcttagatttcagaaatacatatattgacatgaaacttaaaaaaattttcctataatgtggctaattgatggtattcagaacatgtaaatggaaaaggaagtcttgtcttttttaccccctggcataggatgtcctgggctgcaatgtctcaccagtgcctgggttccagccccaagacgagagtctggtgtatttgtgctacacggtctccagagaagatggctcgttctctttctattccttgccaagtgggggctacactgtggtgagtgaagcagatttccgttctgtttatgtctgggactctcatgacacagtaaaagccaatgctgtttgggtgttaaaggaaaagatggttggcctgcagttctctgaacatgctgttaagcagtaacttacttaagatgagacactcaccccttcgtaatagctacaaaaagggcaaggcttcctcttttcaaatctgcaacagttatgatgaatgtttctcttggtctgtctgaaccccttgtcatttgtgggctgctagatcgattattaatattgctgattgatcatgttagtggttcttagtgattaagagactcttccttccagattccgttctatcgaggggagaggattacctttgatgtggcgccttccagacttgacttcacagtggagcatgacagcttgaaaatcgaggtaaggcttttctgtcttctggagggacaggtgtttgagttcccatccctaggcacaggtattgcaaacatgttttaaaaaaaaatcaattattttatctggaagggctgttggaaaaaatgccatctggtattatattcttacccatgatgtccttatcgtagagagctggattcctagttaaatctactcattcaatgaaatatatttattgattgccagtgacatgcatttcaggcaccattccaggactggggatatagcagtgaccaaaagaggcaaaaattcttgtccctgtggacctcatttttttttttttttttttttttaagacagggtctcactgtgtggctcaagctggagtgcagtggtacgatctcatctcactgcagccattgcctccagggttcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtagtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagggtttggggcatcccaaggaggccagggtggctggagtggagggaatgagcaaggaaggaggaggcggaaagagggtcagggaggtgacagggcagattgtgcagggcttggtgggctactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtgatggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcctctcctaagtggaccacccaatgttagagttatcgaagcaattatattttaatcattttcttttaataattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtactgtgtcttattctttactgttttcctaacatgtgatttagtgcctggcacatagtaggtgcccagcaaaaatatttgttgcgtacatatgtgaattaataagtaggtaatgcatggaatgaaacatgtctttttggaaagatcaataaggactacctgtcatgtgagaccatcactaagaaaccatttgctgaaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaagtccctgtctccatgaggtaacatgctagtgggagggagacaactaagaaatcgaacgaggacatttcagatactggtaagtttgatgaagatattaaaataggttagcagtggtgaccttggggatacacagatcagggctggaactcagtaactgcagagaaagcacagctgtgctgctcacaggcgagtggggcacagacacagacacagacacatggagcacgggaccacgtgtgagccagtgatggtggtggaggagggtggtctaggtggatttctttttttttctttgagacagagtcttgctgcttcacacaggctggcactatcttggctcactgcaacctctgcatcccgagttgaagtgattctcctgcctcagcctcccgagtagctgggattacaggcgcccgccaccacacctggctaatttttgtatttttagtggagacagggcttcaccatgttggccaggctggtcttggactgctgacctcaagtgatctgcctgcctcggcctcccaaagtgctgggattacaggcgtgaaccactgcgcctggcctaggtggatttcataaggacctgtgttcaggtcgtggtggaaagacaggaggggacacgtgagaccttgcagaggtggaatccacaggactgatcgatgctggaggagcggggcgggtcatccaaagtgatgccggggtgtgcatgggagactggaggaagacgtggttcaccaaaatgggggcatctggaggggaggagatggcacaggggtaagggtggggggcttctagaagcttgagtcagtgaccttttaacgagggaagtaagtctctagacttttcttttctgttgtttgacactcagcagtgtgttgggaacacaacagagaagacagatgtgggtaaagtgagagggagcccggctggcacacaggaccggggcactgagtgttgggaggtgggcggcaggagcagacatggtaggtggtggccggcgcagcagaaggaggctttgtggctctggcacaggagcaccttcgagcaccttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggtaagcttatcgtgtggatttggaagcaccagtaaatatgctggcagccagtgtagaaccaaatgacctgtgatctgtgtgtctttgccgagcttaagaacttaagaaagattagtactttttttttttttttgagagacagagtcttgccctgttgcccaggctgtagtgcagtggtgccatctcgactcactgcaacctctgcctcccaggttcaagtgattctcctgcctcagcttcccaagtagctgggactacaggcgtgccccaccacacccagctaatttttgtattttttagtagagacagggtttcactatatgttgtccaggctagtctcaaaactcctaacctcaggctgtctgcctgctttggcctcccaaagtgctgggattataggtgtgagacactgcacccggccaagaaagattagttctaaatcttacaaactgaaggtactgacatgtcggatgcttaatgaaaagtcccttgcttcaaattaaaatgggcttgtgaaattaaaaaatctttcatgtctgactttcacgatctttcacaggacccctctttgcttaatctttgaggatttttggaagatggtattgttggttgagaaagcttattggaagatgcttcaggtcattggtgtagttcttcctgcttgtagttactcattatactataagtacaggcagggacatcttgtggttgaattcatgtggttttaccatcatctgaagcaagattgtgtagtgccaagaacttgggctttggagtcagatcccagatccacctgtatgtaacctgcagaacagctttagacataacaggtgctcacaaaacagtagcttagaaggagactgcagggtctgcttgggagaagcgcggcatgagcaaagtcaggcagtctcacagcagcatgaggtggctgcgggtgtaaagctgggtgctactggagcagaatatactggcaggtgaaggtgatgatgaggccaaccccatagcacctcctcacaccccaccagggcgtaggggctttctcccactggggccaacgggccatgagtggttttgagcattaatataacaagctttgatcattgttttcaatagggcattctgaaaacaatggcatggagtagagtggctttgaaggggacaggacttgggcacaggaggtctgaaagcagagacgacaagggcttgccttgtagggaagtcagggacagactggtgagatatttagggtgcccagcttgagaggtgtgatggctggggacagaaagagaagccagttaggtgatgaggtttcagatttggccacattggtctgtaggaccactaggtggagctcttcaataggtacttggatggatggtaaatcctgaagatttggccgcaggtggcagccaggacctcaaatatgtatgtgcaagtagaattagaagaacagtaggccaaaaacagagtgccaggtggcccagggggggacctagggagcctgaggtcataggagctaagaaagtaagtttggggtaggaggtagggcccaacagggaggtgcagggagctgggccctggtgaacacagtcccctggcttgatcactgaggaggccacagtgactcttttctgtagacagatggaggtcaaggtcaaggagtccagtggtgaatggaagacagggaagcaaattaccctcagaaagtaattcttggatttaagtctttcccaccttccataaacactttgtgcaattactctagatgaggcactgaaaaatgcttcatacctaataattaatcaaactagtgttccagagatggggctttcaccctaccagggagacagactgaagacaaatacatctgtggccaggcttaatgcctcacacctgtaatccatcccagcactttgggaggcagaggtgggcggatcgcttgagcccaggagtttgagaccagcctgggcaacttggcaaaacaccatctctaccaaaaatgcaaaaattagctagtttcataacctggtctaaaaataaataaagagataaaaattaaaaaataacaagatttttaaaaaagacaaaaaagacaaatacatttatgctgctaaattatggcaaatgttgtgcagggaagagatcagggtgctgcaagaagagctaatttagagtgggagctctgcaaggctctctgggttgcagagaccttagtaaagactaaaagttagctaaagaaagatcttccctagtagagaagcagcatgctcagaggcctgcataggataggaaggacctgaaaggcagtctgcgcagctggaggaggtgggtgaggtcagggagctctggggccttgtagccttgctttgggattgggctttgctccctaatgcagtggaaacccgttaggagttgtctgttggttggccgggcacggtggctcacgcctatgatctcagcactttgggaggctgaggtgggcggatcatgaggtcaggagttcaagcgcagcctggccagcatggtgaaacccggtctgtactaaagatacaaaaggttggcggggcatggtgatgcgcgcctataatcccagcaactcaggaggctgaggcaggagaatcgcttgaacccgagaggcaggggttgcagtgagctgagattgcaccattgcactccagcctgggcgacagggtgagattccgtctcaaaaaaaaaaaaaagagttatcagttggcaagggagtgatagggatcatggtactttaaaaagtttgtttttcttcctggctgctgtgtggagaatggattggaggaaagccatggtgtgaatggaggggccagatatgaggcagtcatggttgtctggaggagatatggtagtggctgggcccaggcggctggcaggcgagggagcgaggagtagatggatttggtaggtcacatggagaacacacccacaggcctgtgctgttgaggttacaggtttcttatttgagccactgggtagatggaggcggtgctgttcacggagatggaggaaatatatttattttctcctttaaagtagagtatttgggtcaaagaaagaaaaatagcatttgttgaacatttttggaaaaatctcttttttttaattggccgatgtagtacatttgcctttttagcacactgatacttcttactatttcttttcctttttattttttgttgagccagggtcttactccgttgcccaggctggagtacggtggcgccatctcggctcactgcagcctccgcctctcgggttcaagtgattctcctgccccagcctcctgagtagctgggattacaggctaatttttatattttttagtagagatgtggttttgccgtgttggctaggctggtctcgaactcctgacctcaagtgacccacccgcctcggcttcccaaagtgctgggattacaggctgagccatggtgcctagtcttcctttaaagtaaaataaaaaaattactcaatttattgtaaaaacaaactctttggcttctgtccaaatgactgtgaaaatagatttctctcaatatccaccaatattacctgtttctgtccatatatgtatttaaaccctgttgaaagaatttattgatacaaatcaatttttaagggcttcagtataacggaacctttttctaccacccttttggtttatttttccaaactaagccagtatagatttgaggtttagggaaaataggcacttctttttaataagaatgtgggctaaaacagatcttatggttcaaatatttacaacttaaggaggcaaagagatttgataggaaatagacaaggtgatgtgtcctctgacaggtacacaaatcaagagaatatgacaggtccttgggaatgattgtgtcagtgttcgcttcccatccttttattctgaaagttcacagtaggggaatgtgagaaccaaaatgcatatgctaggtcagggactgggacactttctctgtggagagccagagaataactattttaggctgcgtgagccatacggtctctaggacaacagctgagatagacatttgtaaatgaatgggcagagcgcaacacaactacatttttggacaccacagtttgcatttcatgtaatttttacatgtgaaatattatctttcttttgatttttttttttaactttaaccacttaagagtgtaaaattctttttctcggcttgcagttcatacacaaacgggaggggggtccttgggtggtagtttgctgacccatgctggagatagtgagctcatatggctgggcagtcccttcactctgaagaaatggctgtgtttttcataattcctagatttcacatacacaatcttccaccatttccttgtgttttccactgtttttttatttgaggcggagtggtggttccaacatttaatgtacccctaattgtcagaatccaacattcttgattatctttatgtcagaagtaactaatttttatctaaaatgattcttgaagattctttaaaatgaacagttgaaaagacaactgtgacccccagctaggatgtactattacactttaatacaccagctgcttcagaaatgaagaccagcactccaaggatgatggtcgttgtaggggggcctctcgtgtgttattcgagggatgccttgcaacaccttactccttatttagaatctcaaatctgaatcattaccttaatagggcttttcagttataagttacattgtggctcctacctcccaaggagttcaattttagctttgcattttttaacttaattaccttttctgttccaatctcccagtttgctttcatccatgtattatatataatcacaagcaaggaagacgtctttgataatcctgacttatttgatggcctggtaatgccacagtttcttaggcagcttagagctcttgcttttaagggctagcccacattctcagtccaaggccgctctgctgtcaacgatccaattacctgaaacgtttttattatctgcagattttcttaaaattgcctctgcagtgggggattgccagatgtcacccggaacacacaaacagccccactacgggcccctgttctgtagaaagatgcccagtcttgcttctgaaggttgctttttaaaaccagaatgaaggttgctttttaaaaccagaatcatctggattgcattctgtctcttcattaagattagactattctcaggaacaagggctgggagagggctgcatcttttttggtcgataagagcctttcctgttataattgagtcctcgtgctggaatgaatggtcttctctttgcaggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgcgatgcattgttttaaatttaaaatgttttgagaaaaagcagtgatttttagaagggttattaggtcgaatggggttagagaaggagcattccagtttccaacttcttgtttttaagtctttacaatcctgcaccagtagaggagagtcagataggcatccagctaaaaaataatgccatctgcctctcttttttccagtcttgatgtttattagtatcaggctgccagtcactcctctaccttcaggcttctggctgctgtagaatgtcgatgagtccaagaggacaccaaaaatgaactctactaatggccgctcaaaaatggccatagtgcgtggcttctgggaccccaggccaaaatggagcttcccatttcctgctttgccttgacttcaagatggctaggcagggaccacgcgacttatccattcaagcaggccgagaacggggagacggtctggcctgtggtctcatcaccatggtgaaggcccaagccacagctggcccaagcaagcaagagacaggacagagcagaggtcagcccaccatgcctttcagtgcagtggccctgcccttggggagagactgtttccgtgggctgtcacccatcaaatcagcagctgcccttcctccctgtggaagagcaaataacacaaagggagagggccgagaaggttccctgttagactctgctgtcctctagggcaaagtggggtccctccctctgtgggaaacagggtaggagattgcgttctccctgcttccacagaacagcgtggtgtgtgggttgacagctgactttattagatggtagctggcttcttgcgaagatgtccacattgacaagtctttggaagccctttcggaagcatgatggacttctccaaggaagggcagtgtcgtctttactagggatgaaagagttgaccgctgctaccttcacctgttcctcttcttagcccatgaaaggcacgcacaacaataggaggaagaaaatgacttaattccaccaaagtgtcatccacatagtgttgacaggttcagagcttatgctacaagtgatccgaagccgggaaaagtgactgggatgtagtatggtttctagtatgtaagtgaggcgtgtccgcgttgcgggcctgtggggaattaggccagatagacttttgttcatacacatcggtctgttgaggctaatttttcatctgggtagaaccgtgcttacttcacacaagttattcgtggatttgttgtgattgtaaaatcagcctggaaacgaacctttggccttcaaaatctctttagccttggtcccagatgaatgttctagcgccctgtaggtcagggggaagatctccccgaatgcagcctctaacgttccatccacgtttccgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttgggtaagatatcactggaaagtaagaacacatagtttcaaagaagtcagccggtaggagtgggatttgggaaactttttgttttgcctttgttgtttgctactgatcacctgcgtgcgagggaggcttcttggagtcaggtgggtacatgttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccgccaccttgtctgcacagcccactggcggcttctgttaagggagggtgccccgacgtatggcattttatttctaaagcccagagaaaggagtgtgaaatagttccactgatgtgttctactaacttagcagtactggtgctgagtactggccatggcaaggtacttgacctccctgaaactcagttttcccatctgtaaaatagacataatagaacctttctgcagaatataagactaaaagaagtaaagtttataaagcccgttgtgcagagagccagctaagtagctggtgcccacaaatgttacttcccttttccttgcccttcttaagaagccacttcttgcctgtatttctgctttttcagaaatcagcttggggctgctggcagtggatagctcataaaacagactgctttttctggaattatattaatattttctgttatggcagggcttggcagactacaaaaactgccttttataagcgtagtttccttagaatacagccttgcccatttgtttatggattctctatggctgctcgtgtgtaacagtggccaagtcgagtggttgaggctgacaaagcatgtggcctgcaaaactgaaaagagttacagaaaaagtttgtggatccctgaataccttacttgcagcctgatcttacaggccccattagatttctttcttgatgtaatggaaattggttccagtttttctttctttttttttgaaatttagcctcgctctgtcacccaggccggagtgtggtggcgcgaccttggctcactgcaacctctccgccttctgggtgcaggagattctcttgcctcagcttcccgagtagctgggattacaggcatgcaccaccatgcctggataacttttgtatttttagtagagatggggttttgctatgttggtcagactggtcttgaactcctggcttcaagccatccactgccgtcggcctcccagagtgctgggattataggcatgagccaccacgctcgactccaggttttctttagcagtaatttattccaaatactgctagttataaatatatgtatgtgtatatttctatctttatgtctacatacacacctgctttttaaaattagttaattcatgatcattgtttctggtggcgtgcagggaggtggtgtgctccacgcccatgtatccgtttttggtgtttgcttttgcagtaagcatcatgcatgaggattggtgctggaagaacaagagcctggaggtggaagtgctggaggatgacgtgtctgcagttgagttcaggcagacgggctacatgctgagatgttccctgtctcacgccatcactctggtatgtacggcttatggagtctcttatttggaaaagcgcttgccttgtggatgtcaagaaagactaacatcccaggaatattgtaaacgtaggcaagtcagatttccttttctgcctctgcactcacccacctgttacgcaacgcataatcaggaagcatttatactctctcagtggaaggacccctgtatttaggaggtttccttgtcctggccctacactaaatctgactggtgattcggggtgacctttggtacagtgtagagcacactggctttatattattagtaataatagctttgggtaaattcatttactgcttctcagcctcagttttcaccgaaaattgagatcttaatacctacttctcagggttatggcagggcttaagtgaaccctcttaggtatcaaagtgtccttggtgtacaccgctctgtactgccaagtgagtttctctgatatatatatatatatatatatatatatatatattttttttttttttttttttttttttttgagatggagtcttgctctgttgcccaggctggagtgcagtggtgcaatctcggctcactgaaacctccgcctcccgagttcaagcgattctcctgcttcagccccccgagtagctgggactagaggtgcgtgccgccatgcccagctaatttttttcttttttttttgtatttttgttagagacagagttccaccatgttggccagactggtcttaaaactcctgacctcaggggatccacccgcgttggcctcgcagagtgctaggattacaggcgtgagccattgtgccccaccttctctggtgtatttgttccagtgcaggggaagaagctgtaaacaggatcttagcttcttgttgactgtggtctctgtggcctgaaaggcagtgtgaaatgggtttcaggagcacctctgtagatcccttcgtgaattttctataatgttttgatgtcgagcggcggcagatgtcatcgtcaggtcttagtttctctgtagagaaactagaagaattggaactggtgtttcatgtgccaacttactcccctaactgcttaattacaaaaactccacaggtcgatttgttataggagatcgattaatatccggttcataataagtgatagatatttaggaaacctttcccttccagcagtggagtggatttccagctctcttgtaataagatccttttttttttttttttttgacacttccttaaccccttctttatctcctcccactgtcccctcactcgccgggccccagccacagtggtcctctgcagtcccacaccaagctcactccctcctcggggcctttgcacatactctcccctctgcctggagtgctgtgacttctccagaaacacgtgttgttggtttttcctcctcattcaggtgcagccctattgttcaggagagatgtgccctgggaccagcgagctaaagacccctcggtggggattgttcttctcttgctttcctgtttattttcacagcttcgttactgaccagttgagatcactaatttatttgttgttgcgttgattttgtcttcctgtattagaacataagccctgtgagagcaggagccatggtcatgactcccaaggcccagccttgtgtctgtcacatagcaggtgctcaataaatattagttgattgaatgaaaaatagcacacttttgttggaagttttgggaggtttttaattttcctgtggcacccaactgctccaatgattaatgggcaaaacagatgactggtttggaaagagaaatattattaatcatcttggtgtctccatctctcttagtaagtcattgtattggctttgctcccttaggaattttatcaggatggaaatgggcgtgagaatgtggggatttataacctctccaaaggagtcaaccgattctgcctgtccaagcctggtaagtttggaaggattgatgtgccatgaattagaaaaatggaaaggcaccagaggatggttttgaaggcatttttttctaccttggttctgtttgcatcaagctttcaatttctgtgtgttcaacctgctcttgtttttctgtctgtcttgggtttgagttgggtagacaccactgggccctttcacctccaaaaatataccattggccaatggcctctctttatagagctgttttaaaatttgaatcatttcccactttgcttaaaatctttcagtggcttctcgctctttctcattttttttttctctttctttttttgagatggagtcttgctctgtcacccaggctggagtgtagtggctcgatcttggctcactgcagcctccgcctcctgggttcaggcgattcccctgcctcagcctctcgagtagctgggattacaggtgcccaccaccacatccggctaatttttgtatttttagtagggatgggtttcaccacattgtccaggctggtctcaaactcctgacctaaagtgatccgcccgcctcagcctcccaaagtgctgggattacaggtgtgagctgctgcacccaaccctctctctcttttataatggctttttttggaggcagaatttgcatatcataaaactcacctatttaagatgtacaataaaatgatttgtagtaaatttatcaagttgcacaaccatggccagaatccagttttagatttgttcatcacccacaatgtaagatcctctgtgcccgttgacagttaatccctgtttctagccatggccagccactgatctattttctgtccccatggattggctttttttggacgtttatcatacgatgctggtattttgtttggcttcttttatttaacatgtttttgaagtttatctgtgtcatggcacatatcagtagtttgttctgttacattgctgtgtagtattctggtgtgtggttatatcatattttgtgtatccatttatcagttggtggatatttgagtggtttccagtttgacgctgttatgactaatgttacggacattcttatacaagtctttgtgtccgtatgttttcgtttttcttgtttcgatacctaggaatggaattgctgcattgtgtgataagtttatgtttaaccttttaagaaactgtcaaattgttttccacagaggctgtgtcatttgatattcccaccagcaatgcacgagggttccggtttcttcacctccttcgccaacatttgttattgtctgttttattatagtcatcttggtagatgtgaagtcgtgtctcattgtggttttgttttgcattttcctaatgaataattcagtggctcctccgtttggttcccaagataaaatacaaactccttaacctgatcttagctcctgtgtaacccagccctgtctgccactgtctctactccagccactctgtccttctgggtgtcagttcagctgcctttggctacatgtaacaaaatccatacagcagtgccattggcaagtggtagtttatttggctcaataaagaagtgtggcagtgcgtggctgccagcatgggttcagcagctggtagatgttaggggtggtgtctttgtgattctttaggcctttcccttctattttttgccttgtattttcaagatggctgtggttagaaaacttatgtttaaaggaggaagtcaaggagagggcaggcaaacatttccttgcgccccctcctccagtaagctacttgtctgtattattggccagaaccgtgccacatggttacttctagctgcaagggaggctgggacagttggatgtgctacccgaggctgagcacgttgccaccctcaacataaccagggtttgttctcaaggcaggaaggatgcctgttgaggaaacaatgagccagcctgtgaggcagatgctgttctctgtggacatctcctcctgcccctcctagctggggccttcttacccatcagttcagtattgcttcctggggaaggatggcctccagggccacttaggcctgcctcctacactcttgctctcagcactcacttctatccccttcttgcatgtgccacaattgatatgtttgtggctgtcaaatgctccccctctctgtggatggtaaactccatgaagacagggaccactgctctgtcattccccactgtgtaccagtacctagcataatacctggccaggaagagatgctctgtcgatatttgttgaatgaaagaccaaacaaaacaaacagagaaacctgatttttttttttttttttttttgatggtaactactctggggcttgttgagtgcaatgaaaacagcagggtggttttagctaatttcaggtttttgtaggaagtgtggccaaaatactggttaatgatgatttgggggaaatacattgttattccttgtatcttcctgaaattgactgtgttcctctggcaagtgatgaaatgtacccctactcggagtgtcctcccacacagactcacacttttctggggcttcccttactccttacctcctttttaggaatatttataggaagaaattgaggctgtggttatctcttggatccttaatagaatcttttaagtaggaaattatcctcagtccaatttgcagtagaaacgtactttctgttccttctcgtgcatgggtccgttcacctggtctgtgcagatttaactactgtgagttgttaccttatggaaaatgaaaatcatgcgcctgtgatcgggccattgcatggatcgggtcattggtaagacgccttcataggcagtgaaaacgatgcctgcccagtatttctgatcccattattgcagatctgcgatacatttgagttttcacatgcaaagagctgccactcgatttcagatgtcggaattgctcagtgtaatagatgccattctctgaaaattacttttgatttcctgtctgtaggtgtgtacaaagtgacccctcgctcctgccaccggtttgagcaagcgttctacacctatgacacgtaagcctgggaattgaatgctttgtggtgtttgtatacattccgtggaggattcttcatttacttcagagaacaaaaggagtttttctgttttttttctgaaagaggcaaggttaggccttcaacagcatttctagataaggattttaagacacttggattagttactgaggaaccggagacaggatccctttcccaagaattctgtaaccccaggatagagggctgtgtttttgaagtgccttaaatagaagctttgtcaaatctcccagccctcaccgatgggcatctgtcaagttcaagtctgccatttttgtatttttacagacgtgtgtgggtttcactgggaattggaagcataaagttgtggagtggagaattagtttactctttaaaatacttctctggatctccagagttattttaccccagactaaaagcaattttctgtagtatatttagggtgaagaaggatgcccaaaaagggtattgctgatgatcttctgagaatgagtaggttctagcgtttcctctgctttgatttgtaggtcttcacctagtatcttgacattgacagccattcgccaccatgtccttggaactatcaccaccgacaaaatgatggatgtcactgtgactatcaagtaagatgagcgttctgcagtgggccgagagtggcgggagagggtgtggatgaggcctggggagtctctaataggctctctggaaattagttttgatttcttatctctagatgtatatacaaatggccttccctctcttataggacattgccgtcaattcccagcagccttgatcctttccatttctgattcagaaattacctgtgggtgaggaagagcgttgcgacagcttgtttcagtgtcttcaatttctgtttgaactctttgtacttctcatctttgctaaggaaaaaaaaaatctctggggtttgtgcattgtatttcaagtgttttagcaaattcaaattgcctatttttctttagacttttgcttgaaggcttgggaaatagagatggcacctggtataagagaagggtcgtgagagaggaagtatttgaaaggcaagtccctcaccgaaggtcacgttcatgtgaatgtcacctttcagggaatttttgcagtgtggtgaggtacctgtgacgccccaattttcttgagaaatgaaagagttttggcaacatgaccgtctctgtcaagtagaatgggcattgcagtccctgtctccctcctgcccctggttgaagtcacctttccagctatgtttccatctttctgtccaccatctgtttatccatccgtcatccctgcagagtacatgatgactgaaaaactgagagtcttcagtgtttaggcactgggcttatgaggccacagcccctacacttatgggattgacagtctcatggggggaacagtggtcagatactcacatgcagaaccgtaaaatgacaactgttctgagtgctttgagcttgaccttgggggcatgcaggacaggtaggctgcggggggccaggccatgttaaggtccatagtctttgtcccatgatgcaattgacatgttttacatagaggaatgacatttttcttcctgaaggtccccctattggccgagtggagaacagacagaagaggcctgagagtgggaggtggtggaggcagggggaggcaatgggggccccagactagtggctgcggagatggagagcgacggactggtcggagagtcgttgagggactgagttgatgagacatggcactaaagtgaccactgggttagggcgggagaaatgtcagggctggccctggtttctggtgatggggagccaggtttttagctgggggtggatttgccgaaggtctgttgctgtcttttactatcatttactgtctccctgcttggaaagtatgaattactgataggactagcaatctaccttcttaccagtagtaactgcatgttacctcctttcagcttgattacattcatttttgtaacttcacaagggtgtttgtgttgcttgcttgtgccggaggttgtatggaatgcatcttccagctagacagagccactcggattcccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccatcatctagtccctttttaccacttggccctcagccttggtctgacccccctctggggtcactgtagcagcttcccagctggccttcccttcttaccacgtggccctcagccctggtctgaccccctccgggatcactgcagcagcttcccagctgggctttgcttcttaccacgtggccctcagccctagtctgaccccctctgggatcattgcagcagcttcccagctggccttcccttctcaccacgtggccctcagccctggtctgacccccctctgggatcactgcagcagcttctcagctggccttcctgtttccgccattgctttgtgtattttccatgaaggagcaaacgatttcttttatcataccattcctcgactgaaaactccagtggctccaggtcggcaccaagcctgtgaagcctcagtctgacatctgctgccccttggacctctctgttggatatgactcttccgtgggcccctgtgccccaggctggactggtgttgccattgcttgaacatctgagtgagctttctctccaaggactttgcacttggcatcgctttgcccaagctactgtttacccagagagctgcgtggcgcattctctcccttccttcagacctttgctcaatgtcaccttatcagaaaggccttgactgtccctttaatgtaaaacagtgctccgggctctccgtcttcccacactgctttatttttctttattgcacttttcctctggtattatttttctctttattttcagccccttcccactgaaacgtggattccacaggggtaggaagtgtggtctgttttgttgatgctgtatccttggtgcctagttctctatcagagcagttctcagcgaaggtagaatggagaacagaggatggtggtgtggagaaaactccgtgtcctacatggaagctacaagcttatatccagtcgccataaaatcaaccgtatttcattccagcccagatctaccagatactgccaccatcactgcgaagctcagttgttattttttgtgaaactactagtttatttaaaacagaagactccgccactgtggtgtcatgataagatgtccagtttgtaactcgcaagtccatactcgtagaaaggtcaaattcccactgaccacaaggatacgcaaccacgtcctaggggccgccatttctttcttctaggtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtaagctctcttgtgcgtttccctacagtgtcctctgttttgtggggataggacccgccaaactgaagtatattaattattttaggtctggagagaaaatcactgttacaccgtcatctaaagagctgctcttttatcccccttcaatggaagccgttgtcagtggaggtaaatgtcaactcagcgagcgaatgtcacacacacctttgcagttgttcccttgcctgcatttacaagtagatttgtgatgttatagtgaagccatctttgtaagccaccttacatcctctctggcacacagatgttactgttggttggatggatggatggatggatggatggatggttgggttggatggatggatggatggatggatggatggatggatggatgaatgaatgatttagataaataaaagtaacttttgctgttagaattgagttgatctttttggaaaaggacttggttttctttgacattatcaggtcgacaccagaaggtagatgaagcacaaagctgccagtgatgatctttaatgatctttctgttgtttggcagagcatgatgggagggtctttttttggggaatggatgactgaagtgatcacttgtggagtatttgtcttttgccacttattatttttttcccagcactctggcttcgttaagttgtgggtgttatgtggttcgcgtttggaagcagagggtgttgaagagcgtgacttctagcaggcaggctgtttggggcggtctttctcagtgggtcctccagaggctgagcagcacggcctcctgtctgctgtaaagtgttccctcctgatctgtggcctcctgagaacctaggaagagtagtagtaaaaacccagccttcagcgttttttgattctcttgctaaagtccttcacactgagaaaggcctttcagggatggaaagaggcttgggctgtatccgattattgagctccccggggtgttaaataaccgcatttggaactagcttctaagatctgttttagccacttttgtcatgggaaacccccaaccaagaagctcctgtctctgctaccaagccccatccttgtgtttatttcttcccctcttagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacaggtgagcccgggatagagacacatttgcctgggatcagcgtgggagtcctctgaagaaactggggcccacatttccttgggcttggtaaggcttcctgcagggtgtgaacaaagccgttgctagcattctgctctctcctcttcagtgttggccccctgcacagtgacctggagtacacggtgacctcacagaaggagggctatgttctgactgcagtggaaggaaccatcggagacttcaaggcctatgccctggcaggcgtaagctttgaggtaactaacactgtattttcaaaaggcagttatactgaggtataattaacatataataaactgcacaaaaagggtacagtgtggtagtcttgacctaggaatacacccatgaaaacacctccacaattaaaatagcacatctgtggccctcaaggtttcctcctgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacaggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaaaattggtaagaaaaagacaacccactagaaaaaaaatgaacaaagattatgaaaaggaaattcatggaagtaacgcaggtgactaataaacacagaaacacaaagcctctgtagttactgaggaaatgtgctaaggaagttacagtcgaaacactgttttgcagggattagatttgctgtaattaagacaatctctattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagttgcagaactgtacatataacatgccatttttatttcacctcctccacccactcaatgaacttgccagtctgtgaacaataatatgtaatgtttataaaatttgtgtgggcatagaaagagttctgggcggggcacggtggctcatgcctctaatcccagcactttgggaggcccaggcatgtggattgcttgagcccagtagtttgagatcagcctgggcaacgtggcaagacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgagacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacagaatcatgtttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagtgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaagaaaagaaaaattaaatatgacttctacctctctgagtcattgcaggcaggtgataccatcagctgccgttgttagagttgtgattgccactacctgactgtgagtggtgattatagagagagggttactatttttggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagcctattgagttgctaaaagcttttatttattttttattttttgagacggagtttcattcttcttgcccaggctggagtacaatggcgcagccttggctcactgcaacctctgcctcccgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtctcccaaagtgttgggattacaggcgtgagccactgcgcctggccacttttattttttaaaagagtttcaaacctgaattacatcattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaataaaaatacaaaataaaaaagatacacatctatagatagagagatgcatacatatatacatgtatacacacagatacacacatatgtgtattttttgtagacttatacagaatcactttagaggaagagtaattggaaagattgggtttagaaaaatggaccattttctactgaatatatggaatgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttgaaagtgggccggccacaccgagttgcctgggtcattgaggcacagttctcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgtgttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtatgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggggaagacagagtcagggttgccagatccttgaaattttaaaaagagaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagaactgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctaatcagaagtcctcccgtctcctctggctgtctgcctttcatctgtggcggggggaactttcatcctaattaagggtcctcttagaatagtgtcatcttcacaagcagaatcttatgtgggtttttagtgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagcacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaaggcttttctcttactgagtaactctcattgggaagactagagggcttaggtagggcaagaggggctgcctcttagtggctttatttaggtggcttcattatgcatgaagattgtgagggaggatagaacttttgacctaggaagtggattttcttttttttttcttttttttttttttgagatggagtctcaccctgtcacgcaggatggagtgcagtgccgtgatctcggctcactgcaacctcctccttgtgggttcaagtgattttcccacctcagcctgtagctgggactacaggcatacaccatcacacccgactaatttttgtatttttagtagagacggggtttcaccatgttggccagattggtcttgaactcctgacctcaggtgatctgctcgcttcggcctcccaaagtgctgggattacaggcatgagccaccgcaccgggccggaagtggatttccttgacgtctttacggtgttggcattttaaatggctgggatgactgcatctcacaccaaaatgctttgcatgttctcggtgtagtaacttaggccaggatcactagcataatgtggactgtggccgggcaggtatgaaagggaagggggccggccctctgggatctcgcaaactccatgtacagacctcacgcagagggggtgctgtgactctgcccctgctctaacaggcaagagcatccttctcctctttttttttaagagaagctggaaaatctggcttcatatatgaaatttcttaatttttaacatgttggcaagtaattcaaacgtagaaaaaaaatactgtgctttcgaaatgaaatgtgtctatgggccagggatatgcccctgctctaacaggcaagagcatccttctcctttttttttaagagaagctggaaaatctggcttcatatatgaaatttcctaatttttaacatgttggcaagtaattcaaacgtagaaaaaaaatactgtgctttcgaaatgaaatgtgtctatgggccagggatagccatcttctgtcggtttgtgaccttggacgtagggtactcaatgacaaacttagcttccttaatgtaagaagcaaagtttgccatgaagcagctctcaggccatcggacagctggcatagaagttcctccaccagctttctcattactggcattccctctttctctctctaggttgggaataatgacatcgatgatgtaaacatcatagttttccggcagattaatcaatttgatttaagtggaaatgtgatcacttcctctgaataccttcctacgttatgggtaagtccagacttttaagctccaagtattgtgttccctttggctttgagacaagtacgaatgggatgtttttggttttgtgcctgtctcgtgccttaggtgtgacaggtggaggtgctccagagtgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattctaaagaaagcgccttgtaacttaaaattttctctggagtggaggtcgtattaaacgttcttgcattggtttaaagaaatgcctgaggctagataatttataacaaaagaggtttcattggctcctcgttctgtaggttgtacaggaagcatagtggcgtctgcttctggggaggcctcaggaggcttccaatcatggcagaaggtgaagtgggagcaggcatgtcatgtgggagaagctggagcaaaagagagagttggggcatggtgccacacacttttaaatgatcagatctcacaagactcataacgaagacagcaccaagccacgagggatccaccccaaagatccgatcatctcacagcaggccctacctccggcacgggggattacaattcaacatgagatttgggcagggacaaatatccaaacagtatcagaggtggtggacggtgggctggagagcaggtggtctgggctttctcttgtctccagtagtgactcaccttgctgcctgggccagtcacttcatttccacatgcctcgacttcgtcctctgcaaaacctagattttggactcagagacctcttataatcttgttcagctctaacaaaatctccatgttaccattaatgaagaaatgtttataaaataccctgcagaccctctgcggatgttagtgatttgctctgggggtacattgttaagatgcgcttgtaattttataagcagttaagtatttggcatgggtgagaaagtgtgtgtgcgctttagtccactctgtccagggcttgcaggcgtgtgcttgtagggaccaggcaggtaatgtcagagagtgcagagggttgggtagggtggggggcaaactggggaactcctgccccatccatgaggggcacaagggaggggaagaggcagagaggaggggagggcgccactctcttgctcctgagtgttgctgtgctagaattgaggctcagggttggtgtcacttcccagttttccggagaagctggaaattagaattatttgaaatcacctgatttttaaatatagtcggtgaattcagatttacttaagatgttatagaagaaaaaagaacacataagggatcttcaatgcgacccataaccttcagtctgtgactttcattttaggaaaattcccctggtgtgttatgtagaaaggtgccagtgtgggcccagggaggtggtcctggcattctcttgcggcaggtgcactgtggcatcctcacagcctttgccatcagccagggctgcaccttaaccctgctcatgccccatcccgtgtgggagtgagaacaggcaacaaccccagaaataaagccagaaacaaagtactccagtgcctcctgaagcagcgtggagagccacgtacatgatggaatgcgttttgagtttaacagattggtggagttaaggtgacatcatatgatgaggcagtgcaaggcgggaaggaccctcaggagtcgtcagggggttgagtcccaggctctaccatgtgtaagttgtgtgaccttaggtgactttggctctctgggtctccatagggataataacaatacctgttttgtagtcaggattggcgataatgtagataaaatatctggcgcctgcctggcatattacagatgttcaacacgtgttagaagctatttttaatattactattatattaacttatattactattttgagcaagaacatgggtagtcagaatctgatttgaatcttaatttctgtgcatgatacataactggatggagtctcagatgacagagggatgtgtgatgtctatggagggagctttctttttcaaatatccatgtttccaaagacacctacccagagagcggctgtcctgaggatgtctgctatgaaatattgattgtgtttcagtttcaaagcatgtctgactttgtttctccctccaggtcaagctttacaaaagcgaaaacctcgacaatccaatccagacagtttcccttggccagtccctgttcttccatttccccccactgctcagagatggcgaggtaatgcctgtggccggattctaccttctgcctttgttttaataattctgctgtttagtttaaggaagcacagttctctccttttctccctaaataccactctgcagaaatgcgctctctgaatcaaaagaggttgggttctgtagggattattttttcttcattgtttttctgtttacaaaaagaatacatattcatggcaggagattttgggaaaaagaagacataagcccatcatccagaaatagccactgctaacatggtgattggtatcctttgggtcttttttcaggcacgtgtgcgcatgcatgtataaatataaatagacatttattttaataattcaaaactgacactgttttgtacattgttttgtaatccatgctcttcaatgaagaatttatcacaaatctgttcctcatcatcaaatctttcttttttttttttttttgagacggagtctcgccttgtcgcccaggctggagtgcagtggcgcaatctgggctcactgcaagctccgcctcctgggttcacaccattctcctgcctcagcctccgaagtagctgggactacaggcgtgcgccaccacacccggctaatttttttttttgtgtatttttagtagagacggggtttcaccatgttagccaggatggtcttgatctcctgacctcgtgatccacctgcctcggcctcccaaagtgctgagattacaggcgtgagcccccgtgcctggccaaatctttcatactatgatttttatggacagtagtccataaactaggaaacgcgatgatttatttaaccaaggcctactgttgggcatgatcgactcttgcactttgaacatatcaccccatgctttcctgctaagaagtccacttttaaaaatgccttgtaatttttaaaaattcctctattttaacattctgctattgagtttagggaaatacagtttcctcatgatgggggatcccttgaatgagatgagttgcttttctcttgctgctttgaacgttctctctgtctttgataatctgattataacgtgtgtcgtgtagaacacttgcagctccaccttttcagtgtcctttgggttccatgaatctggatgtctccctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcgaaataatgaaacaggctgtcacggaattttctcctcctctttctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcaggaggctgaggtgggaggatcacttgagcctgggaggttgaggcctcgatgagccatgatcatgcccctgcactccagcttgggtaacagagtgagaccctttctccagaagaaacaaaacaaaacaaaacaaaacaaaacaaaacaatccatggggtggcaaaagaaggcatgtccatacaacctgtgctccaggtcgcaggttgcagggcagatatttaaagggctcctggcattgggtcactttctcattctgccttctggattctgggcttccccagattgtttttagcttttctgagcactgatgcctgcgattccctttgaggaggaaactggtaataagagcagtgtaattgtttagatcggtggctcaggaatgattttgggggaggagggacaccactatcgctggtgtggcgtgtgcttctccatgagggagcacatggtacatggccacgcaaacccctagaaccaactgctactttacaggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttgttgcttctaggccttttcagtgggcagaataagaactttattgttttcaaaagatgtaactgtaagtggaacaatatcctccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatacggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcactgtacttctaattgcatttctctcttttcatgtggttaagagccatttgtattttctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctgtgttaaatgtgttgattttttcttattgcttctggattttagagtcataggaaggttttcttcattcccagcttttacaggaatttatcgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaccccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtctcaaaaaaaaaaaaaaaaaagaaagtgccagaaagataagcatatacaagaaccacttacctttgcttggggctgcattgtggcccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccgagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataattaaaaaaaaaaaaaaaagctgtgcctgctggggcttggattcccgagcagggccaagtgttgaatgaagagagcgcccactctgtgccaccccgtacagggccctcacaggttgatcctcacaacaagccttcaagcaggtgtgccattcctcccattttcacagaagcccagaaagattgagtcacttactgagtgttagcagaaccaggactcaagtgaggcagtttgtctcaagccacatggtttccacctcgttctgccctccgcgtgatgagtggctcagcattgcatgttcacgggggctttgtaagcacattggtttccttctttgttgatgtgactgcccacagcctcgcgactggattttactcagtattccatgccctgctgagcatttcacatactcctttcatcaagtttcacagcatccacccccagtgggtgttgttcatatgatctccatgtcatagttgagtaaactgagtctcaacgtggttgcctgagtttacccagtgaggcctgggacctgagcctagactgaatcactcttaattcctgctgaattaaacttttatttatttattcattattatttttttctgagacagagtcttgctttgttgcccctgctggagtgcagtggcacgatcttggcccactgcaacctctgcgtcccgggttcaagtgattctcacctcctgagtagctggaattacaggcatgcaccaccacttctggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccagagatacaggagtaggcagttgttgatggaaatctgttcctgcccttattctttcatttatgaaagggcatcccaggtacagcggcccccacagtcactctctagcccagcagttctcggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggctgaaaatagctgtggcctcgggaacctctgcgagaggagtcccggtatcctacactgagaacactgctctggctcattaacttgtttttatcattattgggaagttctccttccatttatttgcttcctttatgagagtagagtgggccaatgggatataggttcacttgatgctttagaacccagcatttcaggggctttagcaagatggaaatgtctgtctcatgtcaagtgtccaggagtgaccagtgcagagatagtctggtagctccaaggcgtcaggggacccaggccccttctgtctcattgtgctgttccagtgcattgcttttctccaaaatggggcaattggccaaatgctgtctacccagcaaaagggagggcacaccacttccctagggtccagccagggtgtggcacttaccgcttctgttcctgtaccattggccaaaatttagttccagggctgcgcctgctgcagggaaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatacatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttcccggtcgggagggcccgtgaaggcctcaagtccagacttaggtctcctttcaaggctgtaaacttctgtaacatctcctaatccttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatcatagatgtatttcttggatgacatgcacgtaacccccgggagtcttcagttgagccaaatgtagagcaagtcagagtcctgagtgaagctggctggggcaggaaaaacacgagctcagccaacatggtccccagcagcttttggcgtcagtgatagagaaatcggagatagtggaggttgtggcaagttgaagtgtgcccaccacgtctaagggaagcttagggactcagctctggctcacccctgctgtgcagaaatgtgcgttcatttttctagagaagccagaaaaacaaagatttacgtgaaattttcccaattttaaatgttagccacaaatgcagtgtttttttaagaaaaccacacactttggccaaacaaaatgcctacgtcggccgggtgaggcttaaaggttgccggcttgcatcagagatccagaggaagtcacagcattttaacagctaaacttaatcctcacaggaagtcatcaagtgaattaagtgatattgaaggaggggacacatccatccatccgacatttattgagtgccacataggacaggcatgggtatgtgaggatgagtagggtagacaacactctacagcgagctggaagaggccagggaggccccgtctgccttgttcttcgtaccccaatgcttggcacttggtgggcattcagtaaggaatgaatgaacgcacgcacagaggaatgaatagatgggcacacagtgtgtgccctcacagcacatggcccatcactgggtagaaggcaagtcagtaagtagacaggggtaatgcagggagccgagggcctccaggtggaggaacatggaggaccacaggagcacagagcagagttctcatcccactggagagcttagggaactttctggatgtgatgcgtgagcagagtccaaaaggacaaaacagagagagggaaaacaaggtggaagttcttgttaggtgccactgccaccccagggggtcagcttgggggactccctggctcttgggggccaaccgcagagctgccctgttcccacctatcagctagcttggtgttggcaccgtggaaggaaagtgaacagtgttggagatctgggacagatgtgatattaatacaggatccatttcttggagtgttttccaactcttattccaagtggacacccagaaacatcccttttaaatgttaatggggtttttattgacggtataaaggttaagagcttgcgaaagatacaattgtcagtacactccttccagttccggaggccgccagtaagtggcagtctttccctgtcgctggctgcaggtcacccttggcctcggtggaacttgtgtgggtcattctcagtccatttgaaagttgggcctgttcggttgtgtataattttctgttcatcatttttctggcaatctcaggacagaagtcctctgatcctcctgtgagaagtaaacattaatgttattagattctttttttttttttttgagtttcgctcttgtggcccaggctggagtgcagtggcgtgatctcggctcactgcaacctctgcctcccggtttcaagcgatttcctgcctcagcctcccgagtagctgggattacaggtgcccaccaccacgctcgcctaattttttgtatttttagtagatacggggtttcaccatgttgtccaggctggtcttgaactccctacctcaggtgattcatcaaccttggcctcccaaagtgctgggattacaggcgtgagccaccgcacccgggctgttattagacttggaatgggacaaaagtcatatgagacagacttgtttgctgaggtatttaaaaaacaaaatggtctaagatggcagattcttggggaactctgctctgtgcacatttctgcctattaaagtggccgtaaaaacaaccataaatccttgatgaggacacctcaggagctttaggacggtgccattcttttttaattaaaagctttttatttgatttgatttttctgtagagacagggtctcggctatgttgaccaggctggtcttgaactcttggccttaagtgatccttctgcctcaacctcccaaagtgctgagattataggcatgagtcaccacacctggccagggcagtgccattctaaggcaacggcttcaactcggtcttcttttctggggttacaggagatgggaagggccgaaggtagcatgagaacgtgtgtgtgtgtgtgtttgtgtgtgtgtgtgtgtgtttgtgcatgtgtatgtggaaggactggtgagatggctggaggaagaggcagtccttctgcttaactctaatggcctaaatgtgagaaacaaagattcaggaaataaggaaaaagcaaatgagtgattgcctctctggatcaagcacaccagcaggcacaaccagcctttcttgagctactgtgtgccgggcgctgtgccgtgcccttgcatgcatgtggatgcttcatgagttcatgaagtaggtatgcttccagccccatttttcagagaaagaaactgaggctgaacaatcttgcagctgtcaagtggcagagcaggggtttgaacccaggtccaagagttcttaaccaccatgttttcctgcccttgatgtatgaaatgagatgatgtagtcacatgccagcttgtctagggatgactcagaggtttagagatggatgtcacgtggatgttgtacaggagaggcaggtataagctgtagtaaagttaggaaaggcacagtgacgtggagcactgtgtgcagtggacggggtcatggctgggggtgagaatggtggaggaccttcgattatttcatcagcgttgtttctgtaaccaaagagctgcatgaccaaaccctgagatctagttccttaataggaacaattattcggcacgattccctttacttaaaagcaggggccgtcctaagggaggagttggaaagagtttgggggataaggtttgcttggttgccttctgtttaggctgatgttcagtgggggtcaaaggctgtgtgtccagtccctggcatgtggcgggtgtttgtggtacacagccagcctcaggatggcccccagggatgcacactgcctttgtgtgtggtcccctcccacactgaatcaggctggctctgtgcgaccagtgggaagtggtggaagtgagtgatgatgtgtgacttctcgggctaggtcgtaacaggcattgcactttggctctcgggaagccaactgccttgcgtgagggtgctcaggcagcctcgtggggaggggtgaggcccctggcccccagcatgtacagcttgccaccacgtgagtgagccagcttggaagcgaatttccccgccccggtcaagccttctggtgagtgcaactgcagatgacatctgacttccaccactcaagagaccccaggtcagtgctgcccagctgagctcttcccaggttctttatgtcccccgaaaatgagctgttttaagtttagaaaacttaaaaacacagtgacaatgaagcacagatatgcattacatacagtcccaaatcagtaatgacttcaagctgtgtcctctctttccaagaaagacaaagcagagaacaaagttcaacctacagtgtcttcccaaattcttgacccacgggatctgtgaatatcttatacgactgaattaagcctctaagttttggggtaactcatgcaacattaggtaactggaatagtgctcaataaatgtctgtcacatgaatgggcagtgaccatggatgcatttctagttgtgtattagttaaggctctcttggtttcaagtaacagaaatccaactccaactagcttgagcaaaatggggcattcctctggtcaagtaacggagaaatccaagagtctctggcttcatgcatagcgggacccagtctcaatttccacctcctggctctgcttcccttgatgccaactttcaggaatcagctttctgaaagaccactctgctagaaacagacaggcccatcctttcaaccaggtccaggactgtttgctcagtcactgctctcagaggcaggggcagaggcagatgccgggcacacatccacagaagtggagatggcaggaaactgagagtggagtgctggaaagctggcttttgcctatgggttccgcttctgacatcatccggcaatgtcaggctttacattgcccccatctgcagacccagcagaaggacagcttccatcccaccacatcaatatgccagtcctggggcgggggaaggacttatgggcaacctttgcagaatcactggggcctggccgcacatgagccatgcccacgctcatgtgacaggcggcccctgtgcctggggtgctgtattacccagaggaataagtgatcctgggtgggcaaaagcaacagaagagaagtcagctccacttccttccaaaacttgagaaggcctggtcaaaatcaccctccaggcccggtgtggtggctcatgcctgtaatcccagcactttgggaggttgagatgggcagatcatgaggtcaagagatcgagaccatcctggccaatatggtgaaaccccgtctctactaaaactacaaaaattagctaggtgtggtggtgggcgcctgtagtcccagccactcgataggctgacaggagaatcacttgatccagggagtcggaggttgcagtgagccgagatcgcaccattgcactctagcctggcgacagagtgagactaaaaaaaaaaaaaaagaaaaaagaaaaaaatcagcctccatttttggctttctctttcattagaaaaatgaacctgactttatgaccatgacaatgaaatgcctagagaagggagcactcattttccagtgggcctactgtgtgctggggtggcgagactcttcctgccctggaacttggtgaggtcaggagggaagatattatatgactgccttcctctgtactttttcagtgggggcaggtgtttatgcttgatgatgcaatggtgagatcttggttggaatatgaacttttctttctttttttttttttagatgggttcttgttctgttccccaggctggagtacaatggcaccatcacagctcactgcagccttgatctcccagggtcaagggatcatcgtgcctcagcctgctgagtagctgggactacaggagtgcaccaccacacctggctaatttttttaaaaaaaatctttgtagagatgagctctcactaggttgcccaggctggtcttgaactcctgagctcaagcaatcctcccaccttgggctccctaagtgttgggattacaggcaagagtcaccacgcccagccaggatcacagacgtttaaattacactccttctgctgtgccttacagcagtagaaggggtgaaatttaaacgtctgtgatcctggggttgttgaagatgccacccatctacatattctttcagatgcacaatatttcactgtgtgaatgaaacagcagcccttcttacgtgtgctttttggaatttgaagattttgtaagataagatgaatgcattggaacaagtgatcctcaattctgtgcagtctgtgcctccggagactggcggctgcccctccctgtctagtcttgcaagagaggcagctggcaagaggacagaagccggcagctgctgcgttttcatcctgtttctgctcttggagctgagggggagaggtggctagcagccacccagtgatcaaacttgcagcctgcctctcttgcttccttttcacagactggagtgtgcctgggtatggagaaagaacattttgcttcttgcctctcagagtttcaagaacgcctcacctgagtggcatgcattcatggaatgagtaattattacagtggagaactcctcactgtgaattaattacacagatgatattcaagacttagactgggctagtgcaggggttagcaaactatggcccactgttcttgttttataaataaagtgttatgagcacacagccatgcccattcatttgcagattatggctgcttttgcctgacagtgccagatgtaagtagttgtggcaaagaccaggtagcctaaaaagcctaaaatacttgctatctgggtctttacagaagacattttgttgttgttgttgttgtttttgagatggggtctttctctgtcacccaggctggagtgcagtggtgtgatctcagctcactgcaacctccgcctcttgggttcaaatgattatcgtgcctcagcctccctagtagctgggattataggcgcctgccaccaagcctggctaatttttgcatttttagtagaaacagggctttaccatgttggccaggctggtctcaaaccccgacctcagatgatctgcctgcctcagcctcccaaagtgctgggattacaggtgtgagccactgcgcctggcctagaaaatgttttctaacctgttgtctagtgggtgctttgtaaagtttagttttagggggagcatcattaattcattcaacaagtattaactgagcatctcccctgtgctgggtgctgcttggcatactgggggtttagtggtgtgagagagaccgagcctcagctcttaggagcacagtgctgatggaggacgaaaggtaaacacacacattagaagttgttggataatgccaggcgttacgaagaaaagaagcagaacaaggcaatgtgacagaggatgattggtatcatggaaggtctctctgaggaggcagcatctgagctgagacctgaggaggggaagggccagttatgcaaagatctgggggaagagctgcccaggcagaggggaccataattgcaaaggcccccaggaggaaatgagctccctgagtttcaggaatagcaaagaggccagggtggccagagtcaagtgattgagaggaagagatgagaacgatggcagggaccgggtcatgtgggtgccctggaaaggagtttagattttattctaatggcaacagaaggcattggagggtttaagtagggaaaggggagtgatctgatgtatgtttttaaacaattgcttctttaaattttgaggagattggattattgggaagcaagaatgaatttagggagagaagcaaagaggacgttgtgttggtttaggcaaaagacagcaatggcttggattggggtgatggaagtaacagtggcaggaagtggtgagcttggggctatgcttcagagatagagcagaaaggtcttgctgatgtatttaatacaggaggtgagggaagggaggaatcaacgataagtgaatcgtttgtttctagctgaaccactgaaatgtgtaggtaaattgagacttctgttttggccatcgtgagtttgagatgcttatcagacacccgagtctgcagcctgggtgagaaatcacggctggagatgagacgtggtgagctgggagtgtttttggatgacagatgaggccacgggattgaataataggtatccttatgaagactgagaaaaggagagggctgggggccaagccctgggacagtgcaaccttcagaggatgggcgaggagggccctgcccaagagacagagaggaagtggcccgtgaggtagggggaagtccaggagaggacagtgtggtgaatacctaatgctttactcattcactggtgaatgaatggatggatggatggatggatggatggatggatgaatgcatgaatattccttaataatatggttggccatggtccatccatatgactcctacggacaccatgttaccatttcacactcgtcttctatttaggagaaatcagacgaaactgccatcttatatataggtcaaaaatggtttccataaccacccacctcacatgcttactgaaattcattaagtaatagatggggtggggggcgggaggtttacaggtcggcaaaggaggcaaggctagagtgatccatgtggcagtggattagagtggcaggcatcagtatgaacacatgtttagctcaatatagatacagatggctacatagagaaatatttatggatatgtgcatatacacaaattagtaagacacacattactaatcctggctgtcagcgaagagagcctagaagcaaggataccccagtagcaacaaacctctggtgcccaggtctctgttctccaataaacaccattctccagtaaaaggaaccaggcttcttgaacaaatgtcgatcctaggaccgagggaggaaatagataagaagaacctgaagcatcttgtagggtcacagggtgaggaggcgctaaatgaaacaaaatgaaactgctgcagtgatggggcatctcagagggacacaggagccagtggaaaagctcccaggggtcaaagccagaacaatttgagccccaaaaaagtactattggattagaattcaaagaataaatacccatgattccatactgctataaatgatcagataagagagaagagacaaatctcccaggcagaagaattccagattatttatttatttttatttaattttttttttttacacagggtcttgctctgttgcccaggttggagtgcagtgatgtaatcttggcttactgcaacctccacctcccaggttcaagcgattcttgtgcctcagcctcccgagtagctgggatcacaggcatgcgctgccacactcggctaattttttgtatttttagtagaggcggggtttcaccatgttgaccaggttggtctcaaactcctgacctcaagtgatcaccctcctcggcctcccattcaagtgctgggatgacaggtgtgagccaccgtgcccggccccaggtaatttatatagctattccatcgtcaaggaggtggagcggacttcccacatcctaagtgtgggctgtgcatagtgactctcttccaaagagtacagtgtgaaaagagaggagagagtaactttacagtggagaacacggacagactacctcagccaggtgatcaaagtcaacttcaatagcggcaagtcatcttgagagaatgcgtgcctgatacagagtgctgagaatgattcttaagctctgtggtcctcctcctcaaaacacacacaagccaagactaaggatgagaagcatctgccaaatcccagttgaggaacattctacaaaatacctggccagcactcctcaaaatgctccatgtggtatcctggaacagaaaaaggacattaagcaaaaactaaggcaatcagaatcaactatggactttaggtggccaggcacggtggctcgcgcctgtaaccctagcactttgtgaggccgaggccggcggatgggttgagcccaggagttcaagaccagcctgggcgacatggcgaaaccccatctctacaaaaaatacaaaaaattagccaggcttgtggtgtgcacctgtagtcctagctactcgggaggctgagatgggaggatcacttgagtccgggaagtcaaggctgcaagtgacccgtgattgtgccactgtataccagcatgggcaatgagagtgagaccctgtctcaacaaacaaacaacaaacaaacaaacaaaaacaaattctctggggatggtagcaggcacctgtatttccagctacttgggaggctgagatggaggatcgcttgagccaggggaggtggagggttgaggctgccatgaactatgatcacaccaccacactccagcctaggtgacgagcaagaccctgtccccacccccctaaaaaaagtatggactttagttcataatgcatcaagctatggggtacatggaaactctctgtactgctttcaccatttttctaaaactgttctaaaataaaaaatttacttaaacatttatttaaaaaaaaaaacaaaccatttgagtaccaacagtgtcatatgctcaacttagcacatctttttcctggtttggtttgtgggcgtgaatgtgtactgagccatctaaaccttggttgcccgaccttcaccgtagccactgacccaggttaacagacaaaaggcccaggttaaggttatgcccagtggccataaaatagcccagcatccagactgcactccttgatgtacccaaaaaagccaaggaataggacggatgggcggggagtggggggcaaactactgcccattgcccaactctggccagctgtctgttttataaataaagttttattggaacacagtcacacccattcatttattatcatctatggctacatttgcatgacaatggcagtgttgagtagttgcaccagagatcgtgtggcccacaaaatatttattatctagcactttacagaaaaagcttgtcaacctccaggacagtggccacaagttctgccatcatctcatcccttagcaagaagggaaaggaatgcccattaaggcacaaattgttttctgttgttgtttgtttgtttgtttgtttttgagacggagtttcagtcttgtcgcccaggctggagtgcaatggcgtgatcttggctcactgcaacctccgcctcccaggttcaagcgattctcctgcctcaacctcccgagtagctaggattacaggcgccagccaccacatccagcaaatttttgtatttttagtagcgacggggtttcactatgttgaccaggctggtctcgaactcctgaccgcaggtgatccacctgctttggcctcccaaagcgctgggattacaggtgtgagccaccgtgcctggccacaaggtggtcttttaacaacagagcacacagctggacaaagcccaacgctctcttctttggggccgaggtgggtcattaatattgaacatttacaatgtacttgctccaggtgattcagtttaatttctgccgtctcttgtaacagggctcccacgtgcacgggttggggccgtgtgtctgcctctgctttctgaggccccacagcgtattgattctgcgaaacgtacgtttctttgaaaacagcgtctcttgacatgacaggagatcacacatcgcttgttttctgtccctttcattgccctctgaacatgataaaatcatgacctagtgtcaccgagggacctcagcatctcttggaaagaaggacttgccttcttttttatctttgtcaagccagtgaggccaagtagaaaatttttagcagctttggagccagacagatcggagtgcgagttctgcccgttattgactggaccgtgtgaccctgggagagccgcctagtgtctatgagacggaggctgttgggcaagaaaatggggatggtcccagcattatggggcggttgtgagaattcagtgcaatgatgcagtgctcccagaacagctggtctagggcttggctcatgggactgtcccttcgcagaggcagcgtggacattccgctggtatccactggtgtggctgtgcctgtttggtcaccgtgtctgttctgattggtcggtgctcctgcatgtcaagagttcaatgttatgaaaatcatccctgcctagagatgaattcccccttcccctgaggtctagactggtatagctgcttttggagcctcacctgctgagagctcacagctgtccttctctagagaatcaccctcagatgggagccacattgcctgggatgggatgccatgcccagtaatggcccagtgactaactgatacagcaacgtgaatggctggtccctgccccacggtggggacgatcctgtggcgtgctctctgctgctcgtgggataggtcaaggcgggactttaagggaccacattctcactctgctctgtccccttctgcatcctgtagtcctcacctcccttctcctgaaagcccctttcaaaacaaaaacaaaaaccacatccacccaagtccctgtctccagctctgcctccaggaaagccggcggaaggccgccagtctcagctgtgacagatacagatatttctgcatttccaggactgaggtcaatccctggggacccagtgaggcggtatctgaagggccatggagctggcttgatggggtctacaggtaggcagggacctggtggggatgtgactcaaggatttttatcaaatatctttatcccctgacagatgcaaaaaaaaaaaaatgagatcagactccagggtttcctccatgccacactgtggccccattgtttgttgtgctatcagcagaagttgattttgcaaggaatgtacacgtgtatgtgatgtttgaatgcacctatctgtgtgtgcgtgcatttgtgtgtgtgtgtgtgcattcgcttgtgtgtgtgtgtgtgtgtgtgtgtgtgtgtgtgtgtgtgtgtgtgtgctgaggatgtgagccccacttccggcccagtgcccctgcccaggctggctctgccctcctgctgctctgggcccctcaggcagtgactacctggtacatagggaaggcatcagcatcccttattcatggggactgtatactgtctccaccatattgggccttttggcctcttggacatgacttggcctctgctggctttaagggactgccagagatgccatcttctctgggaaatgttctcagcctgggcacagcccactaaccactgcctgcttgtctgagacttctctgtccaggaaaacagcccagcctgaccagagatgggcatagagccatattttgggaaagactggttgggggtcaacttggtttctggaaccagttctgatttcagttgcaggggacagtgagccagttactgcccactggctgcatcctaagccttcctagaggagagctagcctcctcctagggttgcccaggctggaccacttctgcctgggtgatgggttgggagaaagacgttaatatttggagcagtgttatattagtcagccctcccatttgcaaacattagaaaaccagctcaaattagtgataaaagaaaatctcagctgaattaaatttaaagtagtttaattgagcaatgaatgattcgcgaattgggcagaccccagaatcacagcagattcatagagactccagcgcagccacgtggtggaagaagatttatggacaaaagaagggaaatgatgtacagaaatcagaagtgaagtacagaatggctggattgttacaagttggcgtttgccttatttgagtacagtttgaacactcagcagcgtatgagcggttgaactacggcctctgggattggccaagactcagctattgttacaggcgcatactcctaagttaggttttcaatcttgtctacctattaagctaggttgcaatttgtccacaaggactcaactatagaagtacgaagtcccactcaggccatatttagttcactttaacactagcttcggcaactgtctctcagagcccagggcagggcagggatgcaactgggcttcaggaaacttgaattcattgactgtctcttccccatcttagatgcagtgctaagggctttttagtaattttctcatttgactctcaaaacaaactgatgaggaaacggtctgagagtagttaggcagcttttcaaggtcacacagatagtaaatgtcatcactgggacttgaactcaggtctttctgactctcatgtctgtgcaacatgtcatctcagccactgttgacactgtatatgtggattagggttggctaaactgctgtaacaaatagacccaactcgaatggtgcatgtatgtacaataggggtttatttcttatgatatagttcacggtggtcccaggtgaataaggatgggtaggtctgcatttttcataatcatctggatttctgctcaggctcctagagtctctgccaccttccccatgtggcttccaaggccaccttggagacagagcttggtggagcacatgtggtaggattttttttgtttttttgagacggagtctcactgtattgcccagtctggagtgcagtggtgcaatctcggctcactgcaacctctgcctcccaggttcaagctattctcctgtctcagcctccctagtagctgggactacaggcacctgccaccacgcctggctaatttttgtatttttagtagaaatgggatttcaccttgttggtcaggttggtctcaaactcctgacctcaggtgatccacccacctcggcctcccaaagtgctgggattacaggcatgagccaccactcccagccagttctttttttcttttttccattttttttttttcgagacagggtcttactctgttgcccaggctggagtgcagtggcacaatcacggctcagcgcagccactgcctcctgggctcacacgctcctccggcctcagcctctcgagtacctgggactacaagtgtgagccagtttggctaattttggctaatttttgtagaaacggggtctcgccatgttggccaggctggtctccaactcctgggctcaagggatccaccttcctccccctctcaaagttctgggattaccggagtgacccactgtgccctgctggcaaatttcttaaactgtgcctcagtgacctcatttaataaagggaataattgtagcacactttttctagagctgtgaagattcaatggaataaataaggcaataaatgaatggatggggaatgaaggatgtgggtttcctccctcttgtctttcaataagctctcaccatcaacctcccattgcctgttctctctcttccccctctctccctctgtctctctcttagccaggaaacctggggtagggaggcttggagccagcgggtgcgtcgggaggctgcgggtactgactggggacgcgcacggagattgcgggagaaggatccacgccgcgggagaaggatccatgccgcgggagaaggatcagagtggagcctgtggctgctgcaggaggaggaagccgccgcctggcccacaccacaggagaagggcggagccagatggcaccctgcccaccgcttcccgcccacgcactttagcctgcagaggggcggagcgtgaaaaatacctcgtgcgcctcggccgactctacagtgcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcggcacagcggccctgctaaataaggaacgcctggagccgcggttggcacggccccggggagccgaaaaaccccgggtctggagacagacgtccccacccgggggctctgcggacgccagcgggggcggggcgcggaggccgcgctcagctgggaggacaaacagtcgctaattggagaggaattgggattcggcctggggctgcggggtacccggagagatggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggctttctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggaacccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaaggatgctgccgagaggtggtggcttttggaaaagatggcgtactgcaaaacgtgctgctctgcatggctcgaagcttcgtggggagacgtgggcagagccgtggctgactcacagaccccccaccccagagcctgccctgccctccctgccccgacccttcccctcctgacccatgtgttttttgtttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaataccgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagtgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatacttttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtatatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtcttgatctcttgatctcatgatccacccaccttggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctccgctgtgctccctggtagcctggtagtgagcctgcttctcacacagtcatacctggttgtggtcccacagtgggaccaccctgttgggttcagaacaggagatgggggcccctcgagtctgtgtgggggctgtagacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggcccccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgttctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcaggacggcctctcagccccgcacgagcccgtggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagtgcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcctttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccagctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcggcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcagtgccaccatgctgggtacatgggggacagggctgttccatcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccgcgtgggactctccagcccgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagcgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccacacatacgtctgttcccacacgcatccccccaggggccctcagtgagcattgcctgcctcctgccagggtccagctgggtccagtacaccagaacgcacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgctctcaccaccaaggtgcacttcgaatgcatgggtgagtgcaggcctgcgtagggggagcagcgggatcccccgactctgtgaggtcacggagccctcctgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccaggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctcatcccgctgagcccctccactcctcccccagcccctccatcccctcacccctcccctcctccttcctcccctccctctcctctcccccttctctctccttccctctcctctccccccttttctccacttccctctcctctctcccttctgccctcctccttctctcatgtgaagaggtgccttgtgtggtcagtgggctgcatcacgtgttccccaggtggaggccctgggtcatgcagagccacaaaaaatgcttagtgaggaggctgtgggggtccagtcaagtgggctctccagctgcagggctgggggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatcccccttatccccttcccctccctttcaccctgctcctcttcttctcccctttctcttttctctacccttttccttcctttttcctccctctccccatcatccccctcatcttcgtcctcatccccatccccttccccctccccctccaccactctctctccagcttccctcttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcgtcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctacacagtagcgtagccccacaagttacgtgagcatcgctaccactgtgggagaccatgcatccacccgcgatcctgactgcatagctcgtctctcagacggaggcgccagcaccctccccgtggctgtttcttcaatacctccattttcctttctttggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggtgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggtgtggacaggtgtgcagtgcgggtcactggttgtggtgtggactgaggcgtgtgcagccatgtttgcatgttacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcatgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcggagctgtttcactcgcatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcatgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccagcaggggttgctcccgagtccgtggcaggaaccagaggccacatgtggctgctcgtatttaagttaattaaaatggaacgatggccgggtgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactccagcctgggtgacagagcgagactccatctaaaaaaaaaaaaaatgaaatttaaaactctgttccttagctgcaccagtctgctgtcaaccgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgcttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgatatagataaggacatcatcactcggtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggtttgtgaaggttccagagaggacctggccttgggaggagcgtgggggactgagaagggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctcctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatcgggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttatttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtccggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatgacaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggcctggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagtgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctcccgagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatatttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggttatccgcctgcctcggcctcccaaagtgctgggattacaggagtgagccaccatgccagcctcatgtcattcttgtgtgttgtgtgtgtgtgtgtgtgtgtgtgtgtgacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaactgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggtgtgagccaccacacccaggctttttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcagggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccaaattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgctgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgatttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggcgcctgccaccacccccgcctaattttttgtatttttagtagagacggggtttcactgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcctggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagactttgaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattacctcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgcagtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgcgactacaggcatgtgccaccacgcctgggtaatttttgtatttttagtagagacagggtttagtagagaccatggtgaaaccccgtctctattaaacaaatctctactaaccccatctctacaaaaatcagctgggcgtggtagtgcacacctgtaattctagctacttgggaggctgaggcacgagaatcatttgcatcttggaggcagagtttgcagtgagctgacatcgcaccactgcgctccagccgggatgacagaacaagaccctgtctcaaaaaaaagaaaaaggaacaaacaacagcaacgacaacaaaaaaacctctgtgtcaatcacagccttcaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgcacgcgcgtgtgtgtgtgcacgcgcgtgtgtgtgtgtgtttaatatagagacagggtctcactctgttgcctaggctcgtttcaaactcctgggctccagtgattctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatcttagctccctgtagccttgacctctctgggctcaagtgatttttctctcctctacctcccgagtacttgggaccacaggcgcatgccgccatgcctggctaatgtgtatttttttgtagatacggggtctcactgtgttgcccagggtggtttcaaaatcctgggcccaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcctggcttggtttccccagatgagtgttcatttgggtcttccatcagaaaggcccctcctgacctctgggagtggggagctcaagggtgggaggccttagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcactggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggccaccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgtgttggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaacgggcactgctaccgcctggtggtggagaaggcggcctggctgcaggcgcaggagcagtgtcgggcctgggccggggccgccctggcaatggtggacagtcccgccgtgcagcgcttcctggtctcccgggtcaccaggtgcctgcccccaccccccgaggggccataggttgggagatctctgaagcagtggggcagagcctgtggctggggagtctcaggaggagggaggtgggagctgggccggccctggtgagcaggtggcgccggccggtggggccgttcctgtcagctctgcagatgcagaggtggacacgagctgggggcagcctccggacactcctgggcacgccatacgggaggtggcctgcacggggatccctgccagtgcccacaggcctcgtgggtgggtgctgctgtgagcctgggctggtgggccctgctctccgggctctgagcctcagtttccccatctggaaagggggacagtgacggggctcccagtgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgctgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgcagggacccctgatgcctctggcacggcagtacggcctctcagccccgcatgagcccgtggaggtagtcggccccccacgttctaaaacctgccctcctgcctgcccctggaggcctcgcctgccctgcccactgtgggtctccccaaaaaacttgggggccttaatgttgcttgtgcccagtgaagatggttgggaaaatccagagtgcagagaggaaagcgtttactcacattacccccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccgtgggcgaatgagggccccaacaccctcccctcctcgcagggaccccggagaacggcagcgagcctgagagcaggtccccggacaacaggacccagctggcccccgcgtgcatgccagggggacgctggtgccctggagccaacatctgcttgccgctggacgcctcctgccaccccaggcctgcgccaatggctgcacgtcaggggccagggctactcggggccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgccaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcatgaaatgaatttaaaactctgctccctgacctcacacgagcccccgtgagtctctcacgccctctgctgtgttctcacctggctaaagcgagtggcttttgaggtggagtctgaacccctgatgggaaactgcgggctgcccgcggtgccaccatgctgggtacatgggggacagggctgtctccgtcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctcccatggcatgcagagccccggccacctcctctcctctgtgccccgcgtgggactctccagcctgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggggtggggaggggaggggatggggtggggcggggcgggctccaccttcacctctgcttcatgctgcccgaggacgctgccatggctgtgggtgagtggagggagggacgctaagcagggccaggcctctcacctgccacctgggcccactgatgcctatccctgcagctgacggcctccaaccacgtgagcaacgtcaccgtgaactacaacatcaccgtggagcggatgaacaggatgcagggcctgcgggtctccacagtgccggccgtgctgtcccccaatgccacgctggcactgacggcgggcgtgctggtggactcggccgtggaggtggccttcctgtgagtgactcgggggccggtttggggtgggcaccaggctcttgtcccggccccagcctcagccgagggaccccacatcagggggttgcttttctgagcctcggtttccctatctgttgggaggtactgggtgcacaggagccctgaggctgcacgggagccgggagaggcctcagcacagccgggtgggccctgaatggaggcctggggcgtgactgcagagtggagcctcagctgggtcccaagcaccccctgcccccccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacgcacacctacgctgccccaggtgagggatgagggggtgagggggccactgcctttcaggctctgagcacggggcacccccagtcccccagtcaagctgccccccttcctccccaacagccctcactgtgacctcacctgggctgatggcttaggtccctactggggtgagggaggggccaggcgtggggggagtggacagggaagctgggccccctgaactgccccccgccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccgtgctggcatctaatgccttcgagaaccggacgcagcaggtgcctgtgagcgtgcgcgcctccctgccctccgaggctgtgggtgtgagtgacggcgtcctggtggccggccggcccgtcaccttctacccgcatctgctgccctcgcctgggggtgttctttacacgtgggacttcggggacggctcccctgtcctgacccagagccagccggctgccaaccacacctatccctcgaggggcatctaccacgtgcgcctggaggtcaacaacacggtgagcggtgcggcggcccaggcggatgtgcgcgtctttgaggagctccgcgggctcagcgtggacatgagcctggccgtggagcagggcgcccccgtggtggtcagtgccgcggtgcagacgggcgacaacatcacgtggaccttcgacatgggggacggcaccgtgctgtcgggcccagaggccacagtggagcatgtgtacctgcgggcacagaactgcacagtgaccgtgggtgcggccagccccgccggccacctggcccggagcctgcacgtgctggtcttcgtcctggaggtgctgcgcgtcgagcccgccgcctgcatccccactcagcctgacgcgcggctcacggcctacgtcaccgggaacccggcccgctacctcttcgactggacctttggggatggctcctccaacacgaccatgcgggggtgcccgacggtgacacacaacttcacgcgtagcggcacgttccccctggcgctggtgctgtccagccgcgtgaacagggcgcgttacttcaccagcatctgcgtggagccagaggtgggcaacgtcaccctgcagccagagaggcagtttgtgcagctcggggacgaggcccggctggtggcatgtgcctggcccccgttcccctaccgctacacctgggactttggcaccgaagaagccgtccccgcccgtgtcgggggccctgaggtgacgttcatctaccgagacccaggctcctatcttgtgacagtcaccgcgtccaacaacatctccgctgccaatgactcagccctggtggaggtgcaggagcccgtgctggtcaccagcatcaaggtcaatggctcccttgggctggagctgcagtagccgtacctgttctctgctgtgggccgtgggcgccccgccagctacctgtgggatctgggggacggtgggcggctcgagggtccggaggtcacccacgcttacaacagcacaggtgacttcaccgttagggtggccggctgcaatgaggtgagccgcagcgaggcctggctcaatgtgacggtgaagcggcgcgtgcgggggctcatcgtcaatgccagctgcacggtggtgcccctgaatgggagcatgagcttcagcacctcgctggaggccggcagtgatgtgcgctattcctgggtgctctgtgaccgctgcacgcccatctctgggggtcctgccatctctttacaccttccgctccgtgggcaccttcaatatcatcgtcacagctgagaacgaggtgggctccgcccaggacagcatcttcgtctatgtcctgcagctcatagaggggctgcaggtggtgggcggtggccgctacttccccaccaaccacacggtacagctgcaggccgtggtcagggatggcaccaacatctacagctggactgcctggagggacaggggcccggccctggccggcagcggcaaaggcttctcgctcactgcgctcgaggccggcacctaccatgtgcagctgcgggccaccaacatgctgggcagcgcctgggctgactgcaccgtggacttcgtggagcctgtggggtggctgatggtggccgcctccccgaacccagctgccgtcaacacaagtgtcaccctcagtgccgagctggctggtggcagtggtgtcgtatacacttggtccttggaggaggggctgagctgggagacccccgagccatttaccacccacagcttccccacacccggcctgcacttggtcaccatgacggcagggaacccgctgggctcagccaacgccaccgtggaagtggatgtgcaggtgcctgtgagtggcctcagcatcagggccagcgagccgggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttcaacatccggctcaatgcctccaacgcagtcagctgggtctcagccacgtacaacctcacggtggaggagcccatcgtgggcctggtgctgtgggccagcagcaaggtggtggcgcccgggcagcttgtccattttcagatcctgctggctgccggctcagctgtcaccttccgcctgcaggtcggcggggccagccccgaagtgctccctgggccccgtttctcccacagcttcccccgcatcggagaccacgtggtgagcgtgcagggcaaaaaccacgtgagctgggcccaggcgcaggtgcgcatcgtggtgctggaggccgtgagcgggctgcaggtgcccaactgctgtgagcctggcatcgccatgggcactgagaggaacttcacagcccgcgtgcagcgcggctctcgggtcgcctacgcctggtacttctcgctgcagaaggtccggggcgactctctgttcatcctgtcgggccgcgacgtcacctacacgccgtggccgcggggctgttggagatccaggtgcgtgccttcaacgccctgggcagtgagaaccgcacgctggtgctggaggttcaggacgccgtccagtatgtggccctgcggagcggcccctgcttcaccaaccgcttggcgcagtttgaggccgccaccagccccagcccccggcgcgtggcctaccactgggactttggggatgggtccccagggcaggacacagataagcccagggccgagcactcctacctgaggcctggggactaccgcgtgcaggtgaacgcctccaacctggtgagctttttcgtggcgcaggccacggtgaccgtccaggtgctggcctgccgggagccggaggtggacgtggtcctgcccctgcaggtgctgatgcgacgatcacagcgcaactgcctggatgcctacgttgacctgcgcgactgtgtcacctaccagactgagtaccgctgggaggtgtaccgcaccgccagctgccagcggccggggtgcccggcgcgtgtggccctgcccggcgtggacgtgagccggcctcagctggtgctgccgcggctggcgctgcctgtggggcactactgctttgtgtttgtcgtgtcatttggggacacgccactggcacggagcatccaggccaatgtgacggtggcccccgagcgcctggtgcccatcactgagggtggctcctaccgcgtgtggtcagacacacaggacctggtgctggatgggagcgagtcctacgaccccaacctggaggacggcgaccagacgccgctcagtttccagtgggcctgtgtggcttcgacacaggtcagtgcgtggcagggccgtcctccctgcccctcacccgtccacacccatgagcccagagaacacccagcttgccaccagggctggcccgtcctcagtgcctggtgggccccgtcccagcatggggagggggtctcccgcgctgtctcctgggccgggctctgctttaaaactggatggggttctcgggccacgtcgccccttgttctcggcctgcagagggaggctggcgggtgtgcgctgaactttgggccccgcgggagcagcacggtcaccattccacgggaacggctggcagctggcgtggagtacaccttcagcctcaccgtgtggaaggccggccacaaggaggaggccaccaaccagacggtgggtgccgcccgcccctcggccacttgccttggacagcccagcctccctgctcatctactgttttccgtgttttagtgctggtggaggccgcgcgctctcccctctctgtttctgatgcaaattctatgtaacacgacagcctgcttcagctttgcttccttccaaacctgccacagttccacatacagtcttcaagccacatatgctctagtgacaaaagctacacagtcccccagcaataccaacagtgaggaagagccccttcccaccccagaggcagccactgtccccagcccatgtccctgttgctggatgtggtgggccggttctcaccctcatgctccccactctggaccggccaggaggcttggtgaccctgagcccgtggtggctgctcctgctgctgtcaggcggggcctgctggtgccccagagtgggtgtctgttccccagtccctgctttcctcaacgggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgccagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgccctcaccaccaaggtgcacttcaaatgcacgggtgagtgcaggcctgcgtagggggagcagcgggatcccccgactctgtgaggtcacggagccctcccgtgatgctgtggggaccatccctcaggctggcatgacgcggaggatgctggcgccccgctggtgtatgccctgctgctgcagcgctgttgccagggccactgcaaagagttctgtgtctacaagagcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcaccggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctcaccccgccccgcatgcctgccagggtactgggttcagccccccagggcagacgggcagcttggccgaggagctgagcctccagcctgggctccttcctgccgtggcgttcctcggtctctgacctgcttcagtagcctcagcctttctgctgtcctgtgtgaacgcagggtgcctctcgggggacccagggtgtaaagaggggcccagatgtggggagggactaagaagatgctgctctgtgccctccactctcccctcccctcccccttccctcccctttctccatctctctccccttttctccatttcccccccgatcctccccgtccttttgtccattcccctcatctttcttatcccccttatcctccttcccctcccttatcctccttcccctcccttatcccccttatcccccttcccctccctttccccctgctcctcctcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagcccccaccctccagctccccctttttgcctgcccccaccctccctctgcctccctgtctctgcactgacctcacgcctgtctgcaggagacctcatccacctggccagctcagacgtgcgggcaccgcagcgctcagagctgggagccgagtcaccattgcggatggtggcgtcccaggcctacaacctgacctctgccctcatgcgcatcctcacgcgctcccgcgtgctcaacgaggagcccgtgacgctggcgggcgaggagatcatggcccagggcaagcgctcggacccgcggagcctgctgtgctatggcggcgccccagggcctggctgccacctctccatcccctaggctttcagcagggccccggccaacctcagtgacgtggtgcagctcgtctttctggtggactccaatccctttctctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccactgcagctccgccaactccgttgtggtccagccccaggcctccgtcggtgctgtggtcaccctggacagcagcaaccctgtggccgtgctgcatctgcagctcaactatacgctgctggacggtgtgtgcagcgggtggggcacacgcggccccctggccttgttcttggggggaaggcgtttctcgtagggcttccatgggtgtctctggtgaaatttgctgtttcatgggctgttgggggcctggccggagaggagctgggggccacggagaagcaggtgccagctctggtgcagaggctcctatggcctttcaggcccgtggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgtgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggatgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcccggcggctgtgtcttcacaggagccgacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcagacggaggtgccagcaccctccccgtggctgtttcttcaatacctccattttcctttattggaattgcccttctggcattccctttttgttttcatttttctttttttggagacggagtctcactctgttgcccaggctggagtgcaatggcgtgatcttggctcacagcaacttccagctcctgggtttaagcgattccccttaagcgattctcctgagtagctgggagtacaggtgcacgccaccacacccagttaatttttcaccatgtcagccaggcgaactcctgacctcaggtgatccgcctgcctcggcctgccagagtgctgggatgacaggtgtgagccaccacacctggctgtgttcccattttttatttccgtgttgctttcatcttcatttcccagttcttttgattacctacttttaaaaactgtcggccgggcgcggtggctcacacctgtaatccgagcactttgggaggccgaggcaggcaaatcacggggtcaggagaccgagaccatcctggctaacggtgaaaccctgtctctactaaaaaatacaaaaaaattagcccggcgtggtggcaggcacctgtagtcccagctcctcgggagactgaggcaggagaatggcgtgagcccgggaggcggagcttgcagtgagctgagattgcgccactgcactccagcctgggtgacacagcaagactccatctcaaaaaaaaaaagaaaaaaaatactgtcacctgggtctgtcactgggagaggaggtgacacagcttcacgcttcgcagtctgtgcatgaactgagggacgggtgtgtggtgcgggtcactggttgtggcgtgactgaggcgtggacaggtgtgcagcgcgggtcactggttgtggtgtggactgaggcgtgtgcagccatgtttgcatgtcacaagttacagttctttccgtgtaacttaatcatgtccttgaggtcctgctgtttattggacaaattgcagtaaccgcagctcctcgtgtatggcagagccgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagtggccaccggcacctggacggcgacagagccttccaccgcaacagtctggacatcttccggatcgccaccccgcacagcctgggtagcgtgtggaagatccgagtgtggcacgacaacaaaggtctgtgcggaccctgccaagctctgcccctctgcccccgcattggggcgccctgcgagcctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggctgcgagtaaggcctcgttccatgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccacctcgtagctgtttcactcgcatccagagggccacctgctgcgttctcctcatctgcctcttcctgggcgccaacgccgtgtggtacggggctgttggtgactctgcctacaggtgggtgccgtaggggtcgggacagcctcttcctgcccagcccttcctgcccctcagcctcacctgtgtggcctcctctcctccacacagcacggggcatgtgtccaggctgagcccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacttagctgggcatggtggcgggcgcctgtagtcccagctactcgagaggctgaggcaggagaatggcatgaacccaggaggcggagcttgcagtgagccgagattgcgccactgcactccatcctgggcaatggagcaagactccatctccaaaaaaaagaaaaaaaaaatcccacaaagaaaagcttgggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactcaggaggctgagccaggacaatcgcctgaacgcgggaggtggaggttgcagtgagctgagattgcgccagtgcactcctgcctgggtgacagagcgagactccatcttaaaaaaaaaaaaaaaatgaaattcaaaactctgttccttagctgcaccagtctgctgtcaagtgttcagtggcacatgtcgcgaggggctgccatcacggacggtgcagatgtcccatatatccagcattctaggacattctgttagatggcaccgggctctgtcctgtctgctgaggaggtggcttctcatccctgtcctgagcaggtctgagctgccgcccgctgaccactgccgtcgtcctgcaggtggctgggagcctgagccccacacctgccgggcagtaggtgctggacatcgacagctgcctggactcgtccgtgctggacagctccttcctcacgttctcaggcctccacgctgaggtgagggctctactgggggtcctgggctgggctgggggtcctgccgccttggcgcagcttggactccagacactgtgcacctctcagcaggcctttgctggacaggtgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacgtgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacaacccccacttactgggtctctccttttacaaccaacacaaccgaaatctagggcttctttttttttttttttttttttgagacagagtctcattccattctgtcacccaggctggagtgcaatggtacgatctcggctcactgcaacctccgcctcccgggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacaggcgtgagccaccatgcccagccaaatctagggctggaacatggctgcagcatataaatagaattgaattccatagttttgttaatcctgttttttgtttgtttgtagttgttgctgtttttgagacagagtctcgctctgtcgtctaggctggagtgcagtggtgtaatctcggctcactgcagactctgcctcccgggttcaaactgttctcctgcctcagcctcccaagtaggtgggactacaggtgcccaccaccacacccggctaatttttgtattttattagagacagggtttcaccatattggccaggctggtctggaactcctgaccttgtgatctgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagagagtttgggcacactctgtgtgatcgggcagaaggcctgtgggaagtttagctgaggacagggccaggaaaggtgatggacagtgggggtctgtcctggtcaccaggcccctgggtcctgcccgcctgcttggagctccccacccatcacacatgatgcggccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgacatagataaggacatcatcactcagtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtacaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaagtcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccctcccctccccctcccctccccctccccaactcagatccggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggcgctgttgcactcttgtctccaacagacaaaacggaccaaaacaaagtgaaatgtcatttgatttgtgtcatctggtttgatgacttttttttgtttgtttgttttttagacagagtctcactctgttgcccaggctggagtgcagtggcaagatctcggctcactgcaacctccgcttccggggttcaagcaattgtcctgcctcagcctcctgagtagctcagattaccacgcctggctaatgtttgtatttttagtagaccaccacgcctggctactttttgtatttttagtagagactgggtttcaccatgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaatttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtatttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccacagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattacttccttttcaagttgtgaaacatgttaacctgtggtaaaatacttacaagatgataattaccatctaaccgtgttgaagtgtacagttcagttgtgtgaagtatattcatgtcatttttttttttttttttttttgagacagagtctcactctgtcaccaggctggagtgcagtggtgggatcttggctcactgcaccctctgcctcctgggttcaagcagttctcctgcctcagcctcccgagtagctgggactacaggcgtgggccaccatgctcagctaatttttgtatttttagtagagacggggtttcaccatgttgcccaggatgatctccatctcttgaccttgtgattcacccgcctcggcctcccaaagtgctgggattacaggcgtgagctacagcacctggcctatttttttttttttttttgagacagagtttgaattttgttgcccaggttggagtgcaatggcacaatctcagctcaccacaaccttttcctgctggattcaagtgattctcctgcctcagcctcgcgactagctgggattacaggcatgcaccaccatgcctggctaattttgaatttttagcagagacagcgtttctccatgttggtgaggctggtctcaaactcccgacctcaggtgatccgcctgcctcggcctcccaaagtactgggattacaggagtgagccaccctgccagcctcatgtcattctttgtgtgtgtgtgtgtgtgtgtgtgtgtgtgtgtgtgacagagtctcattctgtcgctcaggctggagtgcagtggtgtgatctcggctcactgcaaactccgcctcccagcttcaaacggttctctgcctcagcctcccgagtagctcggattacaggcgcccactgccatgcccggctaatttttgtatttttagtagagacggggtttcaccatcttggccaggctggtcttgaactcctgaccccgtgatccacctgcctcggcctcccaaagtactgggattatacgcatgagccaccgtgcccagccgtcattcttatattattatttcctaggtgtctttcctgaagactatcttcccatctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaagtccatttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttcgacaatatttgtggcaaattcagtgggttcaaaattgagtttgtcctttctgcttcattagtttaagctgtataattcctttcccttcctacattcttgtttgtcattttttcaggggaagaggagttgctagtactgcattggttttcctttctctctcttttttttttttttttttcctgagatggggctttgctcttgttgcccaggctgcagttcaatggcacaatctcaactcactgccttttgggttcaagcaattctcctgcctcagcctcccaagtagctgggattacaggtgcccaccaccatgcccagctaatttttgtatttttactagatatggggtttcaccatgttgtccaggctgatctcgaacttctgacctcaggtaatccacccgcctcagcctcccaaagtgctgggattagaggcgtgagccaccacacccagcacccagcctttttttttttttttttaattttgagatagagtctcgctctgtcgcccaggctggagtgctgtggtgcaatcttggctcactgcaacctctgcctcccagtttgaagcaattctgcctcagcttcccgagtagcttggattacaggtgtgtgccgccacattcggccaattttttttttttttttttttttttttgagacggagtctcactctgtcacccaggctagagtgcggtggcatgatcttggctcactgcaacttccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacacctcggcctcccagtgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatggtttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacactccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaattgaaccttgttaaagtcagtcaacaccagggtggatggtttgccgttgtcacctattttcaggacataacaccctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgattttttttatccctcaatgggaggtgtccattctcccttcagttgtgagaatcagttggttcatttgtgggaaggttgcaggggggatctttgaatcacagccttcagatgccagaagggcagagggaatcccacacgggctggtggatcatgtgtgtgcatttctctcccttctagtctgaggaaactaagcatgaaagaacgtgagcacagagaagaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttaagagacagggtctttctctgtcgcccaggctggactgcagaggcacaatcatagctcacggcagccttgaactcctgggctcaagcgatcctcccacttcagcgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagtcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgctgtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgggactacaggcatgtgccaccacgcctgggtaatttttgtatttttagtagagacagggtttagtagagaccatggtgaaaccccgtctctattaaacaaatctctactaaccccatctctacaaaaaacagctgggcgtggtagtgcacacctgtaattctagctacttgggaggctgaggcacgagaatcatttgcatcttggaggcagagtttgcagtgagctgacatcgcaccactgcgctccagccgggatgacagagcaagaccctgtctcaaaaaaaagaaaaaggaacaaacaacagcaacgacaacaaaaaaacctctgtgtcaatcacagcctacaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgtgtgcacgcgtgtgtgtgtgtgtgtttaatatagagacagggtttcactctgttgcctaggctcgtttcaaactcctgggctccagtgatcctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgctcctggccaattttttaaggcaacgttttcagcccatggccagggtaaggcacagctagtaccaagatctggcttcactggccatgttatccaagaggcctctgcctgcctgcaaagtagtactgcacactgggatctccctggaccaaaccccagcttcagttttgggtacttcctcataagccttgactaccccagagtgtgagggattttgcagcctggtcccaggcatgcactcaccagtcaatggcatcgcggggctggccatggcctcccaagccacaaaagcaaccatatttcacataggcgatgggagttcagggaccaacacaacccacaattcctgccagttccaggatcccacgccggtgcacacataatatcctggaggctggggggtaaacaaaggtgacaggctgcaggtcagggcttcccagacccctgggaagggcatgagcctgagaggagcctaggtgttacagcctggctgtctgggtttgaatcctacttcctggctgtgtgaccttggacaaattcctaacctctctgggccttggtttcctcatctgtgaaatgggggataagctgacttcaactcatatgaatgaaatgagataatgagtataaagcccctggtgcatgaaaaggctattataatccggctgggctcagtggcttacacctgtaatcccaagattttgggaggcccaggcgggcagatcacctgaggtcagcagttcaagatcagcctggccaacatggtgaaaccccatctgtagtaaaaatacaaaaattagccgagcatagtggtgcacgcctgtaatcccagctactagggaggctgaggaaggagagtcacttgaacctgagaggcgaagattgcagtgagccaagattttgccactgcattccaacctgggcgacagagcaagagtctcaaaaaaagaaaaaaaaaaaaaggctaactattataatcaaggtcctcaaggtagccaaggagggaaaagagtcgtgcatgaaacctttgtccagttccctgtgttgggcactcggcatcatatgagcctacaggtgtctgtcaccaaggtgggctcctctgtggcagctcccaggccctggcactgccctgtgctcatgacttttcctccagactcaggctcagggcccttggtatctcctcttattttcactgccagataggaaggccccttggactgagcccagccatttatctagatcctggcacagcttggacatgtaatggtgcccaatgcatgtgactggaacccctgcattggacatgtaggaaacgaggccagccgggaaaggtaaccccacattcccacagccagcaggaactcaagcagaggcttcaacccaggcttctgacttgcaaaccagtgctccttcctccttacacagtaacaacaggggaaggtggccttccaggttgccagagccgagtggtaccagcaatagagtggaaactcacacacaggcttgcctgcttcctggtttaggtttagggtttatacggctccgggaggttgatgcattgtgtttgatcatccccttttttttttttttgagacagagtctcattcctgttgcccaggctggagcacagtggtgtcatcttgctcacaacagctccgggaggttgacgcattgtgtttgatcatcccttttttttttttttttttttttttgtttgagacagagtctcattcctgttgcccaggctggagcacagtggtgtcatcttgctcacagcaacttctgcctcccaggttcaagcaattgtccagcctcagtctcccgagtagctgggatcacaggcgtgccccaccacacccagctgatttttttatttctagtagaaacggggtttcaccatctaggctgggccggtctcaaactcctgacctcatgtgatccacctgctttggcctcccaaagtgctgggattataggcgtgagccactgcgctcatcctgatcatcttgtctctctttttttaaatagagacagggtctcactctgtcacccacactggagtgcagtggcacaatcatagctcactgcagcctccaaatcctgggctcaagcgatcctcctgcctcagcctccagatcctgggctcaagcgatcctcctgcctcagcctccagacatacgggcatgcaccaccatgcccagctaatttttaaatttttagtagatctgcggtctcactatgttgcccaggctggtcacaaactcctggcctcaagtgattctccttccttggcctcccaaggtgctgggattccaggcatgagccaccatgcccagtctcatttctgttttatctagaacatgttttcatcacactgacttttttgagaagtccaggccaattttaaattccattttgtctttttatcagtggaaaagtagcatatttatgttgcacgacaaagatgaatcaaataggaagaaaatgtaaaacacatttggggccgggcacagtggctcatgcctgtaatcccagcactttgggaggccaaggcgggtggatcacctgaagccaggagttccagaccagcctgaccaacacggagaaaccctgtttctactaaaaatataaaattagccacgcatggtggcacatgcctgtaatcccagctacttgggagggtgaggcaggagaatcgcttgaacccgggaggcagaggttgcagtgagccgagctcgtgctatcacactccagcctgggcaataagagtgaaactccgtctcaaaaaaaaaaaaaacacacgaaaataaaacggcatttagagttgaaagcttcaccttcctctctggatggtgagtcctcactctcccagcagcccacacctctgcctcaaacctccatggctcccatgagtctggttaaagctaaggagtctcactgcacctcaagtcctgggggtagtcagcccctctcacccctccctcatcctctcacacaagagtcatttactgtccctccagttatgcccggtcacgcagacactctgctgctcaaatgccctcaccccatcctcagcctgctcccaggccacctccctccagaatccaccctgcctgccaggtggtcatagggaccctcgccatactgtctgcttgtggcagtgccctccagcctggggggtcttccagagcagatctctggccaagcgcagtggctcatgactgtaatctcagcaccttcagaggccaaggcaggtggatcacctgaggtcaggagatcgagaccagccttgctcacatggtgaaaccccgtctctactaaaaatacaaaaattagccaggtgtggtggtggtgcatgcctgtagtcccagctactcaggaggctgaggcaggagaatctcttggacccgggaggtggaggttgcagtgagccaaaatggtgccactgcactccagcctgggcaacagtgagactctgtcttaaaaaaaaaaaagaaaaagaaaaagagcggagctctgatataagctgccctggcacacagtgagcttccagaaatggtcccttgacctctaaatccaccaagacccagggaacatgccctctctgagcactctgacaatgatttgcatttctctaatgaccagtgatgatgagcttttcttcacatgtttgttggccacataaatgtcttcttttgagaagtgtctgttcatatcctccggccacttttggatggggttgtttttttcttataaatatgtttaagttccttgtggattctggatattagcccgatggatagattgcaaaacttttctcccattctgtaagttgcctgttcactctgatgatagtttgttttgctgtgcagaagctctttagtttaattagatcccatttgtcaattttggcttttgttgccattgcttttggtgtttcagtcatgaagcctttgcccatgcctatgtcctgaatggtattgcctaggttttcttcttgggtttttatggttttaggtctaacatttaagactttaatcaatcttgagttaatttttgtatcaggtgtaaggaaggggcccagtttcagttttctgcatatggctagccagttttcccaacaccattttaaatagggaatcctttcccattcttgttttttattacaactttttacctaaacattcaataattttcactaactttttggcaatgaggcagctgagtctaagtaggttaaatcacttatctgaggtcacacggcaggacagtgcttgttctgcaaagttaagtgtgtttctttttgtggaccatgagaacatctccaactgccctttttgacttggccaccagggaactcagcgccatgttctcaaatccagtttagtaactggccttctggcctgtatatctttattctaccttccatcctgctctgttctgcttttacctcttattctagattatctttctttagtcctaattttaaatttatatctataatcttgttatatatatttcttggcatctactgtaagtgggtagtgaacgaataaacaaaatgtgatgaattttagaggactaagaggggcctaagtcacaccaagattcatgctggataatttgtcatcgacccagactgtggttctgcactcgccagtaaccagtttttttttttttttttttttgctttttgccaaccatacattttgctttcatggtatcgaagtggtttaagcttatggcttccagcctgcagtggctatgaggggtcagtctctcatcaggaggggttggcagactctgttctcagataggcagcaaggatggaggtggggcaggagcaatttcactacctgcctggcgtctgggtcttgcttagagaaataattccaggctctgctgctttcgactctgtctctcatggttccactgattcctgcagagatctagagagaaaatttccagcgaggagtttctggctcgtttgattttgaacacgttttgagtattccaccccttacccccccgcccccactcactactctgtagtttttttttttttaagaaaacagtttgaaagcacaaataaataaataattcaaaacagaggggccatttttatttactttggttgtttcaggagagggaagggagcttacactttttttgaactcttattctatgccagccgatgtgctgcattcttagcttaaaagcctgcttctctttgatttcagaataacttggaaataaatgatcagaccctgcatgctctgatcctggctgtctgctctaactaaatctcctcttccttgcttcctccagcgagttgttctcccttcacctcccagcacaagctttgcacgtgttgccgtctgtcctacaaaggtctgtcccttcccagtctccgtgtgactccctccttcacacccatggttctccactgaaatgtcctttgagcacgtctcagatgcctcagtctaaagtagatgattctgggctgggtgcagtggctcacgcctgtaatcccagcactttgggaggctgaggcaggcagatcacctgacatcaggagttcaagaccagcctggccaacatagtaaaaccccgtgtctactaaaaatacaaaaataagccaggcatggtggcgggtgcctgtaatcccagctacttgggaggctgaggcaggagaatcgcttgaacctgggaggtggaggttgcagtgagctgagatcacgccactgcactccagcctgggtgacagagcaaaactctgtctcaaaataaataaataaataaataaataaagtagatgattcacagaaacctctgttcttttagagcactcttcaacactttttatgctttttatgtttgatttctaataaatatgtttctttcactataccataagtatattccttcttctaagtttcattaaggtagaatcacgtatgtcttatttcctgttatatccctaagtacctagcatgtagtaggcattcaataaaaattgattgaatgattgaacactcaatcccatgatttgagtgttttttttgtttttgtttgtttgtttgttttgagacaaagtcttgctctatcacccaggctggagtgcagtggtactatcttggctcactgcaatctctgcatcctgggttcaagtgattttcttgcctcagcctctcaagaagctgagactaactacaggcatgtgccaccatgcccagtgatttgttttgcatgtgtgtgtatttttagcagagatggggtttcactgtgttggccatgctggtcttaaactcctgacctcaggccatccaccctccttggcctctgaaagtgttgggattacaggtgtgagccaccacgcctggccttttgtaattattctaacagctactacttattaggtgctgactatatgccaggcactgtgccaattgatttatttattttcagggattgggtcttgttctgtcaccatggctggagttcagtggcacaatcatagctcgctgaagcttcaaactcctggggtcaagcagtccccctgcttcagcttcccaagtagctgggattacagagatataccattacactcagctaattttaaaaaatggctaattttttttttcagagatggaaaaaaaacaaaaaacaaaaaacagctactacttattaggtgctgactgtatgccaggcactgtgctgatttttttttaatgttttttatttttttagagttggggtctagttctgtcaccatggctggagttcagtggcatgatcatagctcactacagctttgaactcctgggcttaagcaatcttcctgtctcagcttcccaagtagctgggattacaggcatgggctatcacacccagctaattaaaaagacattttattgtatagataggggtctggctgtgttgcccaggttagtctcaaactcctggcttcaagcgattctcctgcctccacctcccaatgtgctggtgttacaggtgtgagccatggcacctggccctgtgttgatgttttacatacagcatctcatttaatccccaccaggatcctgtggggatggattggattatcccccactccttggaagagcttaaggatacccaaccagttggtgattgagctgggatttgaactcaggcattctaatggcaaagctgtgccccttccactctaccatcgtgttcctctccaggggaggtgtccctgcagtgctgtgactttgtcgtcgaacatgtgctgaggtacgtgaatcctctggagaagaagggcaaaggaacaggctttccaggcaggaagcccctgcaggcgagggaggaaggctgcaagggacatggtaggaggtatcttgctccccatagctgggctgggaggatgagatggctgagagccaggagccgggctggggttaggctcatatcagcctgcagagggctttggggaacccaggctttggggccagacaaacatagcttctcacccacctgatcatttcctctctgttgtatcctatgtttctgggtctcagtttccttatctatgaaatggggataccatgacctgttctgcctgcttcatagagtgctaaggagcagatgacataacgtgtgcaaaagcagctgttcttatttctatcacttattttcattatcgctattctcaagcaggcagacggtaattttttacctctttcttttttttcacccttgagttgtttggaagttatttttaaaagtctttgaagtgtccttttccatatttggcaaaagcaaaatggaaattgatagcattgtcaccgtcggcatcccctcactccggccgcctggctgggggacagctctgggaaaatgtggagatgtctgttgtgggcgactggtttgttattgcgtgaacttttctggcgagacctgaccagctcccttttaaggcaattcctcgtgttcttgttcctcctcttttcttttcctgccaatgtcaggtcctttgtgccatctccaggctcagaaatccgtacagccagagtcggtccccagtttggccacttccagctgaaaagctttcccatgccttccctttaacttagaatagcatccaaatccttcattgtgaccaaggccctgtgcagtctgctcctgtcactttcctctccattactcagctccaaaagtgtcacctcccttgactcctccaatgccccacatggtttccagccccagggtctttgtggggtctttgccaggaatcctgttccccgtttttttgttatgggtagctctttctcatctttgacatctctgctccagagtcaacttcacacatggctcttccctaacccacactaaaaaataagcctccttaaagaaaaaaaagaggctggacgtggtggctcatgcctgtaattccagtgctttgggagactgaggtaggaggatcacttgagaccgggagtttgagatcagcctgggcaacacattgagaccccatctctacaaaaaaaaaaaaaaaaaaaaaaaaaatagcgaggcgtggtgctgtatacccatagttctagctactctggtggctgaggcaagaggattgcttgagcccaggagttcaaggctgcagtgagccgtgattgcaccactgaacaccagacgcagtgtcatgtacttgtagtcccggctgcttgggaggctgaggtgggaccatctcttaagcctgggagtttgaggctacagtgagccctgatcatccctgtgaatagccattgcactgcagcctgagttacacagatacgtctcttaaaaaataaatgaaaagaaaagccttttaaattcagtgtcttcgcatagttagtccaaccttaaggagtgttaccagatacaaacaggatgcccagttacatttttttttttttttttttttttgagacagagtctcactctatcccccaggctggagtgcagtggcatgatcttggctcactgcaacctctgcctcccaggttcaagtgatgctgatgcctcagcctcccgagtagctggaattacagacgtgcaccaccaggcctggctaatgtttgtatttttagtagagatgggtttttgccctgttggccaggttggtctcgaactcctgatctcaggtgatctgcccaccttggcctcccaaagtgctggggtgacaggcgtgagccaccatgcctggcaaaactttgtagcccagtttgttctatttttttttttttttttttgagacagagtctcgctctgtcgcccaggctgtagtgcagtggcatgatcttggctcactgcaatttctgcctcccgggttcaagtgatttccctgcctcagccttccaagtagctgggaatataagggcgtgccattgcacccaaatttgaaccttagataaacattgaataattttccagtattacatcagatacataacttgtatttaaaaaatcattccttatttcactggatttaaaattgaattgggtgtcgtatatttttacttgttaagtctggcaaccctaccctctagagagaggtgttgaatgaatgagtgtgaagtccttagcttagggcctggcactcagtaggtgctaagtaaatgtcacctgtcagcatcttcctcctcctcttcttcctcctctagttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagtgagttatcacagagcgttccctccagcactgggtcatgcaaatatttattgcgagcgttaaataataaatggagcagcctgcccaatggtaaatctgtcatgtttggtttcagccaggagttgtgatggctctggaatcgctgcccgtttcaccgcatccacctgccctctagaggagcaaggcaaacagccgagttctctggggtggcatcagtgggctggtgtggaagccagaggggcggtggggggagtcagccaggcatggaaactggcaggtaaggcagccctgtggcccaggaacctgagccgcagccacaccgagcaggcctggacctttgagtcccgctgccaccacagttctcaggggacacggtctcattgtccacatctggatttatctttccgtatttccctcattgctcttgtcagcttcactctggctgactggctggagctggcaagcttctgaaagtggagtcaaccttccgaccctttttctaggctgagtggtgggtggaggaatgagaccgtgtgttggactcaaactcgatgcaataacgtttcccagcccctgtggtgtgctggggctcctagcacacatcctcttgtttaacctcagcattgcaacctgaaacacagacacatgggttcttgagccagatgcctctgagttggaatcctatctctgcacttaacaagcggtatgaccttgagtgagccacagtttttcagagcccctgtttcctgatctgtaaggtgggggagatggtggcactcaccttatggggctgttatgtattagtccattgaggtgtcttagcctgttttgcgttgccataaaggaatacttgagggtgagtaatttataagaaaagaggtttgtttagctcacgttctgcagactgtacaagaagcatgatgccagcatctgcttctggtgagacctcaggaagcttttcttcactgtggaggatgaaaggggagcaggtgtgtcacatggtgagaagaggggtgagagagagacaggaagggtgccaaacacttttttaacaatcagacctcgccgtgaactaaaagagtgagaactcactcattactcagggagggcaccaagctattcatgagggatctgctcccaccacccaaatacctctcgccaagccccgcctccaacattggggatcacatttcaacatgaggtttggaggggacacacatccaaactatcttatgaggtagtaggataatgtaggtgaagacttgcacagtgcccgggacctggggacaaatgctagctctaatggttaataatggtccagagaagaaaataactgctcagatgcacagacatgactgcactagtcaaccatgcaggtatgagtccccatcctagagtatggggtgcatagagctctagcccaccattattgagttgtagaactaaggctccaatctggggctttatggatccctaaatcatgccctttcaccttccccatatctgctttattcctcatagggtggcagggagggtggagctcatgcctggccttaatcatcatggcctaagtttggtagtgtccaaacagtggtgaggggtgaagttgtagggttgccaggtaggttgtgtttggcttcaaatcactgagaacccaactggaagtggtgtagatgctaatggaagttattgtttctctgcagggggccatgtggttaattgattcagtggctccattgtggaatggtgggccttgtttccttccacttttccactattccattcttagcagctggctcttgccctcagccacaccccatcatggtctcaagataatatggacaagagagaagagagccttcttccacttgttccccgcttgtttttgagacagggtctcgctctgtcacccagactggagtgtagtggtgcaatcatagctcgctgcagccttgaacttctaggctcaagtgatcctccttcagtttcctgagtagctgggactataggtgcatgctaccatacccagctaacttcagagttttttctagagatgaggtctccctctgttgcccaggctggtctcgaactctgggcctcaagtgatcctcttgcctcaacctcccaaagcactagggttacagatgtgagccaccacgcccagcccatctgtccctttttatgatcattttctcattttctcagaagctgccagctgacttctccttcatcgcattggtcagaaatgtatcacgtgcccttttctaagccagttgctggcaagggaatggaattcccaaggttgccttagaccagtgcttcttaaagtgagatccccaggccagcagcatctgccatgtctaggcaattttaagaactgcaaattctcagaccccagttcagacctactaaatcagaaactctgggggtgggatctatgtttttatttatttatttactagaatcggggtctctgttgcccaggcaggagtacagtgacactatcatagcgcattgcagcctccaactcctgggctcgagcgatcctcctgcctcagcctcccatgtagccaggactagaggtgtgcacccccacacccagctaatttttttattttttgtagagacagggtcttgctatgttgtccagtctggtctcaaactcttggcttaaacaatgctctggtctcaaactctcagcctcccaaagtgttagaattacaggcgtgagccactgcgcccggcccatagtctatgtttaaacgtgccctccgggggtttctgatggacactgagtttgagaacctctggtttcctaagatcttttcctctgaagagccagagaataaatatttcaggcttgtggccacacagtttctgtagcaaccactctgttctgctgttgcagtgtgaaagcagctatagatgataataaataagtgaatgggtttatttatggagactgagatttgaatttcacctaatttttatgtgttaggagatattattacacttttgatcttttctaactacttaaaaatgtaaaagccatttccagctcctgagccgtacaaaagcaggtggtgggccgggtttaggcaatggtttgccagccctccatcagactgctcaagattcatcccctgaaactggggagagtctaatagtcttaaaacacagagagccccagattctttagaaaattggaatttgggctgggtgtggtggctcacatctgtaatcccagcactttgggaggctgaggtgggaggatggcttgagcccaggaatttgaggccagcctgggcaacataatgagaccccatctttacaaaaaataaaaataatagtcggacgtggtggcatgtacctgtagtcccagctactcaggaggctgaggcaggaggatctcttgagcccaggagtttgaggctgcagtgagctatgatcacgccactgattgcagcctgggtgacagagcaagacactgtctctgtctaaaaaaaaaaaatgaaatttgggccaggcgcggtggctcatgtctctaatcccagcactttgggaggccaaagtgggtggatcacctgaagtcaggagttcaagaccagcctggccaacatggtgaaaccccatctctactaaaaatgcaaaaattagctgggcgtggtgacacgtgcctgtactcccagctactcgagaggctgaggcaggagaattgcttgaacctgggaggtggaggttgcagtgagccaagattgcaccattgcactccagcctgggtgacagagcgagaccctgtttcaaaaaaaaaaaaaaaacaaaaagggctgggcgtggtggctcacgcctgtaatcccagcgctttgggaggccgaggcgggcggatcacaaggtcaggagtttgagaccagcctggccaatatggtgaaaccctgtctctactaaaaatacaaaaattagccgggcgtggtggcaggcgcctgtactcccagctacttgggatgctgaggcaggagaattgcttgaacctgggaggcggaggttgcagtgagccgagagtgcaccactgtactccagcctgagtgacagagcgagactccgtcaaaaaaaaaaaaatactgataatgacagtgctaacagcaataatagatagctaacaagtgtggagtgcttatccatcttctagtccccaccttcctttagcccaggagttcgaggctgcagtgagctatgattgtggcactgtactctagcctgggcaacagagcaaggtcctgtctctaaaaaaataaaagcataaaaataaaataaccaaactttttattaaccttctacccccagagggccccctccctcaaatagctcattaactagacctggtttgcatgcccaccccctctagggactgagcccaacttctgagatagggacccttgaaagaactggggttctgttagcaagaagaattaagacaagaggatgacttttggtgttgacagtgtctgcccctgttttttgtttgtttttttgagatggtgtctcgctctgtcacccaggctggagtgcagtggcgtgatctcagctcactgcaacctctgcctcctgagttcaagcgattctcctgcctcagcctcccgggtagctgggattacaggcgtgtggcaccacacctggctgatttttgtatttttagtagagacaggatttcaccatgttggccaggctggtctcgaactcctgacctcaggtgatccacccgccttggcctcctaaagtgctgggattacacgtgtgagccaccgtgcccagcctgccacagttctttacacatttgatctttagctcacccaacaaccttgtaaaaatatgattgctacccataattttcaaataatctacgtatgcgtaagagagagaagtgattccccaaagatcacgcagctaataaagtggaagggagaacccaggcccacctggctccgaagctcacactctttccactaagctgcctgcttctttcattggaatagaggttctcaatcgtgaatggtaggagtggggtgcggtgaattttgaccctcgggtgaaatttgaaaatgcttggagacatttttggttgtcataattgggagaaagggtgtgatattggaatctagtggatagaggccatggatgctgctaaagtttttatagtgggccgggcgtggtggctcatgcccataatcccaatattttgggaggccgaggtgggtggatcacctgaggtcaggagttcgagacgaccctggccaacacggtgaaaccgcgtttctactaaaaatacaaaaattagccaggcgtggtggttggtgcctgtaatctcagctacccgggaggctgaggcaggagaatcacttgaacccaggagacagaggttgcagtgagctgagatagcgccactgcactccagcctgggcgacagagcgagactctgtctcaaaaaaaaaaaaaattatagtacataggacagccccacaacaaagaattattcagcccacaatggtgccaaagttgagaaaccctatatactaaaacaagctctttgagggcagggatcatactaccttgactaccttgttcaattctcaatcctttataccctgcctgtcctggcacattgtaagtgctcagtaagtaatgactgagcaactgagcagatgtgctacaccagattccagagtcaaataatcatagacttggagaagtgcagggttatgggggctgcagtataacactctacctcacagtgggtgcatccaagccaccagcttcccctggttccagaaggcctgttagagacatgtcttgcatttgcacttggtccagcacagcccatgcctcccacttgtgaaaagaggctgactgatgggtggtgatcagggttggctgccttttcatttttgagatcatgggaacagagggaccggatgaagaaacacttctctgaatctacccatttctaaatggatgaatcaccaaggaggaaactcaaagattaatttctcactgcccttcttcccttgctctgctctttgtagacagttactggtgctccagggcaaaagataatgaaagttcttccttgcatcaaactattttcttcaggagatagagccagcattagccaaagagatggtctgggctctgggagcttggcttggaggcccaggacattcaaacagtccttcccggagaacaggctggacctgcagtgatgaataattattttgcaattgacagttcaatacccaccagattcttcattgtatgtttctgtatcgtgtcaagttatgagaaaacgcaatattctttaacagctaggcaagaacaatggtttttgctcatttgtttgtttgtttccaccccgcagaggtcagtttttgcagtaagaagagtctcattctttttttattttattttatttgtattttgagacagtctctctctgtcatccaggctggctggactgcagcggctgcaacctccatctctcaggttcaagggattgtcctgcctcaaacttctgagtagctgggactacaggcatgcctacgccctgctaatttattgtatttttagtagagacaaggtttcaacatgttgtccaggctggtcttgagctcctgacctcaagtgatccacccgcctcaccctcccaaagtgctgggattactgccatgggccactgtgctcgtgactcttcaagaagagtcttgaatttactctgaatgtgtccttggttggcacaaccacgagcagaatatgcatcctatctatcctcacaaacactgcgtttattatccccaatttgcctttgaggaaatggaggctcagagaggttaaataacttgctcaaggtcacgtgggcaatgagtggtggagtggagatttgaactcaggactgtctgtgaccctcccagccctgcagtctccaagtctccagtactatctggctctaaaatccgtactattccctctgctatgtttttgtggcgacttgaactcttccttcaaagtcttggctgctgctatgaactgaacgtgtaccttgtgaagttgtattttttccatattgtaattccatccttcaaaagtaagtcttgttactgaaagactgtttcaaccgtcctggggtaggagtggctaacaggttggcttgggtcccacagtgaaatctgttctgagccagaccctcccgaggggacaggggacgagcaggagagattgtagctgaagtagacatctcctgggttcccagaaatgtggaagaaccttgtgcaaaaacagcttcctgcagagctgcaagatgggatccaggttattggtatttgagcactgtgtttaggggctatgagagaaacctaacatgaaccggctgaaggaaaaaagtggaggattacatgaaaatgaattcagggagcttgcaggtgtactgaagggaagtgtgagctctaaaagctggaaaaggtctaaacgtgtagattacaaaaatatctgcagcttagcatggcaatgacggataaagcgtcagatatgtgtttgtcatccagttgtctatggctgtgcaacaaaccacccaacatgtagtagcttaaaacatgacagtcatttattttgctcacacatccacaatttgggcaggatgttgaggggacagttcgttcctgctccacgtggcatcagctggagctcaccagggggctgcagaattcatttctgagatggctcctctagcggttgctaagttggcgctttctggttggctgggagctcagctaggctgtggtccaggggacttggttcctttgtttgggcctctcctctcttcagctacttgggcttcctcatcgtatggtggctgggctctaagacaaggagaacccagtggaagctctgtcacattttatgatgtagccttggatgtcgcataacgtttcttctatattctattggtcaagcaatcgcacagtctggattcaacggtagatgacataggttctaccttttgatgaatcaaaaaattctgggatcatggtttgaaactaccaaaaagtagcggctgtattgtttgttattattacaaagtaggccgtgtgcagtggctcacacctgtaatcctagcactttgggaggccagcctgggcaacataatgagacccggtctctaaaaaaaaaaaaaaaaaaaaaaaggagagagattagccaagtgtggtggtgtgtgcctgtagtcccagctacttgggaggctgaggtgggaggatcacttaagcccaggagatcgaggtggcagtgaactatgatcacactaggctgggagacagagtgagaccttatctcaaaaaaaagttaatgataattactacaaagcaaggccaatagtacaaaaacagtgatctttcacagtctatgatatagcaggacagtgctagatgttccccatctgctatgccatttattcctccccaaaatttgggaagctcagggaggcatataaactgcctaaacagggccgtgaagctaggaagtgctaaagccaggatttaaacccagaagtcaaatgctaaagactctgctagactgactacctgattctagaggctggggtgtgtgctaggtatctgaaagattggagagatgcagacagaaatgtgtgaatgtgagtgtgcaaatttgcacaaggccagtagcacctaagggggcccatgtgggagatgggagggtccctgccatctgcttccttctcctcatccatttcaccctggtcttctcagccctcccctctcctccatgcccctccttggtctcttcccatggaccctgtgagagcccctctccagctgtttatgggagatgttgaaggagaagcaagggctcctcacgaccctgtctctgcctctttcctgtgctctgggacatctgaactgtcacatagtcagctggcagggaagcccaattttcctttggctctccaaagggcctgattcatgggttaggctgagatcagatagagcccttgggtcaggtgggtgggattctggctcccagggctgctggcaggtgccatctggttgttctggagggagttgaggggaatggttcccacctggacagtgtctgaggggtgagctggtgaagcactgggcgggtggggagctggcagggacgggacagatacagagagtgccaggaggtgtggacagctgctcgcagggctcttggtgactttgccaggaaactgtgtctagacagcctctgtctgatctctcttctcatcccacatcatctccccggttcctccctggcctgaggccgtcctgccaggttggtgcagggatatgttgaacaaagttcagatgtgctgtgtgcacagtaccaggctcagcatagtctgagaatgaaaagcagcttctgaaactcagccctgcctcaggtgcagggagctgctggtcttgccaggaggcttaatgcctggatcaaatatgagggggctggctgggcatgatggctcacactcgtgatcccagcactttgggaggctgaggtggtgggaggattgcttggggtcaggagttcgagatcagcctgggcaacatggtgagactctgtctctacaaaaaaactaaaataaaaaaatagtcggatgtggtagtgcacatctgtggtcctagctactggggaggctgagataggaggatcacttgagcccaggagttcaaagctgcagtgagctgtgattgtgccattgcactccagcctgaatgacagaggcagaacttgcctccaaaaaaaaaaaaaaaaaaaaaaagacaaatatttgggggcttccccagatagacgtctggtgctatggtctgaatgtcattgttccccttgaattcatatgttggaacttaatacccaatgtgatagtagtaagaggggccccttaggaagtgactaattcatgaggaatccaccttcatgaatgggattagtgcccccttttataaaaggggcttgagcaagcgcctttgcctcttttgccatataaggacacggcaacaaggtaccacctatgatgcagagtgagccctcctcaccaggcactgaatctgcaggtgccttgatctgggacatcccagcctccagaactgtgagcaacacacttctgtcatttataaattacccagtctaaggtattttgtgataatagccccaaaatatgacacccagagagtgtgggccctctagaggtcatttcttccaggcccctgccagatgctgagctcagcctgcaaccccaggctgttgaaaatccgaggaggctgaggtcagggagggaggcaggaggccagcaggccatcagggaagggaccccagtgggctcttgaggaatggggaaggggcattaaagggcccaggtagaggcctggagtggtggtggtggccgtgggggtgtgagaagctggtttgggtgaagatgcagggagacaaacagagacccattgggcacggacaggtgctcacatgtttccttgcacctggcatgcttcccctggtgaacactgccaatgtccacccacctgttcttcacccaggtgggcctcgggtctgcagggacacagcaaaggaatgaaagccaggggcaggggtttaaatcctggctctgtctcttttcctccgtgtgacctggggcaaggaaatggtctttatagctcatgcggtctttatgcagttgtcttaggtgatgggggatgagaaagtgccttgtaatcaataaagacagatttattacgataatacaaatttattgatttgtaatcagtaaaggcagattaaccataccatttttttttttttaaatagggtcttgctgcgtctcccaggctggagtgtagtgtcatgatcgtagctcactgcagcctcgaactcctggctcagactatccttccacctcagtctcccgagtagctggagctacaggcgcacaccatcatgctcagctaatttttatttttatagagatggggatctcactatgttgcccaggctggtcttgaactcctggcctccagcaatcctcccatcccagcctcgcaaagtgctgggtttacaggcgtgagccactgcacccagacaggatcaaccgtatcttttgagcatccgttctgtgcctggcaccaggaccagttgctgtgggtcaacagaacagtttcaggtgggtggtggatggaatggctggtgggctcagagctagagcttaggcccctcagctactcctctgggcaggagtgagcagtgctcaccctaccccaggcttaggccacttgcgatgtggggttcctcttcgcgcacatctactgaccctggaactattgaagctattttgtgagtgctgtgccctctctgctgagacacaatccctgtctggcacacccccaacacatcatttgcccctggagtttaactgtactttggtgaagagtggcagaggccagagggaccccaggggtggacatgtgattagcttgatgggcaaccccaggacagagaacagggatggggaaggagatgcttcccactgaagaccccatgcactctgcagcttacaatgctcctaaaaccccgatgctggtttataaactctcttgtccaattgctggggttcaactgggagccttggtgtgtcccgcccctcccccaggctgtcccgttgtcaggcgagaatgaggcttatttctgctcatccaccaagcttgtctgtttccaactgtccattttttttccatccatctatctgcccgtccatccatctttccatcacctcctgtccttaggcttaggggatttcctcttgggaggggaactctttttgcagaaaaggacgctgagccccaaaagctgagtatttcccagcataaatgtctgagccctgttccctgggcaggtcctgtattggggattcagagttgaattggagttgtctcagcctgtgaaggaaagagacctgtcaacagggggtgacaaggagagtttgtagccaggtgtggtggtgcacacctgtagttctagctaattgggaagctgagcagggaggaatgcttgagcccaggagtttgagaccagcctgggcaacatagtgagatggccccatttctacaaacattgtgaaaactagccacgcatggtgacagatgcctgtagtttgagctaatcggtagtctgaggcaggaggatctttggagcctaggggttcgaggctgcagtgagctaggattgtgccactgccttacagcctgggagacagagttgcaagactcccagttgcgatcatttaaaaactgggagactgacatagcatctggcttttagcttctcttaatttattagaagctctgacagcattgggcccatgttcccacgtggagacagttggtggatacaagataggcagctacctccgtctttcaatggggcatgcactccaattcaccacagaccccaccattccctactgcttctcattcctccctttcttcacttatgttatctgcctggactctctacaaggattttcatttgtggttcctgtttcaggaacaggccatggtgtggcctttcctgaccttgtcaagcctcaggttcccagaggggaccaaaatagatactgcacattgtagagggatcagctgaggtaatataggtgaaagctctcaggaagcctaaagctctctgcaatcacaaagctacacaaatagaaattattatcatcattatttataaccattgaaaggacaggagacaaagaagtcagtccccaccatacccctcccaaccccaagcccacaagggtatttgtgccattatgatggcattgatcattgacattgacagttattattaaacgatgtcaacttccaaatgcaaaatgtttaccagatgaactcaaatgggctggcagaaataatgtccaggtgccatctaccttcaactcctcttctcatgaatttctgtggcatttctccagggcccagagtcaataagggagagagaaatgactcctctggtttactgaaggtgtgacttgtgattccagccaatgtcctgttggtcccattgtctcccctgccactacccatgtggagtcttagatcttggagactgtactatgtgggccaactctctcctcaagacacatttattaaaaggtgggtgaagtatcttctcctttgcctgtgtcttttgcccaaagggaagttgattgatgacaatgctcctttttcaagctctgattgccggtggaggttggataaagcatcttgctgtgatctctaagtgggctgtgccttgaaaacatgattgttgtgtctaatcatgtgtgtctgtggctcccttgccactcctggttgccgtgtcactgtgactctatttaacatactttcaggacccactgtatctgtcccgcctctctctggatcttcccaactctgtggttgcctccctgctatattcatggcccctaggggatgccacgtgtgttcggttcttcatgctgttcctctgtctaaaatgttctcttctgtggcagcttcctgcaaacatcttcttctctttccagactttctttgatgattaagaagcttgcacgacctaagtcttataattctgaaaatcatctcctagtttccaggaccccagatgcaccagcatggcttagggaaaggaaaatgacctttggagagagaatctttggagggatttgagcctcggcattgccacttactagctacaccatttgggacatgttacaagcccccctgaacctcagtttcctcatctgtgaaatgggcataatgataggccctaaatcttgtggtgaggcttacatgtgccaatggatataaagtatacatcatcacaatgcctggcacatgatgaaagattaataggggcaattaatatagtgtttgtgatagacccaaagatagactgacccgaggccgaccctgggcaccttttcaactgaaatcccaccaccttatattttgacttctaggtttcctttccctaaaagagaagtttggagaaggatctagaattgttggttaatcaagggcttgctaccttctaatcacttcatgttgatactaggataaagagcaaacatccttcatggggtttacaaggccctccatggccaggaccgtgtttatgtccccagcctcatagtccacttctcctctctccctgggtggtgacacattacacagtaccctcgcacatgctcttttgcccacttaatgcctgctcattcttcaaagcccaggcacttcctctggaagccttccgcagctccctgtgttccttctcgacagagtgtaaccgcccattgggtccaccttgcccgctgcctagacagagctgatttatcaagacagggggattggaatacagagagagtaattcatgcagaggggcattgtgggagactggagtttgattatcactcaaatcagtctccacaagcatttggggagcagagtttttaagaacagcctggtaggggtggttagttgaagccagtgagccaggagtgcagattggtcagggaagaaatcatagggagtcgaagctgtcctcttgcgctgagtcagttcctgggttggggccacaagatcagatgagccagttgatcgatctgggtggtgccacctgacccgtcacgtgcagggtctgcaaattatctcaagcactgatcttaggaacagtttagggagggtcagaatcttgtaacctccagccgcctgactcctaaaccatagtttctaatcttgtggctgattttagtcctaacaaaggcaatctagtccccaggcaagaaggaggtctgctttgggaaagggctgttatcatctttgctttaaactacaaactatgaaccatgaactcagtttctcccaaagttaggtcagcctacacccaagaatgaataaggacagcttggaggttagaagcaagatggaattgatcaagttaaatctctttcactgtctcagtcataattttgctaaggcagtttcaagagcacttactctagtttctggttttacattcatgactgtgttttatttggttcatgtctaattcctccactggaccgagagctccatgatggcaggaaccaagtccgtgggtggccccctgtggtgtccccagcattgaacacagcagcacgtccctcatgggtgttcactacataataatttgttggatgcacaggtggatacatgacttactactttaagaatgtgtgcatttgagatgtttacttggaacaacgaaggcttattcttgaagaaacaacaagtgataagtcaccagaagacagaaaacagcatgttggagctgggtggctcctggtgcctgggaaatgaacccttggggtggttcttggaaggaagtgagcaggtttagtcccatctgatgaactctttcctctccatggttaagttggcttctaactcagggactaagttttatttgagactgaggccactgctggtgggttggttggtctcctccacctttcccttcacccgtaaatgggatattagtgaacgggtggcataacccacctgagggttcttatagggtttcaggagaacagccctcatctcccaatttcctgaactgccatcaagataactgtgtgtgtgtgtgtgtgtttgtgtgtttaatcgagacagagtctcgctctgttgctcaggctggagtgcagtggcatgatcttggctcactgcaacctccgccactcaggttcaaacaattctcatgtctcagcctcctgagtagctgggattacaggcacgtgccaccacacctagctaatttttttttttaagatagactgatttttgtatttttaatagagatggggtttcaccatgttggccaggctggtctggaactcctgacctcaggtgatctgctcaccttggcatcccaaagttctgggattacaagtgtgagccaccacacctggctatcatcaagataactctttaaataagccaaacatttattggccaaaagcaatgcacatgtgctgtcaacaagcaaatttggggaaacacaaagagaatagaaacagaaaataaatattaaccacccagatgtaatcatattagcattttggggcatatgtttctgattctttttaaaaaatatttatgtctctctgtgttttctatttatatatgtattgcaacctgatttttttcattgagcaaatgtaaaatgaacagaaaatgtccaggaaagcaaatgtctcccttctgctggcctggtgtattacacagggttctgtggagggacagaactaataggatagatgtatatacaaaggggagtttattaaggggtactgactcacacggtcacaaggtgaagtcccacaataggccatctgcaagctgaggagcaaggaaaccagtctgagtcccaaaacctcaaaagtagggaagccagcagtgcagccttcattctgtggccaaaggcttgagagcccctggcaaaccactggtgtaagtccaagagtccaaaagctgaagaacttggagtccaatgttccagggcaggaagcatccagcacaggagaaagatgaaggccggaagactcagtaagtctgttctttccaacttctgcctgctttattctagccacgctggcagctgattagatggtacccacccagattgagggtgggtctgcctctcccagtccactgactcaagtgtaaatctcctttagcaacatcctcacagacgcacccaggatcaatactttgcctccttcgatccaatcaagttgacactcaatattaaccatcacacctggtatgacagtactagccttgtcccaagaggcaggagccccagaactgcagagcatctgatagagatgtgaatagtggctttggaaggaatgactgtggccaggtaaggtgacaggtaatggcgaaaacaggcatgaaatcgtggggcagttcaggtgagccattccccaatattcaccaagagataatagggaagggagagagagtaggggtctcaaaagcagggtcacggtgctgataatctgaaaggtagggtctcagagccattgaatgtttcatttattcactcaacgagaatttcttgagtggctaatatgtgccaggtgctgcagcagccagtggggattgtaggtcacaaaaacatgacttcattcaaagcatgcaccattatttacatatgtaaagtgccttggcatgaaatagaagcccaataatctcttgcaaccatagagatgagcattaatgacttttccagaattgcatctatggttggtgattattcctatgtggccaaatgaccagaaggagcagaaagctacatttttgtggcatcttgtatacatagaaatgattgctgtaaatatatgttgactccctttaatacatatgcaactaattgaaagcgggcagtttatggtgtagtatcagtgaaacgtgctctgttgccattaagtatagctttgttacattattgagacaacttgccttgggggcactggggtaagttattgcttcttcaaccatattttggtccttagaggaccaaccgctagtccagcttttattacctgctgtttctttaatcacaacagggaaatgttggctaggcatcggacgggagacttttcttataagatgaaatgagccaagattggaagacgacatttttatttgccttacaaatggactggatacagtgtgaatggcttcgtgaatgagatgaagggctctgctgcgcagcaatcccaaaccattcacccttatgcagaggcagagagcctcctaaatgaattgggttctgttggagttagctgctcttattttcctgtgctgaggagtctggagtgggagggtatccatttcccaaccaataataattagctttgattccaggcaacatgtgcatttttaatccgttaggcatagggtcttcccgggacctatacgtttttcaagatctacagaaatgtttgagaccaaaaacaaacaaacaaacaaacaaacaaaaaacaccacacaaacacacatacacacacacacattggcttaaaaatgcaaaagagaaaatgacaaaattgaaattaatgaatatcttaaaaattacctacgctgggcatggtggctcacgactgtaatcccagcactttgggaggctgaggcaggcagatcacctgaggtcaggagttcgagaccaggctgaccaacatggtgaaaccctgtctctactaaaaatatgaaaatgagcttggtatggtggtgcatgcctgtaaacctgtaatcccagctactcaggaggctgagacaggagaattgcttgaacctgggaggtggaggtggcagtgagccgagatcatgccattgcactccagcctgggcaacaagagtgaaactccttctaaaaaaaaaaaaaaaattacctacaaattgtgctgctttgtcaatatcactaattgttaaatttaacattcctagggatttcattacatctgaaaaatgtggatagttagaatttcccactttctagacctcctgaatatgcacaattaccaagaaatcacatccaatctaaatttaaataaatcacctattgccagataatttcaggagcagaattttaaaattttctcaaaaaatgtttagagccaaaaatccatttaatgtaggatacaggcaaatttgtagcatgtttcaaatgctttctggtgagacctccaaaagtgaatgtgtctagggtatataaaattcttaaaggggctttgtcatccttcttccccactcacccataaaatagatgagataaaagctatttctaagggtggctcttttgtgaagtatttgagctttacggtagatgagactattgtttagtaaatatttgttccctctcctattacatcattgatgttcagctaggctatgtgacttccttttccctgagagatggcatagtgtacttccctacccttcgactgttgagttgagcttaactttctttggctaatgggatgtgagaggacataacccttatgaaaggcttgaaatgctctcgtgtgatgagtttgccttcttgtgcttttgccttctctatgagaaaaacatgacttagttggttgctggtcctagaaaaatgagatgcatctagagcagagccgccccagcatgtcttcagacctgcaacctccagcagagctgctccagccaagctatacgggcatggcagagaaataagctctttctgggatttggggttgtttgtcttacagcatctagctgactgctgcaagttcctgcacacagtggtgcttactcatgtttctgaaggaatagcagtttgtttatttcaaccatattgctagttatttgttattttccaccatattgctagggttataactctgaaaacaagttcagctacttctcacatgttccttctgcctgaaaactttgtctccttgctcttcacgtggatggctttctatctttggctctggatttaaatattactcccttgggatgacctcttctgatacattatttaaataccatctgtggtggagcctactatttacatattgaaacatctacattcccttttcttctctgaaataacaccttattttcgggggaaaaatttcaaactgagacaatagttggaagaacagtacaattaagttttccctctcctcgaatcgtttcccaatactttactgtgtgtgtcttgcaataaggaccttctcctatatgcccataatacgaccattaaagtcaggaaattattataacattgatacattaccaccatctaatccaaaggccccattcaggtttcactgaccatcccaataatgtcctttataatcttgcagggcaagattatcatagcatttaattgtcacgtcttattccggcagattcatcagtctctttgttactttcttgaccttgatacttttgaagatacaggccatttatgttgtataagagctctcaattggggattgtctgatgctttttcgtgactagaactaggtcgtgcaccaattctaggcttcaacaccccatgccagatctctgtcctatcccctctcgttgatgcttactttggttggtgccctttagtgactttaacactgaatatttgaggaagaataaaagatgaaacactgattttaattagggtgacatagactctgctttaaacaacaacaacaaaaccaaaaccctctaatttcccaatctctcatgaagctacccaagccatgtgatttagctttggccaaggaatgcaaagagaagagtaatatggacattttctcagaatgaggaccatatatttctttgcccatttttcctgttgttggtcttgaattaggatgcaatggctagatctctggatgccatatttgaccatgaagtcaagtccaaatgagaaacgatcattcccaaattaaggccgtgacttaaggaggtatataaaagagaaggtggcaattggttgaatgtagggtgtgatggagaaggactcaaagatgttgttcaggctcttggtttgggtaactgggtgaatggtgatgatattcatggagaaagtgagctaaaaattaggagtaaaattatttggaaggcaagttaaattcgtttttggaaagaaatgaatctgagatatacaatggacatctgacggtgttctctaaggtaacgggaattggaaacagatttcaatattgaggtggtagaagaaggggtcaaatcatcaaatcatgattctgttacttggaaggaaggctgaaggggagaccttgagcatcttgtttcttcttagttccatttatgctttatgcttttgagcactaatcacaacagatactgtggaggctgagctccagccattgtcaagcctgtgctccagcactggtataaattactggagtcctcattctagaggaaagcacggggacgaatcttttctagggctctttaccttgtctactcttcctgcagggagtagttcagactttcttcttctacctcctcttcttctttttttctttatagagacaagatctcagtctgtcacccatactggagtgtagtggcacaattataactcactgcagcctcaagttcctgagctcaggtgatcctcctgccttagccttctgagtagcttggactgcagggttcatgccaccatgcctggcttatttatttatttatttagtagaaacagggtctcactatgttgcctagtctggtctagaacttctgtcctcaattcatcctcctgcctcagcctcccaaagtgctgggattacaggtgtgagccactacacccagcctaggtttttctttcttttcaatgaatcataacccttctctcttcatttctagtgaacatgcatcaccttatcctatcacaaaccaactctgtgacaaatgtactattactatgcccattttacaaatggaaaaactgagacttaaagaatttaaattggctgggcgcagtgactcacacctataatcccagctcttttggaggccaagatgggaggattgcttgaggtcaggagttcgagacaagctgaggcaagaaagcaagaccctgtctccacaaaaattaaataaattagccaggtgcggtggtgcacacctgtagtcccagctactccacaggctgaggcaggaggatagcttaagcccaggagttcaaggctgcagtgaactatgatcatgcccattgcactccagcctgggcaacagagcaagaccctgtttctaaaaattagacaaaataccaagcaacaacaccaacaaaacaacaacaccataaaacaaagttaagtatcctggggttatactggaatccaaataatctggtttaagagcttaacctcctaaccaccatgctatactgccttgtggcaactcatgccttgtgaatctttactcctggtagtgtttcacagttgacagagagcttttgcattcttgatctcatttggtcctcacaacagccctgtggggcaggtaggaaagaccttgttattagacatgagggtcctaagaaccagaaagctaatggacatgccgaaggtggcccagccaatgaatagcagagttagataagaattgtgatcttcaggccgggcacggtggctcacacctataatcccagcactttgggaggccaaggcgggtggatcacttgatgtcaggagttcaagacctgacctcaagtctggccaacatgatgaaattctgtttctactaaaaaatacaaaaattagccaggtgtggtggcgcacacctgttatcccagcttcttgggaggctgaggtaggagaatcgtttgaacctgggaggcggaggttgcagtaagccgagattgcaccactgcactccagcctgggacacagagccagactgtctcaaaaaaaaaaaaattgtgatcttcagcagccttatagagcacttcttctactgtataatcctcgctttcctcatttacatctgtgaaaaagatattccttttgttcagatgctcttaggtgctctgaagcaagcaatagcccaagctggcattttgagagccatttcatggatggaaagcggaggctcaatggctaagggaattagccttggttctccagtgtgtctgcagtcttcatggcattggtgctgctgatccacagtcatgccagaggttgggtccgcagtgaaccgcttcacagctggatggttgggggaaaagagaggtctaatgatagaaaccttccccaaagcaaaggatgtaagcccacaccgagaattattagaaagaataatattctcccacactgagaattattagaaagaaagaaagaaaaactagaaagaaggacaaaggcattccagcatgcttcctgtgacagattgagccagtctttgtaacctcagattcacaaggacattgcaaagaatttcctgttgcgctcaccaaaattggctggcccttgtgccagagtcccactgacatccagaaaactattgcccatcttctctgggctgtgcaaggattagtgtcataatagatcatcacagccaaatgttattatgcaaagcagaaagctgcaagaaatggatcttcattcattgaatttgcatgtttggtggggactgcttcagacttcctttatctcgtgatcagtcgtgtgtgttgatcctctttgcaagttgttgtgagaactgggtgcagcaaaagctgccacttcaagagaccaaagggatttctgagatgaaaaagtgcatcaatttgcataaagaactcagataatttctaggtagaaagcaggtcagagaggctctagacctaggactctcgtgttggattgcttagtttcaaatcatgcttatgtcacttacatgcatgcaatctggataagacatttaatatctccccaagcctcagtgttctcatctgtaaaattagatgatgtggtgatgatgaaagaacatatataggctggatgcagtggctcatgcctgtaatcccggcattttaggaggatggggtgggcggggcacttggggtcaggagttgagaaccagtccggccaacatggtgaaactttgcctctaaagaaagtacaaaaatgagccaggcctggttgtgggcacctgtagtcccagctacttgggaggctgagacaggagaattgcttgaacccgggagacggaggttgcagtgagccaagatcataccactgcactgcagcctggacaatagagcaagactctgtctcaagaaaacccccaaaaaacaaaaaaaacaaaaataatatatataaaacatatatattatataatatataaaaaacatatataatataatatataaaacatatattatttaatatattatgtaatatctattttaataacatatattgtatattacataacttgttatattatataacatgttatataatatataatttgttatatatgttatataacatataaaccatgtattatatataatataatacatgttttatataatatataataattataatttatataatatatgacattatatattatatataacttatatatttatgtatgataaaatatatggtatatgaaatatacataattatatattatatgatataattatatatcatatatgtattatgtatatttcatatacattatattttattatataaacataagtatatattatactatgtaatagtataatatataattatacaatgtataattatatatgtaatagtataatatataatatacaatgtataattatatattatgatatgtatgacatacatatctaacatatattataacatgtatgttatatataacacatatagcatctagataccatgtatagcatgtgtacatgcatatatatttatgttattcaacatgggtccaggaatggagtaagagatcaacaaatacagtcattaaaatcagtgattcctcattcttctcccagctccttctttatgagattttgaaatccatatggatggataaaaatatccccaaatggtgcctaatgttgcagtgaaggaaaatgaaactctggaaataaaattagttcaaggagaaggagcatctccgctgttgacccggcttaacactagactaagaatagattgcaatggccccaacctcaggtatgccggataagtccctgaaggccctagaggggaacctgagaagggtttgaatgtttgcatgtgtgttcgacaagctggtacctggtagctgagatgtagaggagaatcattgtgccctatgtagagactggactatgtggactttttcatagctgtagacaaagacacgctgacagtaccagactggttttcaacctaatggcagcctcggggacaagggaaggtgaaaatggggctgcctatgaatggatgcgactcctcaggtttccatcagcctgaagtttggaagtgatctttggattaactgagtcggcagagtgttggaccacgagaaggcagatgtggagtgagatactggacttcttggctcctgtgagcaaagaggatgggcatgagattaaatggaaaagtaagagacgtgacagtttcccaggttaataacatgagtaatgccagttacatgcatgggagctcatttaacaactcttcagggttgtgttactacccaaaccctttatgatgctgagcacgcactgcagacactgattcctgcctgcccctccactctgtttcctggttaccttctgcctgattcattttgatctagacacactggcttccattcttttccatgaacaagccaagctccttcccacctctgggcctttgcacacgcagtttcctccacctggaatgctgctcccagatctttttacaacacatttcctctcatctgttgagcctcaccttacacgttaccctttcagaaagattttcccgttcatgtcctctccgctacattattctccctcccatcaccctctctaacatcatagtcctcaccattcctgaaatgatctttgttacttactgggtggcatgtttagaggctgctttccccactggctctgtgacagtgactttgtcatggtaactcaacattctgtttcctgtggcctgaagattgccgggtatatactaagtgctccatgaatatttgttggaagattcaatgaatcatatcttaccaatgcaatattggaagcctagagaaatgaaataacgttttcacaattgcacagagtaacagatgctttcagtgcttcccttgtatcttctaaccctttacctcttaagcatccactgacccatccaaatgtagttgcattctctttctgaggactttttctttttcttttctttttttttttttttgagatggagtctcactctgtcgcccaggctgaagtgcagtggcgtgatctcagctcacagcaatctccgcctcccaggttcaagcaattctcctgcctcagcctcctgagtagctggaattacaggcatgcaccaccatgcccagctattttttttttttttagtagatgtggggctttgccatgctggccaggctgtctcgaactcctgacctcaggtgatccacctgtcttggcctcccaaagtgctgggattacaggcatgagccaccatgcctggccctctttctgaggtctttttctggttgtactgtctttgcccacccgtatgatggcttggaagtcttggaggaatcaacacctgccctgggagcatccctccaccaggaactgatgagagttggtgtatgtggataactaccccatctccctcaccccttaggtcagataactatgaagcaagagctggtatgtgcatctttccccaagtccttgttcagggacaaggtagtgtgaaatcagccatggtgggaggatttacaccatggatatgggcagacactacaaatctgggcttttaatatttttctgcagtgttggttgttaaacatctaccagcacattgctagagatgttctacagtgtatcctagagttttccagcaagtttaagctccagttattgtcccaagtggtaacttgttttataatatgccctttactggctgcctccctgacctatttcatttcctgtgtcatgtttcatttacctcccacatagatgacttactcttggagtcttgtctcagggtctgattcttgggaaaccccgatgaaggcatacaactagtatgcgataaaaccagcatttaaacctaggaaggtctgactccaaatccacgtgtattttactaatactccactgcctcttgtgtctgaccagttctttgccaatacactgtgacaggagtcctttaaggagtgagacaaatgcattatattgatgaaagtagcttgcaattaagaagttagccttctaggccaggcacaggggctcaagcctataatcccaccatgattgggaggctggggcagggggatcacttgaggtcaggagttcaagaccagcctggtcaatatggtgaaaccccatctctactaaaattataaaaattagctgggcatggtgacgcacacctgtaatcccagctacttgagaggctgaggcaggagcatcacttgaattcaggaggcagaggttgcagtgagtcgggatcacaccactgcactccagcctgggtgatagagtgagactccatcgcaaaaaaaaaaaaaaaaaaaaaaaaaaaaaagaagttacgtttcttatgataagggatgggttaactagataaaacatgtggaaatctaatttagttagtaaattattttttatttcaaaaacacttttaaaacatagacatgttttccataaaacatgtaggcaccaagacagatttgattgctctcttgcgaatgatcagcagcaggcttccacttcatgcttgttataatttactgtttatagttcctaactctctgcttacacgctggtttgaatattcaagggtctcaccaagtggtgaggcactggacacaatgatgatgttgggtgcaaatgaatagggcttcagctggaaaggggcaaggggcagactggaaagagcttaggctttagacctctgtactggtcaggacactttggttcacaagggagagaaactcagtgcaagctagcctaggcagaaaagaaaaaagaacttaatgcctggggaaattggaaggttgaaggatgtgtagttagcttcaggtatggctcgatcaaggattactcgctaataaagcctctctccttcactagaatagaagctctgtaaagacaggcaccttgtctgccctattcatagctgcatcctccatcatatagaataatgcctggcacacagtgataataaaaattatagagcatgtcatatgggcatgccactgttcttagtttatccacttaacccaatgaggtaggcaattattaattataatccccatttttctgggtggagaaaccaaggcactgagaagtcatttagctgataagcagggtaactgggatttgaacctaggacctcttgctccagagtctgtgctcataaccatgctgctatattaactcagtaagtagttgttgattgagtgaatgaataactgactaatgatgaaacttgccagacacagagtattcagtaactaggagtgctgacatttatttgagtggcctctgttttctgtgtcccattagctttgggtgctggtgtcttcatctgcaggattccatatatttagcccagatcaatggagtgctggagggtcaggatgagtcgtgttcaagaaaataaggttggagttatttctagaattttttttttttttttgagacagagtctcgctctgtcgcccaggctggagtgcaatggtgtgatctcggctcactgcaacctctgcctcccaggttcaagtgattctcatgcctcagcctcccaagtagctgggattacaggtacccaccaccatgcttggctaatttttgtatttttagtagagatggggtttctccatgttgaccaggctggtgtcgaactcctgacctcaagtgatccactggccttggcctcccaatgtgctgggattacaggtgtgagacaccacacccagcctgaaattttgttttaagttcctgagatccaggggttgtttgttactgcagcatagtctaacccatcctgtgtagaagcccttacttacttaggatgtgtcattgagttcagagagaggcagtagaggaaagggcccagactttaaaatcagagagatgaaattccaactctccactcactagctgtgtgaccttgggtaagttccttaacctctctgagcctcactctgcattctcactagtgaaattacaactgtaattgctactccatgaaattgctttgactactaaaataggaaaccctgtcaagggtataacatagtaggtgttgatgtatgttggctattacttttgctattatgtagcaaagcatagattactttggctattttgaaaaaacctgttgctatcaattaaggatagagtggctaaattaagtaaattctgtaagcaaacaaggatgggtctttaattctcctccacttttgatttatggctgaagatttgacagttatctgaagtctgactagcttgaaaaccaagacatctgtgattagacttaccttttgttcttcccattagtgtaatacattgttttaggacatctctgccaacccactcccccaatatccatctagcttggagcctttatggccttcataaggacccggcttcccccttggtctttaaaattagacaacagatgttcataatcgaacctgtcttggttccagaaagtctgagatgttcagaaataatcagaacgtctctataaatatcataaaggatatatcattttggcagaaccagatccagtttttgtggggactgaagcttatataatatggggatctctgtttaagaaaaagaatacaaaattatgaatttaaaattaggcacaaaagagaatgttattttggaatgagaaattaagtataatattcctgtagctgcctggacatggtagctcatgcctgtaatcccagctttttgagacgccaaggtaggaggatttcttgagcccaggagttcaagaccagcctaagcaacatggcaagacccccatctctacaaaaaaaaaaattcaaaaaattagccaggtgtggtggtgtgtgcctgtagtcccagctactcaggaggccgaggtgggaggatcgcttgagccagggagttggaggctgcagtgagcgatgatcttgccaccacactccagcctccagcctgggggtaacagagtgagatgttgtctcaaaaaaataaaaagagaaaattctggagcctttagctatttccattccattcttctgggatctgtgtaggcaattaatcagaaatgtgaacatagaggtgcttcattattgaaacccagctttcccttctcacctaaagccttccccaagtccagcatttaaagagacaggtacaaggaaaagaccctgaagcccaagcctcattagcttcaggtaaattcacctccgctctctggagaagcagacaacagaggcctcttgtgaatattgaggagaaggttgtatgtgtgttcatgtgcgtgagatccaagtggagagcatgggaacctagctcaattttcccttgaggtgagcttgaagctttgggtatcttcctctcagagaacgtaaacccatttttccaacattgttgtaaaatattctgttcccacctttcccacaatcagcttgcctgaccccaccacagggtgtgtcatcttgtgcttctggcacacacacacacacacacacacacacacacacacacacacacactctcagagccctgccatctgaaggcagccagctccagaaaggccaacccttagctgtaactcagcatagcactgttcatgatctttggtttccatttctaggctggtttccttttttgttttgttttttcctttgccaagactgtagttgaaataggataaaggatttatttttccataacaaggtaggagaaagggtgctaggttacaagcaccctgtcaatatcagagttggaagcttcttcctaccatcaggtgtgtgttgtgaaaggaacgaggggttcaggcaagtatttcccagcaggtgggaaggggtcttgatgggatggaaactaggaaaacaaaccagattccctgagggaaaatcaactgttcctgaactgttatcagtgtgggagtagggttcacagatttcatattctaaacatgtttgtgtgtggtgtgtgcacacacacctactatgtggcagagcctgtcataagtggtgatggattcctgtagatatagtttgctggagctgccataacaaagtactacagactgggtggcttaaatgacagagattaattttctcacaattctggaggctggaagtctgagatcagggtgtcagcagggttggttcctccgaagacctcctcttggcttgcagatggtcgattctggtgtgtcctcagatggtctttcctctgtgcctgtccatccctggtgtctctctgtgtgtcctaatctcctcttcctataagaacacgagtctgattggattagagctcaccctaaatgagctaaataggtttaaacttaatcacctatttaaagcccctatctccaaatacaatgacagtctgaggtgctagggggttaggacttcaacatatgatccatatggttgaagggcttcaaattcatatatatatatatatatatatatatatatatatatatatatagagagagagagagagagagagagagagagagagagagagagagagacagagagacagagagagagagacagagtctcgttctgtcgcctaggctggagtgcagtggtgcgatcttggctcactgccacttccacctcccaggttcaagtgattctcctatcctggcctcccaagtagctgggatgataggcatgcgtcaccacacctggctaatttttgtatttttagtagagatggggtttcgccatgttggccaggctggtctcaaactgctgacctaagatgatctgcccacctcggcctcccagagtactgggattacaggcatgagccactgtgcctggcctcaaattcatatttgaacatttattcaaatttgaattttagggggacataattcagcctgtagcactgtcaacctaaaaggaagaagctgaggcaaaattaatgtaagtaaagactctgtttgggccaagcttgaggactgtagccagggagcgtagattcaagtttccctgaatatacactccaattagcagcagttacaagtggatttataaaggcaaaaaagggggacatggagtgggctggtacacagttggttgtcaggaattctcactggttttcagaaataacattgacgagtgattggctatacattgttaagctatgaggtgtgggttatagcatccagtggggcattattagattaatttatagctacttgtggcaatggcaagcagttttaagaaatgaataccgagctcaaagggggtatgtaggacatgattgctatctcattctattgcctctctgggcctaataatttaaaaggcttgtattcctcagatgaaagttctgttcttttctcagcaccttgaatggctggagagagcaccaccccatccttgaccatgctgagtgctggctggacttcaactgggccagtactcccttttcccttgtggaaggtcccctgattaatgcttacctgaacgcctgctcttccttcagtccccagttctctgcattccccagcactgggaacagagacagcatgtctgtgttatacaatagggaagagtatgggctctgggtttaaactttgactctgcccccttgttagcccagcgactgtgagcaagtcatttcacttcacccaacttgttttcctttttgtacattggaggttactaaaagcaccttacctgtccaattgtagagaggattaggtgtattaatgggcatggcacagtaaacactcacaaaatgctagctactattaattgtcaagattatgttggttgcaaggagcagaaactcatatggaagtcatttaggcaataaaaggggataatttattgactctcataaccaaatccaggaaggtaggagagcagttgagtggcaggggcaactggaaagagaccattccccatgtctgtctgtctgtcatatcttttttatttttatatatgtatttttttaccatggtgggtttttttttgtttcttttctttttttggttgttttttccatccttggctagaaccatggctgccaacaagcttctctgtttcataatgggagaccttctcatgtggttatgatgtgaaaaaaatcccagggaaggactctgattggttcagctcaggtcacatagccacccacgtggccaggtcaggggctggggtgcttaggtggggcagggggttctgggtagataaaaataattaatgccttctgccttatctaaatgttctttgtactatgcctggcacttggtagaaattaaacaaattcccctttttccctttctgtttgaccctcatgtctactttttattacataaaagagtaatccagaaaagaaagtcagctcattggagacactgggtagggagaaaaagctttttatagaatattaggtaggagtagtggcttaggatggtaagagctctgcacgaaaggaagacattacggtctaaggccacctgggagatctgagtcaagcagctctatcccttcctgaggacaaaagagatttcaggcaatgactcatttgtttggagagctaattgacaagacatattaagagttttagcaattgttcatgctttttgatccaacaaattcacttctagagtgtcaagaactgtgctggtctaagatattatcctacatggaggctagtgagttttatggatgtgggcagaagacatgagactctggattgagagataaaggactttatttttcatggcacaacaggaagcttgagcttcatgtctgcaccagttccctttgacccccaagtccctcaagggtgacacaggttgacatggtttggctgtgtccccacccaaatctcatcttgaattgtagttcccacaatccccatgtgtcatggaagggacccagtgggaggtaatttaatcatgggggcagttatcttcatgctgttcttatgatagtgaatgagttctcacaaaatctgatggttttataaggggctttttcttcttttgctcattcttcccctttctgccgccatgtgaagaaggacatgtttgctttcccttctgccatgattgtaagtttcccgaggcctccctgagtcaattaaatctctttcctttatgaattactcagtctagggtatgtttttcatttgtttgtttttttgttttttttgagacagagtttcactcttgtcgcccaggctggagtgcaatggcaggatctcagctcaccccaacctctgcctcccaggttcaagcaattgtcctgcctcagcctcctgagtagctgggattacagccatgtaccaccacacccagctaattttgtgtatctagtagagatggggtttctccatgttggtcaggctggtcttgaactcctgacctcaggtgatctgcccacctcagcatcccaaagtgctgagattacagccatgcctagccttttttttttctttttttgagacagagtctcactctgtcgcccaggctggagtgcagtggcgcattcttggctcactgcaacctccacctcccgggttcaagcgattctcccacctcagcctcctgagtagctaggattataggtgtgcaccacaatacctggctaattttttgtattttagtagagatgaggtttcaccatgttgcccaggctggtctcaaactcctgagctcaggcaatctgcccacctcggcctcccaaggtgttaggattacaggtgtgagacaccacacccagccttgggtatgtttttattagcagtgtgagaaatgagtaatacatggatggatccaggtagaatctgtgcctgcagtggatttgcatcacacctgaggaaccccaagtttaggaatcttggtcttttcaacctttaccctggatggagggagacattgtcattataatcctttctttttctttttcttcttctttttttgttttttgtttttttgaggtagagtcttgctctgtcacaccaatgttggagtgcagtggaatgatcttagctcattgcaacccctgcctcttgggttcaagcaattctcccacctgtctcccaagtagctgggattacaggcgcccaccaccacacccagctaattttttaagtgtttgtagtagagatggcagtttcaccatattggccaggctggtctcgaactcccaacctcaggtcatctgcctgcctcagcctcacaaattggtgggattacaggcatgagccactgcgcctggtccggagatattattattataatcctaatcagcaaataaatctgtcttctactatactagccctatcttctaatgctattagctatacaaacatccttataaagacggtctagaacaaaagctgacacaagatgtgcagaaatgtaagagacacatggggaattgttgcacagcatagagaatctttcctaaggaaactacatctgaaacacacacagaaaatgtattcttaaagcaacaatagttcagcattaggggaagaggttaaacagactgttgttgggatactcttctgtttctaaacatgtttctgaagatcttggaatgggaagtgtaaacgttcaacttaaaatgtaaagtggaacaaaaagctgcaaaacttgaatatatgtttttattaactatgtacagacatctattctaggaaacctgggagggagacgtgctaaaatgttcatagtctttctctgggcgatgagtctaggatccactgtttttcttcatttggaatgttcatagtcctcctctgggcaatgagtctaggatcaactgtttttcttcatgtggaatgttcatagtcttcctctgggcaatgagtctaggagccactgtttttcttcatttggaatgttcatagtcctcctctgggcaatgagtctaggatcaactgtttttcttcatgtggaatgttcatagtcttcctctgggcaatgagtctaggagccactgtttttcttcatgtggaatgttcatagtcttcctctgggcaatgagtctaggatcaactgtttttcttcatttggaatttttttttttcagtttttctataatgaacatgtattacatttataatagaaaataacaagataaattatttctgaaagcagtgcccagcatccagaatttggcaaaaacaggagaagaaagcataaaacaagcagggaaaaaggttttcagttaaattagatgtccaatgaagagatcagcttggctgcaaaatctctttttgacagacaattagttctgggcaagtcaaatgtttcaacagtgcgttcttctggggcaattaaagtaattcatacttgatgtgcggaaatgtggtaattgggaaagttccccaaatggcagttgaaactgggctggttgtgtttggagaagttaagtcatgcccttgacaagccatctatctgagtctactgaagagggcttgggctgggtgattttaagatggaattttccactgggcataggaagtgatgttgggaatggactagaagggtcaacagtgacaacattaacagcatttattgtaatataaatacagttggcccttgaacaacatggatttgaaccgcatgggtccacttatacatggatttttttctgtttttgccacctctgagacggcgaaaccaattcctcctcttcctcctcttcctcagtctcctcaatgtgaagacaatgaggatgaagacatttatgatgatccacttccacttaatgaataataaatacattttctcttccttatgattttcttaatcatatattgttttctctagcttattttattgtaaaaatacagtgtataatcatataaaatacaacatatgtgtatattgtttgtgttattggtaagacttctggtcaacaataggttattagtagctacgttttgggggagtcaaaagttataggtggatttccaactgtgagggggttggcatcacagtcattcatgggtcaaccattgtgtcaataacaatcataccacacatattttgagtgccacatgttgcactaagcacttatgtatctattaatttctacaactatcccgtgcaatagatacgattggagtttccgtcttactgataaggaaactgagggccagagaggtcaattgagttgtccaaggtcacacagccagttagtaatggagctggaatctgaatccatgcaatctgacccttgttcaatgctcctagacttatgtgctggatttttttttttttgaaataacaatgttttatacctctatctttactttcctagataagggcatctgatttccctccatggcaagcaagttatgttgtatttgctacatttgagagggaaaaaagctgaagttcagaacggattagaaatttcccaaggccacacagtgaaagaatagaaagtttccttttttaaatggcggagcttttatatcaatgctgtttgtaaattttagttggcaatgtctgttatattccatgaaactgaatgagaggtgaggtggtatattagccaaaactctctcagctacatcttgctattgttccatgcaacttcaaagcccacagatagactggacttcaagtatggctggatccagatgcttaaatgatatgctttgaaatctgtctgatctctacttctcagctctcttttcatccatgttggcttcattatcaggcccttttcttatgccatcagcagctgctgacttacctcctaccagcttagtaatcccaggggaaaatgaacttacctttgccaaaagcactggcataagaagctgactctcattgcattgtaagagtcaggtgcccatctctgaacgaattattgtggctaaggaagtagaagagggtgattagtcagtcctgatcatgtgctcagctctagctttagaagatggtgctatccaaactccatgaatgaacagtgaaggaaggaccattgttcaaaagtaagtggaaatgctgtttccaggaaagcagaatgggaggaggaagtggggggaggggggaagggattcaaggggtgggagctggaatggaattagccctaaatagttggagtttggagggtgtaagtaagtgtgagctgaatgccgaaagcagagttgcaagatggtgtgtcagcccagttctgagaaacaaactcccatacaggattacacatatgtgatttttattaagggaaatgcccttgagagaaagcaaagaaggtgccacataaagctgggagaacctgagacagtaatgcaagtctgactctgagtaaaagagagaggagaaaaaagttagggtgcgaacaccatagggaagtccctaagccaaagccggggacaggggaatcctgtgtctcccggggaggggtctgctttagtgtccctgccatgctcagtcattagccaggagcacctcatggaaggaagcatatggattccccagcgcagcagctggggccctggttaattacactcccagtagagggaggtcgatgaggcccattctcagggccaccacatggtgagccatgcagcagtggcctggcagaacatttgtctgggttcatacagtatttacattaaaaaaaatcagggctgggtgctgtggctcacacctgtaactccagcattctgggaggccaaggcaggcagatcacttgagattaggagctggagaccagcgtggccaacaagggggaaacctcatctctactaaaaatacaaaaattagctgggtatggtggtgcacccctgtaatcccagctacttaggaggctgaggcaggagaatttcttgaatgtgggaggaggaggctgcagtgagctgcgatcatgccactgcactccagcctgggcaacagagtgagactcttgtctcaaaaaaaaaaaaaaaaatcagttgccagcattcaacaaactgtgtattttacatctttaaaaacccctggatttcctgcttctctttaaaaaatagtggcagtttggcaacattgggagtccattccacaaatcttgcaaaattgagtcctcgctgcctccttagataaggtgtgtgctctctagtttgccacagtctccaccagacccagttgccctaatctgtactcttcactcatttgtgttacttgtctgcccatgtgtgcatttaagtttgcaacccttgccttaaattcatctgagaaacaaactatggcagtcaggttcagccatagaatctaatgggaaggagcaaagctggagattgagcgactaagctagaggttgataaagcaggaatagagcaggtagctggagtctgagcagacagacttcagggcttgtctgccttcctaagagctcctttgctggctgggtgaagtcactgagaacctaagcagagggtgtcagttctagccttcctggagaaatcttagttgagatggatgtttagagctggtggacactgcctttgtgtcaagccagtctaggagtcacagcaatatttggacactggttgaaagttgttccattccatcccacttgctcagcaatttggacaagtgtgggtttaggttattttaattggttaatacccttttgtttaggtgctctcctttcctcttccacatggttcagtaaggctgccaattctagagctctttcttctcctatgaaagtcatggatgtcttaggctgggttttcccagaggcagatcctgtgatgaggatttccatgtaatggtttatttgtagggtgactctgggaagcaccagtaggagaatgggagtgtattagtcagggttctttagagaagtagaaccaatagaatagcacacacacatacacacacacatatgcatatacatacacacacacacacacacacacatatataagcatatggggaatccatatgcttccttccatgaggtgctcctggctaatgactgagcatggcagggacactaaagcagacctctccccaggagacacaggattcccctgtccccagctttggcttagagacttctctatggtccatatatatatatatatatatatatatatgtgtgtgtgtgtgtgtgtgtgtgtgtgtatacacacatatacatgtgtgtatatatacacacatatacatgtgtgtatatatacacacatgtatatgtacacacacatatgtgtgtgtatgtgtgtatatatatatatacacatacatatatgtatctatatgcacttttatatacatacattcacatacatatatgtatctatatgcacttttatatatatgtgtgtgtgtgtgtgtatgcaattatggaggctgacaagtcctaagatctgcaggatgagtcagtaagctggagacccaggagacccagtggtgtagttccagtctgaaaaccagcaggcttgagatccagaaagagccgtgtttcagtttgagtctaaaggcaggaaaattttgacgtttcagcttgaaggccctcaggcaggaggagatctctctgactcaggcaagggttggccttttgttctatttagaccttcaactgattggatgaggaccatgcacatctggagtgcaacctgctttcctccgtctacccatttaaatgttaatctcgtctgaaaacaccttcacgggaacacccagaataatgttttaccaattatctgggcactcagcgtcccagtcaggttgacacataaaattaaccatcacagggcaaaatgagacaaggaaatctaaaccagaatagagcaaggtaatgagtaagttacttctatgggcagccggggcttggtccttttgatgggctttggttgatggcatggaacacacctcaaattgtcccacctgagtgttgagaaaactgagatatttatctttcatcactcatctgacattgaccaagggatgctctcagggactttgacatccttgaacttctggcctgtcttgccgaggccaagaaaaggccttcaggtggggagttgcaggtgcttgcagagggatgccttcagcttgtatgggatggggagggtccaagggacatgggtggccattgccagtgtctgctatggttggtaagtggcacatatctggtcaaacatcaggatctatccacccagcagtgttggaccttggagtggcacaggcatcagaatcttccctggggattaacttattgtggttcttgaacagagaggatatatatctggaggtgccagcctctacttgccctcccacatggagagagatggagaataaggctgagcaaagacaaacagtgaagagaaatggagacagagagagggagagagagagtgagagagagagagagagacagagagagagagagagagagagacagagacagagagagagagagagagagagagagagagagagagtatacatgtactttgaggcagtgagtcctgtttctagtccctggggctctggttcttttctcttcctgtcttagtctgtttttgctgctgtaacaaaatacccaagactagataacttataaaggacagaaacttatttctcaccgttctggaggctgaggagtccagggtcaaggcacaggcacattttgtgtctggtaaggggctctgttccttgcttctaaggtggtaccttgtgtcctctggagggcatgaatgctgtatcctcatatgtggaagttggaagggcaaaagggcctaagttagttccctctacccctttataaggcatgaattcattccttaagggccaagccctcctgactgaatcacttcctaaaaggcctcacctcttaataccactgcaatgaggattaagtttcaacatgaattttggaggagacacgttcaaaccttagcattccctttccgtaaatgacctcagctggataaaccagtatattcgtttcttgattaatttagccagagttagatttctgggcatgcaaccaaaagctcttactaacagttattgtggtgggatagggatgaggggaagggagattgggattgagagagagattgccctgggcctaagagctttctctccttattacatcccagtgcctgagatttaagttgctagaaggaagatgagtttatggtggaaatttgtaaccgaccattaactagaatggcgcagctaagcccctgtgcctgaccaattgttaggacttaaagaaatagcaataaagaaagagcttttagtttcagagcttaattagccattcttttccttcctgacttttagttttatgactctagcttccaggatagaattttattgtagtcagatacaaattaaacccaaacaaggactctcccgtgtttctgtttcttcaatttaaatttattctttgtagggtgacactaagtaccacagtatatgtcacatgtaagaacagtaaatttttaaaaaagagagacagggcaagcatttatcattgtgatctcttctctaaacataatgggaacttaggttaattaaaaaaaaaagttaatgccgttgttttttgccttaagaaaggtagggtttttatctgaagtgctctgagaattggcactcttaaatctgcaatgatgagaaataacagtagctaccatttgttgaaaatctattagtagtatgctaggtccttaaccttcagtatctctaattaccccaagacacttgaaggatggatggtctaaagtttccatgtgtgcaaaatgatagctctgagaagacttaaccaatgtttcaaagatttaaaaaaaaaaaaaaaggaattggagccagtttgcattaagaccttttgaactccaaaaaatctatctatgtgcttccgacttgaaaagggtatgttttgcatgctggatatgggtttggtggaggtgctggtgtatacactgtatgtttcaatgctagacatcgtgctgggtactggacttagtaggcacctgatcgcatttctgttcggcaaattcagaaaatgtgagtgactgaaacttcattaggttgaaggggaatttaccttttcactacgtctgagcaaagggtttattcggtaaggtatatttatattatattatattatattatattatattatattatattatattagtgccccatggaaattatatttgtttctctacagataacaaagattcttatttctctcttaaaattcaaaataaagagccttactgacatctaccataaatcctctgctgtaaccaggtagagtataaataactccataaaaagagagtaatgctgtcttgcgtttgcacagcactttacagtttagaaagtatttgcttgccatgtccctttcgatcctcctgataggcttgcggggtaggaaggagaggtactgtcatttccatcttcctggtgggaaacaaacatttggagaagttgggtgacttgccccaaggtgacacaatagtgaagggttcaaaccaggacttagttagtttgggtgtcagaatgggtcagagtgggtttgtcttagttagtttgggctgtgtattagtctcttcttgcattgttataaagaaatacctgagactgggtaatttataaagaaaagaggtttaattggctcacagttttgcaggctgtacaggaagcatagctgaggaagcctcaggaaacttacaatcatggcagaaggtgaaagggaagctggcatgtcctacatagctggagtaggaggaagagagcaaaggggaaagtgctacacacttttaaacaaccagatcttgtgagaactcactcactgtcatgagaacagcaaggggcaagtctgtccccgtgatccaatccccttcccccaggcccctcctccaacactggggattacgattcaacacgagatttgggcggggacacaaatccgaaccatatcaggctgcaataacaaaatagtataaactggatggcttaagcaacagaaatctatttctcacagttttggaggctgagaagtgccacaatctggctgatgtagctcccagcggaccctcctcctggcttgcagaaagctgctttctctctgcattctcacatgacggaggaagtggggggtggggggagcggaggtagagagggagagagagagggagggagggaagaggagagacagagcaagagagcaagccgtctggtgtcttttcttgtaaggatgctaattccatcacgaagacctcatcctcatgatctcatctaaactaatagtcttccaaaaaagcccacctcctaataccaacataatggaagttaaggcttcaacatatcaattttgaggggacacagttcagtccattggacttagagttcacacttcctggacaagattttggaacgttgtaaagctttcttcagaaaaacaactagtttattttcccccaagcatttatagcccactttagcagcactcaactgcatgcctctgatctatatgctaattttggatccgccttatctcttaagtaatccaagagtttgtgtgtgtgtggatgctccttgatttgaaatccttatgtgcttagaactaatggcgttgtaaaacacactccacaatgtacccttctctaattcagcctgattttctcccatccctccacgttagccgggctcccatgcccctgtttttgatcacgattgattgtccagctccaaagcatcatctgaacgacttatggtctttctcccgagtgttggagcccagggtaggcagatgggagagggtaggggatttgaaccggagaaagacatttaaatttcctcctgttcatcttagcttaggaagttacctgctgtctgaagggtgtatccctattttattatttatttatttttacaaaaccaagggaaaccagcaacgaaacgcaagaggagctcctctgcctctgattccagtagctgtgctctcaggttggagcagccaacccagaaattggtggccagtggctagggtcaggatgagcagagtgaacgcgagttctatgtctgattataaaaactgtacttgctccttatggagaatttgaaatctagggaaattataaaaatgtaaagtgttatcagtcctttgtcagccattgggctggttggttggtcagaagtcatcactgttatagaccctcattgcttaatgaaaattaatttgtcaagcgatttccttgatgatgctaatatttattgaaaggttaccctaggctgagttctggctaacagctatatatatgtatacttttattttccaagtgaagaaacaggctcagagagggtaagaacttactcacagtcacacagcaactgagtggggcggctagaatttgggttcagatagtcagacgttagagttcaggtttttcatcccttcaacatctacacatttttcaagaaataacaagattcacttttggtttgaagaggagtgcatgggagagaaagaaaagtaccaaatgggaaaaagagagagcaaggaaaccaaactccgtttgtggtcgtgagctacattaaaaaaaaaaaaaaaaaaaaaaagccaggccagggacaatggctggattatgcctgtaatcctgccactttgggaggccaaggcaggaggatcacttgaggtcagaagtttgagaccagcctgggtaatatagcgagaccccatctctacaattcttttctttttcttttttttctttttttgaattagcaaggcgtgctggtgtgcacctgtagccacagctactggggaggctgaagcaggaggatcgcttgagcccaggagttcaaggctgcagtgagctatgatcccaccactgcactccagcctgagcaacagagtgagactctctctgaaaaaacaacaacaacaaaaacaaaaacaaagcaaagctggtggtttcacatgagtgttgctccttctggaaaggcatcactggagtgggtgccatattttgatgctgctgctgccaatgatgagaacatgggcaacctcttttgcctgtaattttttttttttttttgagacagtctcactctgtcacccaggctggagtgcagtagtgcattctcagctcactgcaacctccgcctcctgggttcaagcgattctcctgcctcagcctcccgagtagctgggattacagccgcctgcatccacacccagctaatttttgtatttttagtagagatgggattttgccatgttggtgaggctggtctcgaactcctgacctcgtgatccgcccgcctcggccttccaaagtgctgggattacaggcgtgagccaccgtgcccggccaagagagacttttctacactttgtaattatgttatttttaaactgaaaactatatttcctatttcttagtgttagaaagaaagagaaatccctgagaacaatcagcagcctggagcatagtttgagactcccactaacagagccaagagtctcaaactaggccaacagatacccttggggaaccctgctgtatccctgggacataaaaaactacagtacaaacatcatcatcttcctggaggatgaataaactttagtagagtaatagtaacttaaaacacatgtggcacaaaatagaacgcagagttcacaaatacctaaggtaaaataagacttcaaagaaaatttcacccttgcagaggttattttgggctacactccacagagtatgaattcattctcttttcctctcagggatagtttgttaagagtctgaaaaccactgctctgggcaaactgccctccggagtcacacacaaaaaatcaatctcgttactaaagataaattttatttcaataaaaattgtaatgagcttgatcacctacccttttcacctgacttggctacaaatgactgccaactgtttaaaaaaaaaaatccaaccgaccctcagagctaatatgctattacttttaaagattacagacaggccaggcgtggtggctcacgcctgtaatcccagcactctgggaggccaagttcctatttcttagtgttagaaagaaagagagagaaatccctcagaacaatcagcagcctggagcatagtttgagactcccactaacagagccaagagtctcaaactaggccaacaggcacccttggggaactctgctgaggctgaggcaggagaattcccggaacccgggaggcggaggttgcagtgagctgagatcgcgccattgcacttcagcctgggcagcgagagcgagactcggtctcaaaaaaataaaaaaataaaaaagcctctcttgtgtccttgtccccagccttccagctctcctctgagggaaccagttttcaagatggcccgcaacaatccctgcctgctgccattcacaccttgtttagtcccctcccacgctggaaagatccatgttggggctcgtgtgtgaccaatgccgcagaagtgatgttatgtcacttccgcgattacgtcatgaaagactgcagcttccattgttggctctttctttctctttcttggatcagtcgctttggaggaagccagctgccatgttttgaggacactaaggcactttacggagaggcccacgtggtgaggaattgaggtttctaagagccagtaaggaatagagacaaccacacagtgagcctggaagcctagtcttcagccccagaaacgctcagatgactgcagtcctggctgacatcttacctgcagcctcattggagaccctaagccagagcacttagctgagttggcttgtgggttccaaatccagacaattagatgataaatgcttgttgttttatatttagttttagtttttgtgactacatcgtaggtgtatatatttatgggttacgtgagatattataggcatgcaatgtgtaattatcacatcaggctaaatggggtatccatcatctcaagcgttttcctttgtgttacaatctaattattctcttttagttattctaaaatgtacgattaaattgtttttgattatagtcaccccattgtgctagcaaatagtaggtcttattcattctttttttttttttttttgagatggagtcttgctctgtcgcccaggctggagtgcagtggtgcgatcttggctcactgcaacctctgcctcccaggttccaggaattctcctgcctcagcctcctgggtagctgggactacaggcgcctgtcaccacgcccggctaacttttgtattttttagtagagacggggtttcaccatattgaccgggctggtctcgaagtcctgacctcgtgatccacccaccttggcctcccaaagtgttgggattacaggagtaagccaccgcgcccggccttattcattctttctaactatttttttgtactatcatggttcactgcagcctcattttgacctcctgggctcaaattgatcctcccaccccagcctcctgagtagctgggactgtatgcacatgccaccatacctaggtaatttttaaagattcttttatagagatggggtcttcttatgttgcccaggctcgtctcaaactcctgggctcaagtgatcctcccgcctctgcttcccaaagtgctgggataacaggcgtgagccactgcacccagtcgatggcgtgtattaaaaggaatgatgatataaatactgatgactaacatttattgagtgttttttccatgtcaggcattatatcaagcactttacatgcatatctcatcagtaaaacatttgcatttttatttcttatcactagtaaatccttctcctcccagaagcatttaaaaatccacaaaccatggctaacttcctgtgaaatggcttagtgggcaaaaattcagaataaggggagtgtgagtccatgtctcctttccagagatgaagaagtttctcttttctgtgcatgaagaagacaatgggatatggatgacactaaacctttgaaagttcctgctaacctccaggtggaaggaaagggcccacggtgatcaataaatgtgtttgctattttttgggtgaaaggaagagagcctgcacctctgttggggtaggttatccacgctgtctgcctggggtccagattcctggcattgatatgacttcttggctctcttgagccctgaatctgcttcaaattcagaaagccccaagacttctgggctctataattactctgggctttggagaatggtttctcttatgagcaaaacaatggtggaaacttgtaccaatgaaggaaacacacaagcgtgtagaggaacattgctgtttgctgatgatgctggtggctgcttgggtgagagataaactctccaaagagcgttggcccttttgtggctgcaggatctgggtgaaagagattcttgtagtctatcctatcactagatactatctgtcttagtccattttgtgctgctataacagaataccacagaccaggtaatttacaatgaatagaaatttacttgggtcacagtcctggaggctgggaagtccgaggttgagagcttacatctggtgaaggccttcttgctgcatcatggtgtgacccaaggcatcacatgggtgagagagagggtgagagagagcacctactcctgtgaaaaccagcccgctcccatgataaaggcattaatccattcagaaagatgatgtccccatgatccaaacacctcttgaaggcctcacctctcaacacggttgcatcagggattaagtttccagcacttgaactttggggaacacatgcaaaccatagcaatatctgtgccggatattttgtatttgctcctttacatccactgtccacccccatttcctgctttgtaccccaggaggctgacttctatggactacatcacatgtggtctcccatcctcttgtggctgcttgggtttggccaatggggtggggatcatagaatactagaaggtgggaggagagagggattcggatatttatttctgtggctccttcctgttgggttgccataggttggaagctcctgccaggcagctgtctttccctgaagactgtggctactctccttgggttccataactatttctcctccaggtctaggggtagaaatggctcctcactgctgctagttagggctactgcaacctccctttttgtttttgttttttttaatcccacttatacagctatatatagccctttgctaaactctttttagttaccccatttgagtttactatgtatttcctgccacaaccttgattgatacagcagcccagagaagggaagcaattaactttctcactcctttattcattcatccaacctcccatcaacacttactctatgccaggacttgtgctgaggcttttaagaatgagacatgatttcttgtctatgtccctgagttctcagttgttcaccccagaaactgactcttaccaaagaaagagaacatgccgaaggcattgctgaaggcccagccttggaaaacaccccatacaaggtgactccagatagctttatagcggcaactcctccaagggcatgcgttagggataggctgatctggggacccctgctctccctgcagagaattcatggaaacccaatagggcctgtgttcttgcatcatgagtcaaggtgccaagagagatcacctgattggctgatccagagtcacacggttgggggagggtatacaaagtggagggctcaccacagcggtcagagataaggctgctccttgcagctctgttttttgcaattcctcttggaccctccccagttcggccaccacccttgaggctagcaagggtgagttgtgtcagaagcattccatgcaaggaaataacaacttggaatccaaatatattcattagtaagtaatggaaacctgaaattgcttaaacaagatgggacattattctctcacattaaaaggaatttgggggtaggtgagtctagggttggtttattcagtagttcagttgtatcatcaaagacctgggctcttgccatctttgtgctctgacttacagagcaagggcttaattccagtcttttcctctaatgagcacaaaatgggtgccacagtgccttacatcacatcctaacacaataacgttcaatgtccaaaggtcagaggagaaaatgtgtcttccttgtgtccattgttgacagcaaggaggaaatttccatcaactctcattggtcacaatgggtcacgtgcctattcgaaagcaatcactagacagggggtcagtattactatgattagtttaggtcagtcaagattcactccttgaggctcagaagggcaacttctcctaaagcatgtgactgttcaatactttaaaaattggggttctcttagcaacggagaagagaggctctttttttgacaagcaatcgtagcatctatcaaagcataagaaaagcttgtgagtgatgaggttggagactgagaaggttccagaacatgacattctggtgaagtaggcaggacccaggaatctcaaaagtgacccaatgtcacagagtctgttggtggcagaggaattgaggcatctagaggcatctaggcagagtgattgaggcatctcactttctacgcagaaaaggaggcatttgctccacaaaagcctcctgctaattccagggacctttcgctgtagagacaactttatggcatcagtgacaactttggcctcattgtcctgacagagcctagaatggtgctatctttgggcttcatatctgtgaggcactcagaaatgtatgaagcatttccaagtccatggtctcatttgctctccactttgcagtggggaaactgaggttcagacaggtgaagagacccgatcaaggtcacatagctggagagcaggaaacactgagctcaaccccagatattttaaccaaaggttttagttctctgccttcctgccttctagataactccatacagtctgcagggtagatcctcaatcatgatgtatgaaaagcgtgaatgaatgcaaaaaaaaaaaaaaaaggtttaaaaaagctgtgcaagctgggcacagtggctcacacctgtaatctcagcaatttgggaggccaaggtgggagaatgtcttgaggccaggagtttgagactagcctgggcaacatagtgagactccttttctataaaaaatttaaaaattagctgggtatggtggtgtgcatctgtagtcccagctacttggaaggcctaggtgggaggatcacttgagcccaggagttcaagaccagcctgagcaacctagggagagcccgtctctacaaaaactaatataaattagcaaggtgtggaagtgcatttctgtaatcccatctacttgggaggctgaggtgggaggattgcttgggcacaggaggtcgaggctgcagtgagctgtgatcacacaactgcacttccagcctgggtgacagagtgagaccctgtctcaaaaaataaaaaagttgtgcaaagataaaaacccagttatgactcccattgtggacccataaataaagcaaagttatcaaatagagatgtgtgagctgctgaatggaacagaactcactgggtttatggggctgtgtcaggcacctctgacaatgccagatatttactttgcagatgaatgacttcattgcttgccccaaatgcatcactggtgggtaatatttatgcagattggaagcattctccctcctttatatggtcctgggctgtttgtaaccattggatttttttaccttttgacttgacgttgttcttcacgggaccgtggtatgggatgcatttcaataaacaataccaaaggacagatttcggctttaaataaaattgtgttccgtaaagtgggagacaaaggcttataactcactgtcggctgcagacattttggcaaaaattatctttcaggctttgatctccactgtatcattttactgagtggccccatgtgctctatcaatcaaacccactgaagatgcaggagaatcacatttaaaatcaaatacaaattgtagattcatctgcccaggaggaagagaaatgtgtcatgaatcctgccttcagtcttctatgattacaacggaattagtttttgaaaactccagaggatggttttccacttcccaactttcatattattattattatttttgaagggggtaacattagatgggtagagaggtagactaaagtgattcagctgtgagatcggagtctcgccttccatctaactgtaggttagggccttttaatattcctctgacagagattctttatgtaggaagggatgttaagaagaaagatgttctctaacaagaaaacatttagacaaagaggatatgacctccctcactcaatctcgcctgctttcttggcatacatgggaagagaggatgaactagaaaggaaatattatttgctgatctcctttctttgtctgaggcacattgcacaggatgtctcatttgatattcacatgcccatgtgaggtgaacaatccacaccatgctttacagaaggggaaactgaggtcaagaaacatgctcatgggccgggcgcggtggctcacacttgtaatcccagcactttgggaggctgaggtgggcggatcatgaggtacagcattcgagaccagcctggccaacatggtgaaaccctgtctctactaaaaatacaaacattaggccaggtgtggtggcatgcacctgtaatcccagttactcgggaagctgagacaggagaatcgaatgaacccggaaggcaggaggttgcagtgagctgagattgcaccattgcactccagcctgggcaaaaagagcgaaactccatctcaaaaaaaaaaaaaaaagaaagaaaaacaaatattagccgaacatcgtggcacgtgcctgtaatcccagctactcaggaagctgaggtaggagaatcgcttgacctcacgaggtggaggttgcagtcagccaagattgtgccactgcactccaacctgggtgacagagcaaggctctgtgtcaacaaaaaaaaaaaaaaaaaagaaaaagagaaaagaaacatgcttatggctgaagagctgagcccaagtctatgtgattctgaataacatgcttttaatttaattaattaattaatttacttatttatttatttgagacagggtctcactctgtctcccaggctgcagtgccattgcaccatcatggcttggctcactgcagccttgacctcctgggctcaagtgatcctcccacctcagcctcccaactacctgggactacaggcacacactgccatgctcaactaatttttttttttgtttttttgcattttttgaggagacggggtcttactatgttgcctaggctggtcttggactcctgcattcaattgaccctcctgccgcgacctcccaaagtactgggattataggctttagccactgtgcccagcctaaaacttttgagaaagaatgcttcttgttgattgtctcccctctctattaccttagtgtctggcatatagtaggtgcttgaaagcacttgtttagtgcctaagccaggggctgacaaccttactgtaaaggcccagatagtggattatttgaggctttgggggccatgtgctctcttgcaaccatgcaaccctgccgttgtagtgcaaaagcagccacagacaatactttatttataaactctgaaattggaatttcatataattgtcatgtaatgacgtattattccttttgtctttttcccactaactatttaaaatgtaagaactagctgggcgcagtggctcatgcctgtaatcccagtactttgggaggccgaggtgggcggatgacctgaggtcaggagttcgagaccagcctggacaacatggtaaagccctgtctctactaaaaatacaaaaattagctgggtgtggtggcaggtgcctgtaattccagctactcaggaggctgaggcagtagaatcgcttgaacctggcaggcagatgttgcagtgagctgagatggtgccactgcactccagcctgggcgacagagcgagactccatctcaaaataataataataataataataataataatataaaatgtaagaaccattctttcttagctttcaggccataggaaaacaggcagctcggatttggccttcaggctgtattttgcagattcctggtctaaataattaccttaattatcacagtagcagatactagcagatactaagaactagtgtatctccaaagtctagtttggtgcccggtacaaacattctttccccaaggtggagtccacttgaccagagtggagagttacagtgctggggaagagttggaagacatcgctgcctgggggtgggggaagggcagagaaatctcttggggtttgttctggggaaactgggaattgtgggagaactgaggaggcgggaaaggggactttaagaatattattgtgggccaggcgtggtggctcacgcctgtaatcccagcactttggaggctgaggcgggcagatcacgaggtcagtagatcgagaccatcctggctaacacagtgaaaccccgtctctactaaaaatacaaaaaagtagccggccatggtggcggatgcctgtagtcccagctactcgggaggctgaggcaggagaatggcgtgaacctgggaggcggagcttgcagtgagctgaggtcgcaccactgcactccagcccgggcgacagcgagactctgtctcaaaaaaaaaaaaaagagtattattgcaggttaggaattggaccttttattacagaggttctcactggggactgaattgtcccatgtgtgtgtgtttgtgtgtgtgtgtgtgtttgtgtgtgtgtgtgtgtgtctgtgtgtgtgtgtgtgtttgtgtgtgtgtgtttgtgtgtgtgtgtgtttgtgtgtgtgtgtgtgtgtgtgtttgtgtgtgtgtgttttaaatctgcagagagcttttggttgccctaatgatagggatgggggagtcattacggtgtggggtagttttttgaatatatatatgtgtagatcccaaattcatatgggttagaagaaccatgattatcagagtctataaccttgttctatttttttttttttttttgaaacagagtctcactctgtcacccaggctggagtgcagtggtgccatctcggctcactgcaacctctgcctccccggttccagcgattctcctgcctcagcctcccgagtagctgggactacaggcgggtactaccacgtccagctaatttttgtatttttagtagagacggagtttcaccctgttggccaggatggtcttgctctcttgatcttgtgatcggcccacctcggcctcccaaagtgctaggattacaggtgtgagccaccacgcccggtccaaccttcttctattttatctgcctattctattttatatgtttacatgttctattttacatgtaagtgttgaatgaacactgatgtttccaagaatgtagcagctatggtgtaaatcaagagaagatttgactctgtttggtatgggaatttatcaagaaagagccactcttttgaagaacatggcactctcagtaaagccgatgcgacaacacaccacgctgtctgcgtttgtgactgtcactggttattctacacacacgtgtgtgagcacttgactgcttcgctccgtctttcctggtggaaacccaaatcatttctctatatattatttcattagaaatcctcatcatttcatttctcctttttattataattagggcacaattgtgattggttagaagagtagatgggttataggatcagcacattttttttttttcagggtagaaaagagagcttttcagctgggcatggtggctcacgcctataatcccagcactttgggaggctgaggctggtggatcatttgaggtcaggagttcgagaccagcctggccaacatggtgaaaccctgtctctaccaaaaatacaaaaaaaacaatgtaccgggcatggtggcacgcatctgtaatcccagctactcgggaggctgaggcacgagaatcgcttgaactcaggaggtggaggttgcaatgagccaagatcccaccactgccctccagcctggactatagagtgagaccctgtctcaaaaaaaaaagagggcttttcaattggttggttaaaacatgggacattggatctgatggcaccaagaatgcctgccctgtaacactgtttgagctgatgtgtggggaactgcttttggattacttatgggttgctgaaatatacttctttgaatgcagagattgggcccctgattatatttgggaggcaaaaccatcaccttgtaggcacctggcagggtaaaataaatggatgcttcttagaggccaactgctctctcacttcctgtttccgttttgtttgcagcgtaaagccagatgccttttatctcttgtatcagtgctggttgtctgagaatttttttttttttttttggacagagtctcgctctgtcacccaggctggagtgcagtggcgcagtcttggctcaccgcaacctctgcctcttgggttcaagtgattctcctgcctcagcctcccaagtagctgggattacaggtgtccaccaccatgttcagctaatttttgtgtttttagtagagatgggatttcaccatgttggcctggctggtctcaaactcccgacctcaggtgattcacctgtcttggcctcccaaagagctgggattacaggtgtgcaccaccacacccagctaatttttgtatttttagtagagatgaggtttcaccatgttgtccaggctggtcttgaactcctgatctcaaatgatctgcctgcctcagcttcccaaagtgctgagattacaggcatgagccaccatgcctggcctgggcagagtttttaaaaatgcttcaaactctcctttagctcagtttcggtagagtcattcctttacagtatagttacagtggagctgccaatcagctcaggccacacccagcccacagtctcagaggggctgggtccctgctctttctctctccctgaaaagtggctgttaattttctcctttagtctcctttccccagaaagatatttccctttaccttatgggagtttgataaaactggcatctccagccttcttttccttatgttggtttttctgccacaaaaggcccagagacattgtctatggaacgtttggctgcagctgggcaggtgttttattctattggaaaattccactaggattttctatgattacaatagagcatgggtcctcagtcaaaccctccaccacttataagaagctctgtgactttggggaagtgacttaacctctctgagcctcactttttctatttggaaagagtgatgggttggtaggttttatgtgttaactcttagggatacagggtgcacagctatttgcctaaacatcattttgggtgtgttcgtgagggcgttttgggatgactgtcatttaaattggcagattgagggaagcagttgcccctcctaatgtgggtggacttcatccaatccacggaagacctgaatagagcaaaagtcggtcctttccgaagtaagagagaattcctcctgcctgaaggtttttaaactgcaccattggcttttttctgcctttgtactcagactgaaacactgctctttccgggtttcgagcctgctggccttaggactggaactaacaccatcagttctctggggtctccagtttgctgcctcgccctgcagatgacagcacttgttagcctccataattgcgtgaaatctctttctctgtttagacattggttctgtttctctggaaaaccccagtcaatacaggcggtgatcatattttgaggattaaatgatacaatgaatagaatatgcttaacacacagtgagtgcttggcacatatgatctcctcaatacacatcagctttatcatggaaattattatgtatcattatacaaaatataataagatttcaaacttgtgttctcttacatgtcctctaaattattcaatggaacaaaaaactcttcactcatttttgtgtgtatgcaaacttaatgtctttcaataaattttccaagttattgtatgttcgcaaggacataattctgtttgacttcccatctttccaatactagtagtgagcctcattagcacatgaatgctggtgtctgtgagatgtgcttgccttcactgtcctgtttgccttgcccaaggtgggcgatggaaaggacaagccatctattattggttggaggaaggaccaaccatctactgtggcagtctgctcaggctgccatacaaaataccacatactacgtggcttaaacaggagacatttattgttcactattctgggggctgggaattcgaagatcaaggtgctgggtgatttgtttctccagtgagggccctctttgtggctttcagttggaagccttcttgttgtatcctcacaggggagagagagagcacgcaagcatgagagagtgcaagagagagagggagagatcaagcaagagtgagagacagagaaagacatctctggtgtctcttctaatatggacacatcacatctccaggaccttaggcttatgatctcatctaaacataatcaccaaagccgcatcttcaaatacccaaataccgtaacactggtaattagggtgtcagcttcgacatatcagtttgggggtggaggcacaaacgttcatttcatagcacttccttttccaaaaatgctccttaatccctccctgccatccttgctattctcatttgacagatgaggaaattaagactccacgatgtgccttaggttgcccatagctgtacatcttataagtgcgagctccccagataattgcattcatccacaagagcagagttaaccacagcatcatagccatccagggagcataatgccccgttaaaaataacaaagcgtagagacccagcctgaactgaagatgtgtctgtggttggggttcagggttctttgatttccagatctaccacccagatatttgtcaagttacatctacctctggtgctcatttccatatctctaaaacagaaataataactgagaggattttgtggcgtcatgcagatgaagtggctctcaagagcctgacttagtaaacgttggctgcgtgttgggcattattagctaagatgtataaacagcagaggtttggtttgtatgagtagatcatattcctgcctgttgtcactgagggagagcagagtcctaaggggaggggacacaggtcaggagaattctagggggtgggggatgtttctgatttctcaacaatgggtaaatctgggaatctcatgagagcttcagtgggtaaatcttggaatctcgtgagcaaaatgtggacgtgaagaaggaagaaaagctgcttggaggattggtgaaggaggagggaaagggaaaaataaaaggaaaaaaacatttaggtggtgctaagtgccacacattttccgtttttgcatcagtgaattgtaaaatcacactgcaaggctggggatattatccccattttacagatgagagagaggaggctgggcaagttaatgaactggttcaaagtatcacagctagagagttggagccaaagtgagatcgcacagctacgcagactctaaagcccttgtctgtatattgaatcaaatttcccctttttctggcttaggtaaactgaggcaggaagtgatgagaaagggttaagagacgtcggctgctccttaaacatctcccttcccagtgtcatttgccatccataaactctttcaaaatgtgataatggttttgattttcctgtcatctcgatttgatatgagaaatttgggatttccaaattgacagaaaactcgattttaaagatgctggaaggcaaacatctgtgaaaaatcacaggaataatgtcaacatctgtccctgtgaaaggaaattgctgaggttctcaatttacagccaatcaatcaatcttggaggccagggtgcttgcaaattgaaatgcatgttgaagctatagggatggctaattaatttagtttgtatgcctataagatttttcattgtttccagttaaaaaaaaattctcttttgaatagaaaacgtgtgcatatggtaaaaaaaaaaaaaaaattaaacagtaccagaaaaagtatacagtgaaaattaagtttgttttccatcccaaccaccagttcttcttctccaaggtcacaagtgttgctggcttctcttgaaagtttccagagatacaatctttatatagaaaaacatatgtatatatgtctcctcccggttttataaatgatagcccattgtacatattacactgcatcttgacttcattcaacaatatatctttgaggtttttgcatagcagtccatatagacattccttattctttttatcagctgtgtagtattccagtatacggatgtgtataaattaatcagttccctcatggtggacattcaggatattttctgtcattctccacaatttatgctagtatgtccatcttggtgtgtgttcatcagtaggatacaaatctagaggtgagcctcctgggcagatgggatgtgcatttaaagtatgatgccttcatgtaaagggaaggttttcttttcttttttcttattttattaagagacgggggtctcacgatgttgcccaggctggtcttgaactcctgggctctagcaatcctcctgcctcagccttccaaaatgctgggattacagacgtgggccaccgtgcctggccaggttttctttgttatcttggagggagcatcacccccgtcaaggagatcagattggtgaaggtgggatgctgtgtctgagagcttaatgactgttcacagatattgtggctgcccttctctaatgtacctgcttcttcaggcccaaaaggtggaaatgatgtttgtttcttacttctttggggctttgactgtgccattgagattttgtgctcagggataaactaccgtgtatttacagttacctcaacctgtgaggtttgatgcctctttctttctttctttctttctttctttctttctttctttctttctttctttctttctttctttctttttctttctgtctctttctttctttctttctttctttctttctttctttctttctttctttcttccttccttcctttctttctttcttctttcttttttccttcttctttctctttctttcctctttctctctctctttccctccctcccttccttccttcctccatccctcccttcctttcttgctttttttttttcttgctttgttacccaggctggagtgcagtggcatgatcatagctcactgcagccttgaacttctgggctcaagcaatcttcctgccttggccaccctgggattacaggtgtgaaccgtggcgcccagccttggccactttctttattctaaacttctttgttccatactttgcttcttttccctggatccatccccaccagcctcccttgtcactccagtgataggacactcagtcttgccaagtcaatgtaaacccagacccttctcatttaaaacctagtctctttggtaaacagtcaattcaggattctcacatcaatctgagttttaaatcttaattagttgaaagattttcatatctttatctttccactttggtcactggcttcgctgtgggtgctgcaccactcagacctctgtgcaggaccaccgaggccctctgtccccccagctgctgggagacctggctgctaacagctcatagcaaagtcctgcctctggcaagaaggcacctgtaggaagccacctagtgctgggaaatcctcctcccctcctaggcatcccataatcctggagggttacaaaggctctgtcccttgcccctctgtatgggagtgtattagtcagcgttctctagagggacagaactaatagtatagatgtatataaaaagcagagtttattaaggagtattgactcacacgatcaccaggtgaggtctcacaataggccatctccaagctgaggagcaaggaagccagtccaaatcccaaagcctcaaaagtagggacgctaacagtgcagccttcagtctgtggtcaaaggtccaagagtcccaaagctgaagaactcagagtccgacgttcgagggcaggaagcatccagcacgagagaaagatgaaggctggaagactcagccagtcaagcccttccatgctgctctgcctgcttatattctagctatgctggcagctgattagatggtgcccacccagattgagggtgggtctgcttttcctagtccactgactcaaatattaatcttttttggcaacaccctcacagacacatccagaaacaatactttgtatccttcaatccaattaagttgacactcagtattaaccatcacagggggtgtctcaggggtcctggcgactgttccacagtgccactcccctctctgcccaatgctgcttccttgctttccagcaggtgctcctcccagtaaaccccctgcacccagatctccatcccacagcttgtctctctagaaacctgacctatgacaggcttataaacaccacaacagggcatgggtatgggccaggagagctactcctctcatctgctgagggtcctaccccaggacccctggggagggatgaggtccctgttgttcatctgggtgatcatctaactcctgatgagcccaggagttagagaccggcctgggcaacgaagtgagaccccatctctccaaaaaaaaaaaaaaaagtcaaaaaattagccagatgtggtgcatgcccccagctacttgggaggctgagatgggaggatagcattagcccgggaggttgaggctgcagtgagctatgattgcaccactgctcttcatcctgggtggcagactgagaccctgtctcaaaaaagttgtcatggtcctatgacatttttttaggtcctatgcaggggtgcaggtggaggtggtttctggttctacctgactgtcttcgttcagcctggtccatttgttgactctgctacccagaagtgaaagaatatggcatctttctcatctctatatggtccccatgcagtaaggagttgactcagccggtctggggagttcaaatcctgcacattccaaagaaagctctggccgttgattggctcctgggagataaccgccaagtctttggaacattctgcctgataagagtgtctttgtttacctatggcctcaggctgagctagctagtccatgctaacaatgcaatttatggtgagtgcctgtttttgtatgtgtcagtttgacctctagaggggctggagactgagtaacaaaagtcacccatgcaggtgctccatgcctgggtgatgaaatgctgataaaacccctggacaccaaggcttgggggagctgctgtggctggcagtactttgtatacattgctaattgtctcttatagcttggctgtgtccccacccaaatctcatcttgaattgtagcccccacaattcctacgtgttgtgagagggacccagtgggaagtaattgaatcacaggagtggtttcccccatactgttttcatggcagtgaataagtctcacaagatctgatggttttataaggagaacccctttcacttggctctcattctctctttgccagccgccatgtaagacatccctttgctctcccttgctcttctgccatgattgtgaggcctccctagacacgtggaactgcgagtccattaaacctctttttttttttcataaattacccagtctcgggtgtgtctttatcagcagcatgaaaacagactaatacagagcattaggagctatccttctaactccactgggagaaaactactggaaacttacccctggtctctcttggagagacctatgcatcttgtaccttggttgattttaatctgtatccttttagtgcaataaacaatgttcatggggacaatggctttcctgattctgtgggtccttctggcaaatcaatgggcctgagggtggtcttggagatccctgacaaaagtcactgtagccagggaccatcttctgttgagcttatttcagaggaagatgtcataggtaacgggcgttgggggcaccctggttccatttgttgactctgctacccagaagtgaaagaatgtcgcatctttctcatctctgtatggtcccctgcagtaaagagttgactcaggaggtctggggagttcaaatcctgcacattcctaagaaaggtctggcccttcactggctcctggaagataaccactaagtctttgcagcattgtgcctgataagggtgtctttatttgcctttgttctagttcttgttctaggtgctggtgatagaactgtgaaccaaaggtcattgccttcaaggagtttatattcaagtggagaagatggaaaaccctcccctcacaaacaaacagactctgaaacctgataaataaatattagcattcagtgaagtgttaatgagtttctgtgagcacatacaatccttagcagagtttatctcatcctgcctgagctagcccctgcctccctccccagcccacatattttgccacacccttttcattcctcccaacattccaattccttcaacacatggaactccttctcaccccagggcctttgcacatgttactatctctgtataaatgcattcctctcacttgacacctggataactcctcattgtcctagtcttagcttaaatgtcatcatctggccaggcctgatggctgacacctgtaatcccagcactttgggaggcggaggtgggaggttcgcttgagcccaggagttacagaccagcctgggcaatgaagtgagaccccatctctaccaaaagaaaaaaaaaatcaaaaaattagctgcatgtggtgctgcatgcctgtagtcccagctacttaggatgttgaggtgggaggatcatgtgagcctggaaggtcgaggctgcagtgaactgtaattgcaccattgcacctcatcctgggtgacagagtgagactgtctcaaaaaaaaaaaaaattcatgaccttggggaagcccagttggatactctcctctttccccagaccagctggatctaccatcataggctgttatagcatgcatccaattctctctctctttctctcgctccttttttttttttttttttgtagagatgcagtctcactatattgccagggctggtcttgaattcctgggctcaagcaatcctcccacctcggcctcctaaagtgctgggattacaggtgtgagccaccatgcctggcctgttacctttcatttttatttcagtcatcattctgagtggctgagcatatggatgtgttgattgttgaaataaatcatttaggcaaattgttacgggccccatctaaattcagaatccagccatggatctggtctgtaattcttcccagccacactcttccctgttggagtccgagttctccactctagacctgcagcgggaagctttccagggaccagccagttccaccgcctccagagccacccctcacctgctgacctcttcctatgttagctgcccctctcgctgcctgctgcccttccccgggccagctgatacgagagctggcgataacttgaaatgctccccgcagaagataaatgagaggggaatctcagcaggcattgagctctgtacctaacgactggcagttggggcttctaattttaggcctgggaaggaagctgatttctgtgatgaaggtggccacacgctttatcaagggccaatttagcaaaaatctaaaatgtatatgaagccgtggtaagtctggattttcttggtatttatgctgggaggttacttaatgagcgtttgctgtgtgaccacattgcggtattaatcataggtggcattataattctctaaaataacagccataaggcatcagggcaattgaggcttgtattaagggaatggtccttttttttcttgctgaagttaggcagcatgaggctggtgtgtttttccttaaggcaccaaggcatctgaggttttgcactgggaatccctgggctctctgggccctctgggtccctagggtcttctacttgccaacacagccttgggttctctgcttcctgttggggtgacaggaacacattggtggtctctgatggatataccaggcgctctgcataatttttcttcttgcttccgggggtaactccagccccatcccttgaaggtgaattttatgttatatatatatttttttgcttaggcaagtttgatttgggttatattttcatcataaagaatcatgactattgcaaatcattatatagaaaagtgattttattcttgagcctgagatattcacagtgaaaatgacaacacattatttctgagacacctgctgggggcatccaccactttcccccaacccattctctctattcacctccaaccaattttatccaaaagccagctcagctgactgtacaaccacaagggatttggagttagatggatatggcatttatcagctgaatgatcttgggcataatactcaaaccttctgtgcctctgttttctcatctttaaacggggatagcacagggttggtgtgaggaataaatgagttattattgtcatagtaatatactaacatatagttaaatataattctatctgtcagatgtagacaggggtggagaatgccttggaagtcatttcttcctacagaataagtgatatggttttgctgtgtccccacccaaatctcatcttgaattctagctcccataattcccatgtgtcatgggagggacccagtgggagataattgaatcatgggggcagttcccccatactgttctcatggtagtaaataagtctgataagagctgatggttttataaggggtttccccttctgcttggctctcattctctcttgcctgctgccatgtaagatgtgccttttgtcttccgctatgactgtaaggcttccccagccatgtggaactgtgaatccattaaacctatttttccttataaattactcagtctggggtgtgggggtatgtctttatcagcgtgtgaaaatggtaccataaggaagtaccttaaggttagacaataagtacaataaggaaggaggaccgcaatccagtcttgtctcccagagccttggcacagaaagatggtaaccaatgctttgtcttggaaaatccctcctacctgctggggagacaaaggagcaaatccagcagaagatggaggggaagtgctggttgagttgcttggcaccccttgccttttttcaccctcttcctcagctccctgatcaccatactctccctgtgtcttttggctcctgagatcagttgttgatgaaatgctgggctgcgctcactcccagagtgggaggaaatggatgtgggaaccctcttggggagatgggcagttaccggggcccagagaaccaatgagggctttatcctgcagtcagagttcaacaccagcccttcccagaatcaatcacaccctcctttccactatttcactgtctgccgtgaactaacagacattggttgtgttgccctcagattcataggctgaagtctaacccccaatgtgatggtatcaggaggtgaggcctttggaaagtaatgagatcatgagggtggagccctcatgaataggattagtgcccttgtaagaagagatatgagagagatgatacccgtctctccaccacatgaggacacagtgagaaggcagccatctgcaagccaggagagagtcctcaccagaccctgaccatgccagcaccctgatctcagacttcccagcctccagaactgtgagaaataaattgctgttgtttaagcttcacagtctattataatttgttatagcagctcaagctaactaagacactaccctgacactctatttcagaaatgacaaggtttgggctgggtgtggtggctcattcctgtaatcccagcactttgggaggccaaggtgggtggatcacctgaggccaggagttcaagaccagcctggccaacatggtgaaaccctgtctttactaaaaatataaaaattagcaaggtgtggtggtgcacacctgtaatcccagtactctggaggttgaggcaggagaatcacttgaaccttggagacggaagttgcagtgagccgagatcataccacttgtactccagcctgggtgacagagtgagactgtctcaaaaaaaaaaaaaaaaaaaaaaagatgagatttgacttcacaaactaaaacttttgttcagagagaagaggaaaagggagggtgggggaaaccacccatgctcccaaagatatgagacgtagaattgatctaagtgccacaaagcagaatttttctgactccattctgtttctcctgtgataattcagctgctttcaaattcctctcctctcagacggtcctgagaatccagtgggagttttctctgtgctccagaacatagtggcctcttgcattcattccctaccagaaataatgtctcattcaccagctattttctcagccaataatttttgtccacccccattcctccttcagaaacttgcccttcccagagccctaggagacccagaaccccataggattcttttggctctggccatggctgtgtaccaaggggttggatatgggattacagccaggccatgtggactctctcccagaaatttggagttgaaaatctctgagcttatctctggaaggtgcttgaaactagagggggatagaaagttggtgacaatatagtcatgtttggcctgtggacaattgcaatagaaaaaactgatatgcagggtgatatggtttggctgtgtccccacctaaatctcaaattgtagctcccataatttccacatgtcatcggagggacatggtgggaggtaattgaatcgtggggcgggtttttcccatgctgttctcgtgatagtgaataggtctcacgagatctgatggctttaaaaaggggagttcccctgcacacactctcttgcctgccaccatgtaagacatgactttgctcctcattcgtcttctgccataattgtgagatctccaaagccatgtggaactgggagtccgtgaccactctttttctttataaattactcagtcttgggtatgtctttattagcattgtgaaaacagactaatacatgggggggcggagagagagagagggagagagggagatggggagcgagaagatgggggagagagagtgagagagagagacagagagaaagaaagaagagattgagaacacaatacagacttaggaaggacagaccgggagctcccagaaagacagagacaggctgtgttgactcctgctatctttctatcccaaaaccctgctgtgctttctgactttggttttgtgggatgctttatttaataggttgaactgtgttctccaaagagatatgttgaaagccctaacatctcagtaccccagaatgtgacctctgttggaaacagggtcattgcagatgtaattacgaagatgtgatactggagtagggtgggcccttaatctaatacgagattgtccttagaagaagtaggaaatttggacacagacccacagggaagacccccttgtgacaatggggatagcgattgaagttccattttaatgtacgtgctgccgaagcgagcacaaggtagagattgaagtgaagctgctacaagcccaggaatgcctatggttaccagaagccaggaaaggaaaggatgggatcttccccagaggctcggggtacagctttgtgaaccccttgattttggacttcttccctcaagaattgtgagagaataaatttctcttgtttcaagccacctcgtttgtgctgttttgttaatcatccttaggaaatcaatatgccccttatccttcttgaatgagctctgtaccttataatgagattattgcagtctaaaaatctagaactagttgcaggaacatcacagacaagggaaagtttgaaccacaccatggatgagtgacaagcttggaaaagaagggcacttcacctctgtggtattctttgcaaaaactcatgacctgagtctaatcatgaaaaaagaaaaaaatcagacaaactcaaatggaggctaatacggtttggctctgtgttccaaatctcatcttgtggctcccataattcccacgtgttgtgggagggacctggtgggagatgattgaatcatggggacaggtttttcccgtgctgttctcgtgatagtgaattagtcttatgagatctgatggtttttaaaaatgggaatttccctgcacaagctctttttgcctgctgccatccacatcagatgtgacttgctcctccttgccttccaccatatttgtgaggcctccacagccacgtggaactgtaagtccaataaacctgttcttttgtaaattgcccagtctcaggtatgtctttatcagcagcatgaaaatggactaatacagagatatatcctgcaaaatccgtccccagtactcctgaaaactgccaagctctgtagagttagagttagaataccttttgttgttgaagatgtgagggaagtatgcatgtgaattgactgctgaattcactttttttttttttgagacggagtctcgctctgtcgcccaggctggagtgcagtggcgggatctcggcgcactgcaagctccgcctccccggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctgaattcacttttgtgccatttttgtaaatacaatagttttgtacaaccttagaaaaataaggaaaggctgaagaagctacacatttggttggtgtggtttctaatgtagttttattttacattaaaaggtttagacaatgggtcctcatggcagttgctggtgacttaccttgtagttgtaaagctgggttcttgttttctttttcttttaaatgaaattataataataataataataataataataattattattattattattattattattttgagacagcctcttgttctgttacccgggctggagtgcagtggtaagtcgtagctcactgcagcctttaactcctagattcaagggatcatcccatctcagcctgccaagtagctgggaccacaggcagatgccttcacgcctggctaatttttaaattgttggtagagatgaggtttctgtatgttgcccaggctggtctctaactcctgtgctcaatcgatcctcctgcctcagcctcccaaattgctgggatgataggtgtgagccactgcacctggctgaggccttgttttcttgctggctgtcagctggggacctctatcagcttctagaggccacctgcattctttgacatggccctgtcacaacatggtagcttacttcctcctagccagcaagggagtccctaagtctcctaaggggaaatcttatttggtgaaatatgatcaagggagtgacatttggcacctttgccatattctgttgattagaagcaggtcacaagttccatcctctctcaggcggggaggcttgtacaagggagtcaccttagctgtgtgcaatcaggaatacagcccaggggccgtgcctgacagttaagaggactcagtgtgatcaagctgatcaatatgaagtgggttaggcagctgccagtgctaaattctgtttgggagttttccaagaaccagccctacccatgagtatctctctgggtaaacctcctgcaacttgggagtcaccttagctgtgagaaccgtttttcgatcttaccagcaaaaatgacagcccagggtattccaggcagctgcttctccagctccaggcagatgattttggccctgccttgcaacagaaatggaatcgtttcgaggggatggtctcctcgctctggatccagcagcagcagatgctccagccgaagacgtgtgtccactctgagcaaggttgagagaatcaaattaatttcttttatgacccgaggcaagcttgaaattggctcttccaagatgaaaaaggagaggcaggagtggcttgcctggctccctactctccttctcctcctgcctccacctccttcccagcagggctccagcaatttaatcggggtgggattccttccaccaagcaaggcagtctgtcacgcgccgctgcagtaggggccatgccagagacagcttttcgaagcggcatctgtgggcagacatttgggcaaccccactaggctggcaagccctggtcgatttttagtgacctcttagaagtagatgggagggactgtcagccatgccggaagtgggagagagcagaaggggtcaaagacaagcctcggctgggaagagcatctctgtggtcctgtaattgatgattggggtggggagcattgaaacgtttcccttgaatcacagccttcagtgagaatggctttgcctgctgtttggacggtgtgttgagagtagggtaaccatatgtcctcatttgctgcaacagtccctgttacgactgctttcctggttttgcctgtctcgaaagcattctggtttgggcgataacttataaggtcatcctaattctgggtttcacagtctcagcactgtggacattttgggctagataatcctttgggtgagggttgtcctgtgcactgtaaggtgtgtagcagcatccctaggctctgcccactagatgccagtagcacaaccccctgccccattgtcattgccaaatgtcccctgaggggaggaggaggaatcacccctggatgagaaccatggcccttttttaagggcactgttgaatccttccttctgataccatctgggggtaacttgagtacttggttcatgttctggaaggaaaaactccacatagtgcttctgggttcatttagcccatgtaagcttcgtttttctgtttcttagaccagtatctcactttttgcagggagaggtgggacctctcctccattctcagcccatgtgttttgggtgactcgagagactgggtttggcagatgggagaatgccattctcctggctgttgtgattgattcagaaacctgcctttaaggtggttcaaagagcatcagtggcaggacttctgttaggtggatagggaaagaggggttctctttttgctggggttgcaaacctggtagggtggaaaccgggagctgctggtggtcatctcatcaccctgggggagagcctgcctgagaaggaaatcacaggagagccgagctgagagaggagaaggaaagccgatcacactgtctaacagcctgtatcccctccaacctgatgacagatctcacctagagtgaatttctcagtgaagccagtttgacttgagtttctgtcaacttgcaactcaaaaaggccatgtgttgccatgaggtatttctctgttccctttcctaatctagagattaggtaactttaattctgctaatgctgagttttgtctcatcaaatggaaacatcacagaagtctctgatcttgccccatcaacccttcccattacctctagggctcagccaatgctgctggtatcttttgcttcattttttcttttcttttcttttgtttctttctttcttttttttttttctgaggcagggacttgctctgtcacccaggctgaagtgcagtggtgtgatcacggcttactgcagcctcaacctcctgggctcaagtgatcctcccacctcagcctcctgagcataggtgcacaccaccatgcctggctagttttttaaattttgtttgtagagaggggagtcttactcaatcattcaggctggtctcaaactcctgggctccagcaatcctcccaccttgatctcccgaagtgttaggattacaggtgtgagccactgcatctggctgcctcatttttcttaatctttcaagactctgtagaaataatacctactccttttcattcctccttatctcctgtcttcctttccaacactatagccctcttttcattattacccacatttacaaaaggtctttgtaacttaatggcatacccagacagaaataatgttctctgggttaattatctagtttgccacaatctcctgtaccagattctacccagcctgctctgattataaaggggactattgagaaatagctgcaaaaatgcacaaaaccataagaattcccattctaagacccagagcagatggcttttggattattcccttctctttttctatcatatgtttacataattgagttcatcatctatatgaagtcttacatacatatatttttataaagatataaaattatacaatcaccccaattaaaaggcatgaacattattttaataattggaagaagatttcattgtacgaacatagtgtaatttcagaaacatttttctgttggttgacacttcattttttaccatttgcaataatgtgatggcttccttgggcatacatctttgtcctcaactggatgtactcccctaaaataaatttctaggagtggaccttctgggtcaaaatgggtgagtatttgtaaggctcttgatacatattgccaaatgaccttccagaaaaattgtgcctgtttacatgcctaccagtggcatggaagggtcagatgtcagaatcatgattgcaattattgataaagatccagctagttccagttttgccaacaatattaacaccaccagcacatccaccaataataataataacaataatggtatgataaataaaataggtgatatggtttggctgtgtgtctccacccaaatctcatcttgaattataatcaccaggtgtcgcgtcgagggagggagctgtaagccccacgtgtcgaaggagggatgtgattggctcatgggggtggcttctcccatgctggtctcatgatagtgagtgagttctcatgagatctgatggttttaaatgtggcagttttttcccgtgctctcacttctccctcctatcgccttgtgaagatgtctgcttctccttctgtcatgattgtaagtttcctgaggcctccccagccatgcagacctgttgtgagtcaattaaaccccttttctttatcaattacccattcttggccagttgtttatagcagtgtgaggatggactaatacaatagacttattgggagcttgtaatattctagctatgttactaaaaatttcacacattatttcatttagtccatccagtaacctagagattaggtattattataattcccccatttacaaaataggataataaggtacaaagacgttaagcatcttgcctaatgaccacagccagtaaatggtggatcttagatttgatgccaggcatctgacttcttcaagcattgtttactgttttagtatgacggagatgactagttggatgtaattccacctgaatggctagctttactgtgtacagatcaccaaagatctaccttgaggaaaaacattgctatacattgcaaataatagtcagggctctggtattaatgtttcccagtctctccctcctaaggacattgtcaccctcccagacaggtgtgtggtagaaggaaacgactctctcctgatgctatgaattccaaagaattcccattaaccatatttctaagccagtttgctttctttcaatgtgcactttctgcaaaatgccatctgcacttgtttcctggggaaaccatctctctgaggtgggtaagttctcattgtgaagatggggacttgcctaatgtttggcattccctttttggggcacgtacagtgatttctgaactgacttgaaaggccattaacttggtttttactgccttttctggcttgcaaatttaatgcctggctcccaacatgtgtgaatggacaaacagcatcagcatcatctgggaacttgctagaaataaaaattctcaggctttaccctagacttacagaaccagcaactctgagggtaggttccagaagtctgtgagtttacaaatcttccaggtgattctgatccgtgctaaagttggatctactgctctaaaccttagtttcttcctttataaaataatagtagtagtagctgtagcagtaataataatattggcttcatggttatagggggaattccatgagtaatttgagtccttggcactgtgcttggcatacagtaggtgcttaataagtggtagttggcatcactatctctgaactgtgaaggtcgctgtgcttaacctatgtagtatttatcagccccgcatcccactccgttcagggatggcccttctcctgcctgtgggtctggtgggaccactctgcagaatttcttatgcccagatcttctatcatggtgtgacaaaagcatggcccatcaaatgcctgccttctgggaatttgcatcttaaggagagatcatcaaggatgtagagtgattagagtccggtcattccacgaccctgcagcctagtgcttctcaacctttaatctgcttaacgctaactggaggatcttgttcgagggcagattctgactcgaaaggtctggggtggttctgagagagagtctgcatttctgacgagctctactggagatggtgatgccagtactgctggtttctggactcacggtgcagttgcatcccgagagtagtgaatctcatttttcaacctcaccttagaatcacctaggggaggtgtgaaacaagacagacctgagccagttaaatctcagtttctttcctttttgccttgccttgctctgccttgccctgccttgccctgccagggtctcactctgtcatctaggctggagtgcagtggtacaatctcggctcactgcaatctccacctcctgggctcaagctatccttttgcctcagtctcctgagtagctgggactacaggcatgcgccaccacatccagctaatttttgtatttttagtagagacgaggtttcgccatgtttcccaggctggtcttgaactcccgggctcaagtgatctgcctgccttggcctcccacagtgttggaattacaggcataagccaccatgcccggcttaaatctcaatttctgagggtgagggcccagcatcagtggtttctaaaagtctctttggttgactgttggctgcagtgagggttgagatccaccaccatacaaagatggtccaactggaaccccctcaagtctgggaactctattctttctctgatcctgtaagctccccgctttttaatgtaaagatttggttctgttggctgggcatggtggctcacgcctgtaatcccagcactttgggaggccaaggtgggcagatcacgaggtcaggagtttgagaccagcctggccaatatggtgaaactccgtctctactaaaaatacaaaaattagctgggcatggtggcgtgtgcctgtactcccagctactcaggaggctgagggagaagaatcgcttgaacccaagaggcagagcttgcagtgagccgagatcgtgcactacactccagcctgggcgacagagtgagactttgtctcaaaaaaaaaaaaaaaaaaaaaagatttggttctgttgcttgaaaactaagaaccttaactgatagagcctcagaaatgagaagagagtcaaggtgagtgttcattgcctctgggctctccagctgcagatcctcttgcttctctgtgcttctctttgggatgacaccacagagacattaaaccttttggagggcccgtacagtaatttctgaaccaacttgaaaagccataaacttggtttttcctgccttttctggcttgcaaatttaatgcctggctcccaacatgtgtgaatggacaaataaaagaggaactgtcccttcctctctttgcccccatcaagggccacctgagagactgtatctctttaggatcgcttagctctttcctcagtcccaggtctggattttgcgggtgacagcttcaccagtatgtgacaagccatgccaggtgaccagagtgtgaaccagcctgctcacctgtcaggtggtggtaatgaaaaccgatggacctggtgcggtggctcaacacctgtaatcctaacactttgggagtctgaggtgggaggatcacgaggtcaggagttcaagaccagcctggccaatgtggtgagggcctgaagtagtgggaacagagggtgactgaggcagagtcagccttaaaagatcagtcgctaaaaaggacttcaactgcctgcctttggggagagggatttgatgggagaagggctggggtaagacagctttgttttccatttcaagtcatttgtatcatttgcttgtactgctttgataaagagaaatctgaaattctagaaaaaattagaagtgaaaaaaaattcctttatagccatgagcagaaccgttaacaatagcagccgggtatggtggctcacgcctgtaatctcagcactttgggaggccgaggtgggtggatcacctgaggtcaggagttcaaggccagcctggccaacatggcaaaaccccgtctctactaaaaatacaaaaattgccaggcgtggtggtgggtgcctgtaatgccagctactcaggagactgagtatggagaaacacttgaatccaggaggcggaggttgcagtgagccgagagcgctccattgtactccagcctgggtgacaggagtgaaactctatctctaaacaaacaaacaaaaagcaatagcaatagcaacagtaatgacactaacttatattgatgtgctagattttatccatgtcacctcattcacctttagttctcactacaaccttgggtgacaaacttgtgttggctttagcactttactggatttgacactgagcgttccctatacctggaaccacttcggtcctagataaaccaaagaggatggctggtcaccctactacagccccagaggcagctgctattaaccaatgcatgctgcaggggaggaaactgagaccctgagaacttctgtaactcgcatcatggtcacacagctagttagtggtagaaacaagttacataccgactcggtggtggacacaattaagggtcccacagtcagttagttgtagaaacagttaagagtcacacagctagtcagtggttgacatagttaagggttgtgcagctagtcagtggtagatactgttagttaagggtcacataggtagtcagtggtggacacagttaagggtcacacagttagtgatagatttaagggttacacagctagttagtggtagatacagttagttaagggttacacagctagttagtggtagacacagttaagggtcacacagctagtcaatggtagacagttaaaagacacatggatagtttaagacacatggatagtttagtggtagatacagttagttaagggccacacatctagtcagaggcaggtatatttagttaaaggtcacaaagctagtcagtggtaggtacagctagttaagggtcacaaagctagtcagtggtaggtacagttagttaggggttacacagctagtcagtggcagacagttaagggtcacaagactagtcaatggtagacaattaaaagacacatggatagtttagtggttgatacagttagtgaagggtcacacggctagtcagtggtaggtacagttagttaagggtcacacggctagtcagtggtaggtgtagttagttaagggtcacaccgctagtcagtggtaggtatagttagttaagggtcacacggctagtcagtggtaggtacagttagttaagggtcacacagctagtcagtggtaggtacagttggtgagccatctcatcactcgtttagtagtagagcttggattggaaccaggtagggctgtgtctgttacattacatcacgtcacatggagtctcagagctgaaaggactttagggtcgccgtgtctattccccttgtttgtagatggggaaacttgcctgagtggcggaacgccctacccaaggtcgcatggtgagttttgggcttctaagagaccactggaggaagtcagggagacatgccctggcagggacccgtccggaggcctgccaattggctttgagaggagcgcgtcttgcatctcccaggaaggattggcagagggagggcgggcgtctcgggccgggggctggtgcccggggctggggctgaggggagggggaggctgcttctctttgtaatttacatacacagcagcaacagcctgggggaaaacaacccaaacaaactctcaaaggatgttttggacttaatcccgggatcggaagcagctcggtaagataaataagataaagttggtgtgcctcttaaggttgaacgatcatatcactattgcatttgaaatattcatgaggggaagggaggtatgagaaacagctacagaaacatattctgctttgaaaaggcagaattcaaaggcatgaaaaatgaatcaggggaaattaatgtcgaggttgggaggggggtgggctggtggggggacaattattgcccagaaggaataaggaaagagatgtggaggagatgtttcagactgggccgtgatcagaattctgtatcctgcctggaatatttgaaatgtcaattgtctcatatatcatttgaagtcaatacttggtcgcaaaatggatgattctagcaaggattaaaaagcagggtgggctgggggatatgggatggggagggtggagtggggtggggcagggagatggaaaaagatgggtaaagtgaactaagtcctataaattgtggacgaattactgatcactcaaagagggctctggaggagtaagatgcaaagaaacgggaatttcttgtgatttcttgcaagtctctcggtcttggtttctccctttataaagccaggaggttgggctggatgttctcctagatggtcccactttgccttgtggagggggtggggctctgatttggagatgtgcttggaaatagagggttccttaaggcaagagggtcaagggtattgacgaacggtagcaatacagacatgatgcttgtggttaatggtggctctcagcagagccctgcaagtctacaccgtgttaggggggccagtggggtttggccccatttaaaagcaagcccttggactgtggactggcgcggtcattctagagagatctgacactaaagcaaatgaaggctgcatattctctgtggtcccagaccagcagcatcagcatcacctgggagcttgttagaaatggaaattctcgagtctccttccagacttcttgagtcaaaatctgccttttaacaagatccctgggtgagtcctgtgcatattaaagactgagcagcagcaattcccctcctggatttataccccagagaaagtttcacccaaggatgttcaaggaggtgggtttgtggtagcggggtattggaagccactgctgtgcgcatcagaaggggatagataagcaaagcatgacagatactcactgtgggatatgactgtggtagttagaaaaacaggtctgatcttcacatgccagtatggacggatcttttattttatttatttatttatttatttatttattttgagatggagtctcactctgttgcccaggctggggtgcaatggtgcaatcttggctcactgcaacctccgcctcctgggttccagcaattctgcctcagcctcccgagtagctgggattacaggcgcccgccaccatacctggctaatgttgtatttttagtagagacagggtttcaccatactagccaggctggtctcgaactcctgaccacaggtgatcctcccaccgcagcctcccaaagtgctgggattacatgcgtgagccactgtgcctggcctggatggatcttaaaaacaaagcacaaggggaaaaaaagtgagcaatagaatcaatttatagcaagtgtctttgtttgtgctgctataaaggaacacctgaggctggataatttacaaagaaaaaaagtttatttggctcatcattctgcaagaatcatggcaccaacatctgcttctgatgagggcttcaggaagcttccactcatggcagaagtgaagaggaactggtgtgtgtagatcacatggtaagatagagagagaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaagagagagagagagggagataagaggggtatgaggaaggaggatgagagaaggaagaaggagacagggaagaataggagacagaggagggttccaggttatttttaactatcagttctcggccggatgcagtggcttatgcctgtaatcccagcactttgggaggccgaagtgggtggatcacttgaggtcaggagttcgagaccagcctggccaacatgtcgaaaccctctctgtactaaaaatacaaacattagccaggcatggtggctcttgcctgtaactccagctacttgggaggctaaggtgggagaattacttgaacccaggaggtggaggttgcaatgagccgagatcttgccattgcactccagcctggccgacagagcgagactgtgtcccaaaataaataaataaataaataaataaataaataaataaataaataaatagaaaaaaataaaaacacaaaaattagctggatgtagtggcgggtgcctgtaatcccagctacctgggaggctgaggcaggagaatctcttgaatccgggaggcagaggttgcagtgagctgaaatcgtgccactgcactccagtctgggcaacagagtgagattacatcttgaaacacacacacacacgcacacacaatcagttcttgcaggaactaagagtgggaaatcactcactcttgagagaatggcacccagccattcctgagggatctgcccccacgaccaaaacacctcccaccaggccccacctccaacactggggatcacatttcaacatgagacttggcaggggccaaaacaaaccatatctagaccatagtatgacacaatttttattggttaaaaatgtatttgtacacaagacagtatgcttaaagctacaagagggcagggatttctgtctattttgttcaccgttgtcttcttgccacattctgaacactcaatatttgatgagcaaatgcacttcacaagaatgcgcacacattcaagagaagaggaatacctcagctgagggggttttgcactgcaccgtggtgatgccagaaactcaggagtaattcactccactttctgcacctggggtgaaatagaagcccaatcttgtgtgagaggtgagggggagggtggccgggctggcctacgtttgcagagcttgttccatttcacagtggcttggctgccctgcccttggtccctccaaggtcctgcttgctcagctcttggcttgccaccttcctgctccatctctaaggctttattggctgttcctgtagaaacagactctccaagtcatggctttttctcagcattttgcatgtaccacctcccttatcctcacaacactgcctacaacactggttctcaactggggacacttccatccccataagggacatttggcaatgtctggagacatttttgattgtcacaactagggtatactgtgctactgtcatccagtacgtagaggccatggatgctgctaaacatcctacaaggcacagggctgtccccagactccccagtaaagaacgatcaggtccaaaatgtcagtggtgttgaggctgacctagggtagggggctctaatatctctattttatatgtgaggaaacggaagcatggtgaggttgggtaatcctgtgtgaggtcctgcagctggtaggcaatggagatggggtatagaccaagtgagtctggctctagagtccttgcttttaaccaccatacatgattgcttctcagaagtggaaaacgctgagacaggcacagctttttatacctttactcacttatgttacggcgagggtgaccagctgtcttggtttgcccaggcctgagcggattcccagagtgtgggacttgcagtgctcaagccaggatggatagtcaccctagtaacctccagactctgtagacatctgtgtttgtgatctgattgttactttcagtctgttgagttcatattactgatgtaagagttaagaagagattatttaggcagatagtgagggtaaggaagtcctcagtaaggttttccttttaatgaaaagcagtccccaaatcatttttcttttctaacggagagcatcctgtaaaatcaagctgcagacataggcaagcaagctggaagcttgcacgggtgaatgccggcagctccgcccataagaaaaggctagctggggctaggcacgtccaacagggcagctccatcttcccttctctttgccagccatgtgtacagtaaggagcaggcaacaaggagccagccaggcaaagaccccatttgcataataacactagggtggggcggccaacttccccatgcgctatgtaaatgtcacacctggtgcaaccaatctttgggccctagtaaatcaggcaccgcctccccaaccctgtaaaatctggtgcactctgacttgggccagaagtcccactgggtgcccccctctcggaagagagacagtgttctcctttctcattcttttgcctattaaacctctgcttttaaactcactctttgtgtgtgtctgtgtccttaatgtttttggtatgaggcaacgaatctcaggtattacccccgagagaatgatgctgcttcactctgtgctaatcacaattgacacaagggccgaatcccagtctcaagttcacctacgatgactttatcatccacatggctcaaagctgtggtcaagtttcctcctgttttgaaaatatgtgctatgctccagttaagtcagcacagctctaggtagatcaaaattcatctttggaggatttctgaaattcacttgaggagtagatcagttggggatggtgtgatggaggaaaaagaaaatcccaaggtttgatggcaaggttagagtgaccttctgaccttgagcaaatggcttaagctgtctgggccttgatgtcctcgtttataaaatgagtccgtaataaaagccacaatgatgagcatcaggcactgtgctgagtgtttgccatctaaggggttatctggttatctcatttaatcatcacaaccacgggaggggaagctcctggggttaagtgtctcgcccaaggttgcagctggtggggaatagtctggttgcaaacccagagaccacacttttaactgctatggaatgttgtctcccgtggctgtttctgaggagatagaaaaacatgccaattagggccaaaaaaacgggaggtggcctcaagggcagtgcattacattaagagtgtttgcaaaggcgtgggtgtttctccacccccgagtcgctgctgacttcccgacacctacacgcagggtcaccctgcagcttctgagcacctggccggctccccccagcaatgtgtgtttgatgttatcagggggtttgaggcacggctgaggccccaggaatctttctctttcatggagaagccaagctcacatctcccagtggcagctggtgctggcgtctggctggagttgcagggactatgtgtcagctctagcagttcctgcgactgtattcacctactgaaggtccttgatctattgctggggtttgccaagggtctcaggggtctgctgcggagcagagagactgattattattttttaaatctccagttgacccccttgttctcacgttaatcactttgagaataaaaatggctaccaataattgagcacttactacgtgccaggcacaggcacatcctatgcctccctccctcctcctccggggctgctggctctccttatcctttttatttttgcttttttctccacagctagtaactgtgttctaaacaccaataagagggcctggcaaatgtggttactcaataacatttattgaatgaatgggtgtgagcgagtgtgtgttaggctccctgctaagcccattacgtgtattattttactcaactctcacagtaatcctatgagataagcttcatctttatctccatgttacaaaggagaaaatgtgctcagagatgtcaagtaatttcccccaaaatgcacagcttgtgtcaacgcaagaatgcaaatttagcagtctccaaattctaccccatttactatctcccaaatagatatgtataaatatcccacatatggagatacattttaaggatttatacgtatctatttccatgtaacacggccacacatatgtatcctatataatatgcacatgtatagtatgtgcacatattcacgtgtaaatgtatcagttacctgtagctgtgtaacaagtaacaccaccctcatggttataaaaataaacacttattttttgctcataggtctgtggtttagctggagagattctgctttaggctgtgggttgagttcaagtctgattcttacatttatttctgaggtccagattggagaagcagtggtacctggtgaaggttggcagcttccagagaggagtgagcagaaatactcaatgccttttaaggcctaagctgggaactggtgcaccgtcagctctgctcatgttccattggccaaaacaaacccatcactaacagggcagaggattctgttcttcccatggtgaagggaatgagagggaagtaaatatttgttaaacaggaaaacataccactatcatattttaattatatatggatgtatttgtattttatctttttttttgagatggagtttcgcacttgtcacccaggctggagtgcaatggcacgttcacggctcactgcaacctctacctcctgggttcaagcaattctcctgcctcagcctcccgagtagctgggattacaggcacctgccaccatacccagcttttttttttttttttttttttttgtatttttttttttactagagatgaggtttcaccatgttggccaggctggtcttgaactcctgacctcaggtgatccacctgcctctgcctcccaaagtgctgggattacaggcataagcctcggcgcccagcctatatttatctttttcacccatgaccccagcttcagtgaggagttctgttactttgtacttttactgggcattcgtttccttgtttggaaaatagtgactataattaataaaagtgtttgtattcttgcaaattgctaagagagtaaatttgaagcatccccaccacttgttaattagcttgatttcaccagtccgcaatgtatacatatttcaaaacatcaggttgtacacaataattatagacaatttttgtttgtcaattcaaaaagtaataagtaaaggaaaagaaaaatgtaagatactttaaaaaatgactggctcgtgttgagaagtaacttttactatttatttgtttttttgtttgttggttggttggttttttttttttttttttgagacggagtttcgctcttgttgcccaggctggagtgcagtggcacgatcttggcttactgcaatttctgtctcccggggttcaagcaattctcctgtctcagcctcctgagtagctggcattacagatgcccaccaccatacctggctaattttttgtatttttagtagagacagggttttgccactttggccagactggtctcagactcctggcctcaggtgatccacctgccttggcctcccaaagtgctgggattacaggcatgagccaccgtgcccagcctaacttgtactatttatttgagttaagccaacacacacttgagttccccacatgtcatagagtgatgtggacaagcccttgaaatctggctttcctgattacctggttgaccttgtagatgcctctctgagcctcagatatgttctctgtgaaatgggcatgaaaccagtacccactttgtagagcactgtgaggattaagtgagaggatacgtgcaaaagtttaccacagtgcctggctccagaagccactcaatatatatttgctgttgttattaatattgatactattcttacaacaaaaacagcacagatgttctaatgatcaattatcctagcctgtcgtctgctggtccccagcccatgtttctcggaccctgtctgtgtgtgatttatgatccgactctctctacactttgtgttggggtttgatttttcctgctttggctcaagacccccttcctacagaaatgtttggacccatcttacagacttgtgcctccttggctgtcctgcctggtcagccccttggaacacagggttggccctaagttggtcctcccatcccagcaaaatggttcactggggcattgcaggttgattgtggaatttcaacaatagcatgggtggtgggaaaaccttcggacatccacagacagcagcctggatgtataagagatgggggtggtgttctttccatctggagtcctccgggagctgtcaagcctggaatctttgcaatttaggcagtctgtttgtaatggtctcaagaaaacccattctgcctacaaacgcggtgacctttaatttttttttctcagatttttccaagatgcacattgactcttcctgtcaacgtggaaggctctaatgccgcctggggcatttagattgcatttgccaatcgctgactgctgtagccaatttgttcctgatctcaaggtcgattttgaataactttagctgggctaagtctcttgcattgaataactgggaaacaacctattaaggtagcaggcgggcgggggcaggagggggcagggggctgtttctattttgtagaagttctttgattttggataaatgagaaggcttctagctctgccagtcatggactatgtggccttgaacaagggagggaaagaaagaaacacatgccaagtacctagcatatgctagacacagtgctgggcacttcacacatgccagctgcttaatctactccgcgaggtgaacatcgtgatctccatgttacagataaagaaacggagtcccggcaacttgcagggttgagcttggatctgtctaaagccccgcccctccccctttttttgtttgtttgagacggagtcttgctatgttgcccaggctggtgtgcaacagtgcaatgatcttggctcactgcaacctccgcctgccaggttcaagcaattctcctgcctcagcctcccgagcagcttgggattacaggcacgtgccaccatgcccagctaattttttatattttttgtatagacgaggtttcaccatgctggccaggttggtctccaactcctgacctcttgagccgcccgcctcggcctcccaaagtgctgggattacaggcgtgagccaccgcgcccggccgatgatgctctttttaaactatccttatgagtgtatttcagcaacctcccccgacccgaattacagtaccacaggctgcgtcctaatgctgtgccctctcctgatatggtctggctgtatccccatccaaactcaccttgaattgtaataatccccacgtgtcaagggcggggccaggtggagataattaaaacatgggggcagtttccgcatacggttctcatggtagtgagtaagtctcacgagatctgatggttttataaatgggagttccgctgcgcaagctctcttgcctgcccctgtgtagcatgtgacttcgctgttctttggccttccaccatgattgtgagacctcctcagccatgtggaactgtgagtccattcaacctctttcctttgtaaattactcagtctcgggtaggtctttattagcagcgtgagaacaaataaacctcctgtcatcttctctccttggattcactcctctagtctgagatgtctggttcgccttgtttccccagcggtgggctcatgccggcaggggttggcatcagcaactgttctttgatcccatgactctgattttgagatgagcctggtgcagcttggtggtttcacgtggggccctttggaaggagaaaacctggtccgaatccctgcaagttgtgtgacgggttgggttccttggaagcccgagaatgagatttgggtaggtgcggtttattcaaggtgggggttctcaggagaaggaaagtgagggaaggaggatgatgggggaggggacagagccaagcaagaatgggctctcaggctgaggctagccttgatctcacgtgggtctctggagtgtattctgccttgaagcaggaggactggacttttgtgtgactcctctcgcctcatatcgcttagtcattggccagttcagcatgtgagagcataactccctgggtgaaatggcttttgctagctaaggaattctccggagaaagtattggtataagccattaggcacagatcagcaaaggctgaatgatgagtggtttactggcaatgaggatctgggtgaagcaccaggaacagctgcgacgttgtgcaactgctctgcctcagttttcctcatctgtaaaatggggatgttgataaaacccatctctgagcgttgatgcaagggttagatgagatacttgcatttgtgttactgataatgtgcctgtcactggccaggtgcaaagcaagggctcaacgaaagcataagctattattattattattattattgttattactggcagttttggatccatagcaacaagcacatataaacaatgctcacttcttctctagtttaattcttataactcttctgagataagttctacttctaccctgttttacagacatggaaactgaggcacagtgaggtgaagcactttgagctcacatgatggggctgagattccaatttagggagtccagtcccagagcccccaagtgagtgctggtttgggactgtctcttctgatcatgacaaatcttttttttgagatcactctcagttccttgaatgtatccatcttctctgttgtttctgggtctttgtatattctattctctgtgctggcaacagcttttccgctttaacctgatctgccctggttcatcccttgagactgagctctgagctcatatttggccttttttttttttttttgagacaaggtctcaccctgtcacccaggctggagtgcagtggtgcaatcgtgactcactgcagcctcaacctcccaggctcaagtgatcctcccacctcagcctcccgagtagctgggactacaattgcatgctaccatgcccagctaacttgtgtactttttgtagagatgaggtttcgtcatattacccaggctggcctcgaactctcaggatcaagtgatctgcctgcctcaacctcccaaagtgctgggattacaggtatgagccacggcgcttggcccatgtttggccttttccaggaagccctccaggttgcctccttccacagccccttgtctgttccccaaagtgtctgttaggatgtattacacttgcctagtcacttgtctgcctctcccattagtctatggctccaaagaattgaatattttgcctgtctctatcattgtcacccctgcaagtagcatttgtctggcacatagtaggtactcaataaatgtttattttgtggctgaatgagcattccagattcagaactggaaacattggaggcttacaaaagttcagaaccgcatacattggaggcttacaaaagttcctgttgagttgaattaattcattttgaaatgacatggactaagttctttctgggaaggtttcctaactaaatccgtgggcatggtggactggagcgttccagaaccagtgcaaagagtcccctgtccataggcatgagatgaaggctcagggacttaaaatacacttctattgtggaaagttcttcagagacccttctggcattttatttaattgatgctcggctcatttattttattattttatttttattttttaatttttttattttttttttgagacggagtcttgctctgtcactcaggctggagtgcagtggcgcaatctcggctcactgcaacctctgcctcccaggttcaagcaattctctgcctcagcctcccgagtagctgggattataggcaagtgccaccatgcccagctaatttttgtatttttagtagagacggggtttcaccatcttggccaggctggtcttgaactcctgacctcgtgatctgcctgcctcgacctgccaaagtgctggaattacaggcgtgagccacggcgcccagccatttttattttattttttttgagatggaatgtcactctgtcacctaggctggagtacagtggcgcaatctcggctcactgcagcccccacctccccggttcaaacgattctcctgcctcagcctcccaaatagctggaactacaggcacacacccacacaccaccacacctggctaatttttgtatttttggtagagacggggtttcaccatgttgcccaggctagttttgaactcctgacctcaggtgatctgcccaccttggcctctcgaagtgctgggattacaggcatgagccaccacgcctggcccagttaatttattttatgtaatgaatgtatttcttttcattaggaaagtatgagaatcacgttgctgaaaatgtgggaaacctagaaaagtagagaaacccacccactatcatttggtagtaaatttcttcagatttttctcctcccatatatgtttttctctttctttattaaacatacttatgaccatactattaatatagtttagtatcctgctactttttttccgtttagcaaaatgagatttttccaggtttaattacatagttttaaaaataaccatcatcattttgttcttatttttttcccttttgaatttaaaaaaaaaaatcatagtaatatgagcacatcgtacaaagttaaagtacagaggagctgctaatgaaagcagcggttcctggccccttctctcctctctcccctccttaagtcttatttcccggaggtaagtgcttgaaatgttgtttccatttttaggtcttcggttatttatctctgtaactccaaataagatgcttatgtggctgtttcttgatttatcaatttaagacattttctattgactctgtgccatagaagatgaggattcagcttattgacatggttcctccccactttttgtccttccccagtttttatttgaaaaaagtcagacgtgcacatggcaaatgatgaccggaggatgaaggagcctctcttactctaatgcttcagtcttccacccacccctcctcccagtttcttgtgtatctgtggcaggtcaaagatgagtgcaaactgtttgataccccatgcattcagaaatggggtctatttcccttttcctgagcctgggctggcctgtgactgctttgacgaatagattgccatagaagtgacaccatgatggttctggtcctggcatttaagggatcatgcagtttccgccttacacctcttggaactcttggttttaaacccctgagccactgtgtgagaaatctgagggcttttgctggagggaaacctggagagactctgagatgacatggaaagggagagaagttgctctgagcccagcttccatcctgtcccactgatatgatttggctgtgtccccatccaaatctcatcttgaattctcacatgttgtgagagggacccggtgggaggtaattgaatcatgggggtgggtctttctcatgctattctcatgatagtaagtctcatgagatctgatggttttataacagggagtttccctgcacaagctctctttttgcctgctgccatccatgtaagacgtgacttgctcctccttgccttccaccatgattgcgaggctccccagccatgtggaactctgagtccattaaacctctttcctgtaaaaatgacccagtctcaggtatgtctttattaagagcatgaaaatggactaatacacccaccaaggtgcctggcacatcactaaaactgcactagacccttcagagcagccccgaagccctctgaatactactgagtgacctcagatgatactgtgtgagcagaagaactgcccagctgggtcctgcttgaattcctgaccctcaaaatcatgatctataataaaaacagttgtggctttaagccataatgtttggggattaacttgaatggcatccttcaggagataccccatgtgtcataggttttggggatggaggttatcttagcctaccaacagtgcctgatacaaatatgtgaatgtttcattgggtcacgcaatctcaagaaagcagggataagggaaagagagaaagaggaagagcaaaaccaaagaagtgcatattgcctagtggagttgcagtttcccagaaacacaagcatgggataactctggagtcagtcatctgccagctcctgctgtttcctgtctcttattggtcaaagcttgctccactctgcacttctgagtaatggccctcagcccctcctagcagcttctgggggatccaggacctctgggagctgataggtgtgatagaggccagcccttaaccccacccagggtaggctgagtcacttttattttattgtaaaattgatatttatttacttattattttaaggtaattttttttgagacaggatcgtgctctgttgcccaggctggagtacagtggcacagtcatagctcactgcaacctcaaactactgggctcatgtgatcctcctgcctcagcctcctgagtagctgggactacaggtatgcaccaccatgcatggctagtttttaaaaagtttttttggagggatggggttttgctttgtttcccaggctagtctcaaactcttgacctcaagagatcctcctgcttcagcctctcaaattgctgagattacaggcataagccactatgcctggcctctattattattattttgagacagagtctcactctgttgcccaggctggagtacatcggtgcagtcttggctcactgcaacctctgcctcctgggttcaaacaattcttgtgcctcagcctccgagtagctgggactacaggtgtgtgccatcatgactggctaatttttgtgtttttagtagagatggggtttcgccatgttggccaggttggtcttgaactcctgacctcaagtatccacctgcctcggcctcccgaagtgctaggataacaggtgtcggtcacagctcctggccactggcttctatttttttattttttgagagggagtctagctcttgttgcccaggctggggttcagtggcgcaatctcggctcactgcaacctctcaagttcaagagattctccagcctcagcctcccgagtagctgggattacaggcacgcgccgccacgcccagctaatttttgtattttcagtagagacaggtttcaccatgttggcaggatggtctcgatctcctgacctcatgatccacccaccttggcctcccaaagtgctgggattacaggcgtgggccatggcacctggcccagcctctatttttaaagtaacttttatgggatgtcagacattgtaaattttaccttggtgggtgctggatgtttttgtgcctggcacagtcctaggtgctgaggacctagcattgaacaaaaacaaagatccctgctcttgctgaacttccatgctactgtggggagacaatcagtgaacaacaagcataatttaggtttgctcttattatactgttgcacacgtaccttttgtatatgtactcttaaacggccattgtttttagtgatttgattgaacaaatatatttgattgaacagatatatccttgctgaatgagccatttctctattgatgggtaattatattactttctctagtaagagtcatcagaagcttagaggcttaagaatctaagctcaacaaacagaggttggagaggttattataaagtccattgtgagagcagccactcctaaccttgggaccaaagattggtattgcgtgacctgtgagccagaattaccctggattggactgtcctaccaggtgggcccctggccagcaaaagagatgatgggggttgttagaatgtcagagagggccttagacaccccttttccatatagtctccagctctttgactaaaacctgtaccccagtatataatcagtcacccaggcctagagtcaaggtcttttatatcatgtaaatttattttttatttttaaaattttttatttccatagggttttggggaacaggtggtatttggttatgtgagtaagttctttaatagtgatttgtgagattttggtgcagccattatctgagcagtacacactgaacccaatttgtagtcttttatccctcaccccctcccaccctttcccccgagtccccagagtccattgtatcattcttatgcctttgcatcctcatagcttagctcccacttgtgagtgagaacatacgacgtttggttttccattcctgagttacttcacctagaataataatctccagttccatccaggttgctgtgaatgccattaattcattccttattatggctgagtagtataaatatactgctggtatatggcatatatataccacagtttctttatccactcgttgattgataggcatttgagctggtttcatatttttgcagttgtgaattgtgctgctataaacatgcatgtgcaagtatctttctcatataatgatttcttttcctcagggtagatacccagtagtgggattgccagatcaaatggtggtgctacttttctttaaggaatctccacactgtcttccaaggtggttgtactagtttacattcccgccagcagtgtagaagtgttcccttttcaccacctccatgccaacatctattatgttttgattttttgattctggtcattcttgcaggagtaaggcggtatcgcattgtggttttgatttgcgtttccctgatcattagtgatgttgagcattttttcacatgtttgttggccatttgtttatcttcttttgaaaattgtctattcatgtggatttataccttccccgtattcccatgcctttgtcttcaatgggactattattttttgtctaatggctttgaattaaatcttctgtcttctattccactgatctccagtctccagcaataattatgctgtttgcattggggaaggtggcagatgtagttgttgccttgcctatgtcctctggcataggaactcaccattcctactgcaagcatctgcaatactgcctggggctttgtctcactgccataacctaggctcttgtggggcaggctggaagtgcagagaaaccaacacaggcacatctcccccagccagctgctgagggcagttgccctgccttccataccttagggtgaggcaggcgctatgctgtctcccagatgtccccagtgggattgaaccccagttgcccatagtagcagcctgcttataaacatgacctggattagctcctttcccttctctgtctcatttccctattgtcatcccagtgtttcctgggctcactttccaaatcaacccacttatcttcaagtccttctgtattagtctgttctcatgctgctaataaagacatgcctgagactgggtcatttataaaggaaagaggtttaatggactcacagttctgcatggctggaaaggcctcacaatcatggtggaagacaagaaggagcaaagccacatcttacacggcagcaggcaagaggcttgtgcaggggaactcccatttataaaaccatcagatctcatgagacttactatcaggagaacagtatgggggaaaccacccccatgattcaattatctccacctgcccccgcccttgacacatggagattgttacaattcaaggtgagatctgggtagggacgcagccaaaccatctcaccttctcttaggatttgtttctggggaaacctaacctatctaagatgatgaaaaatacaaagaaccaggaaaatccataaatagatttaacaagaaaattttacctagtcttgatgagtggcaaagcttgactgccctgaggaagtgactttgctgagctgagacctgaggatgggtaggagttagctaagcaaagcagcactggaagaacagcaggggaagaacattccaagcatagggaagagcatgtgcgaaggtcctggggcaggaatgctagtgtggatggggtgcagaaagagaggcagagaatggtggttatctttggaggatatatggcctgaaagtgaatttgggtccctgactttaagtctctttcctctgcagtttaattatgtctatacacttttttttgaaccccattatggtctggcttcatttaaatgcatctgaaatgaaatctctaatgttaacagtgttgtcagatgtgaaggcttcatttctctttggttctttttcaccgaatgctatctgtgagtttctggggaggatatgaggattttgattgttttgatttttttttttttttgtatgaccacattatgttaatttccccattgtcttagagtatgagaacataaaagcaataactcatttatatgaagactgaatgtgctgagaggttgtcatggaaacctctcatgttggcttgagtaaattgaataacccctgttaaaagactgaacacagataactggcaggctttgtttcagggcaagagttcacaaactggggtccacagatgctcaaacattctatcatgaatagaattcggggatcccatgatcttggacagttaaaaatacatcttatattcttttatctctacctgaagtttagtctttctttccattgtgaatgaataaagcaataaacaaacaaaaaaacaaaagattgaacacagaacttatttacccaattgcatggcattcacaagagatgagaaattcaacatgatacatgagatttttcccccccgcaggggcagggaggaggatgaagagggtgaatgaatgctaggaatgtattatttttatttagacagtgatttctatttttctttcaaagattatatttttgtttccaaatgggagaggtgttatggggcgatagagaaaggatccagggaaaattgcatggtaaaattgctcctgggaaagaccagcttagggtatccatgattgtcgcttctgtagccctgagcatgtttctccccttggagcatcctctgaagtcttggtcagagtcgttgaagagacatgaaccttttcagcattttctgctttgctttggcaggattgtttactgcctatcaagctgacttacaaaaaatactagttctgttgtttttcatttttaaaagcaaattgcttcacctcttcgtaaataactccttaaaagaaaagccgtggatgacagatgaggaagcatagttgggaacagagcgcggcactcgctcacgatcatagtgtcaggtcacaggaagccctctgagccccgggggtgggggcagcctctttaaagtgattatggagcaagaggagcttgaacagtggcactctgagcgttgtcttgggccagcttggagatcaggtcctgggctccagaagacatcgaggctggttctacctggatgttgcatccgtaggtatcaaagtaggagatgctttcgaggggtgagtttttcatcagtggcctccaccccaaagcaccatagtcctacctccttgttgtatgtctttcttctcacaggctgcttgtcagacttcagaatttcatgggcatgatgggcaaataagcttgattaatgcttcatgcttgctatccactaaatgtgttcccaccatgtgttgaaacctaatccccagtgtgatggatggtattagggggtggggcctttgggaggtgattaggacatgatggtggggactccacaagtgggattcatgcctatttatttatttatttgagacaagagtctcaccctgttcccaggctagagtgcagtagtaccatctaggctcactgcaacctctgcctctgggtttaagtgattctcctgcctcatcctctgagtagctgagactactggataattatctaccacacctggataattttttttttttttgtatttttagagagatgaggttccaccacgttggccaggctgtcttgaactcctgatccaagtgatctgcccatcttggcctcccaaagtgctaggtttacaggcgtgagccactgcgcctggccaatgcccttttaaaaggggtcccagagagcccctttgcccttccatgatgggaagacacagtgaaaagagggctgtctatgaactaggaagaaggccttccccagacactgaatctgcctgggacttcccagatcttctggagagaaccgtgagaaataaatgtctgctgtttgtaagccacacaacctatggcattctcttatagcagtctaaatagactaagataataccataaggatctacctttgggactgtgtgctgttataataaaggctctgataagtcctgctagcgccgtttagaccaggggtttctaaactttttgaccacacaagttatttttccctttgcaagcaccttccatggaaatcttttgggaggctgaggcatgagaattgcttgaacccatgaagtgaaggttgcagtgaactgagatcatgccactgcactccagcctgggtgatggagtgagactctgtgtcaaaaaaaaaaaaaaaaaaaaagaaaagaaagaaaaaagaaaatattttcaaaatgatgccatggattaaatctgatagtcacaaaggatccttgtctggtgttacctccatttgatgggtgaggaaacaggagtcctgagaaaccaagtaacttgctcagggtcatgctgttaggatgtagcagaatcagaaccaaaaccctaagtcccagacgactaaaatccaccactccaatggagaggcccttactgcaatgacctgttctgaaggagcgaaacaaggcatttattgcagcatcatttaattaggaaaaaaatctggaaagaccctgaatgtccaactaaagggaaatagttgatatttatgatacttccatacaatagaatgttatggggcatcgataatagacatgaagcacagtaacatgaggtggcacatattataatgtaaaatggagaaataaagcaaaatgataatcatgcaaattaaatgcatgaaactaaaaaagaaatacaaaatagtagctgtctctagatggtaggtgagtcagttcaggtcctctgagtagcagaaggcaaaacagaattaattgtacaaggtcccagtctccactgatttcaaatccacttttcaacttctgtatgaagttctcattctcttactaatttttttttttttttgaggcggagtctcactctgttgccaggcttgagtgtagtggcgcgatctcggctcaccgtaacctgcgcctcccgggttcaagtgatttcctgcctcagcctcccaggtagctgggattacaggcgcatgccaccatgtccagctaatttttgtatttttagtagagacggggtttcaccatgttagccaggatggtctcaatctcttgatcttgtgatccacccacctcggcctcccaaagtgctgggattacaggcatgagccactgtgcccggccctcttactaattttaaataacatgtctcctgcagcttctgtattgcaaatataggaagtgattttggcgagcatttgaattatggtagctgatctgatctgttgtgtctccttactttctaattctttctttactttctgctcttttcctccctctgcttatttgcttcctcttgctgtcttcctttatctccttttcttttcctacaaatttctaaaatgatagctgatgagaaggaagatcactcttacataatttgattcctcagtttccattttcttctttttacaagtataacattctatatttcttttttttaaaaaaattattttttaattgaaaaataatggtacctattgatggagtacgtagtgatgttttgatatatataatgtatagtgatttgatcagggtaattagcatatccatcatctcaaacgtttctcatttctttgtgatggtaacattcagtatcttccttctagctatttgaaactgcattattattaccattatcattttattttatttagacagaatcttgctctgtcacccagactgatttgtagtagcatgatctctgctcaatgcaacctctgcctctcaggttcaagcgattcttctgcctcagcctgccgagtagctgggattacacgcatgctccaccacgcccgactaatatttttttagtagagatggggtttcaccatgtttgccaggctggtttcgaactcctgacctcaagtggtctgctcacttcagagtcccaaagtgctgggatcacaggcacgagccactgcgcctggccaaaactacatattgttaactgtagtcatcctacagtggtttacaacatgaaagaaaaccaagtattaattgtgcaggaaattcattgaagaaaatgcctgtgaagggaaatggggagggagcagggagagatttcagaccgtaatgcaggtctgacacctctgaaagcagagtgggaaggaagagagatagttagaaagagaaaggcttcggcacaactctgagaatgtatcagccagtgtaatagttcctaaggcaactctctctgttggacaactcccagttgggttagaatcacctaattccgttacttccactgtgcccagtcactggctgggaaaatccccagggaagtgcagcctagcatgaacacctcggtgggtcaaaaggtacagcagctagaggttgtcagttagctctgcttccagagcagttcaccttgaaggaagatttgagcacagaacttccatgactgagagcttctggtgcactttacagcagaggaatttgtgaagcaggttcactgttcactggctaccaacttgtccagtgagacagaacactcccacacaacaagttacctgaggtaggtttattacttacagataggcagcaagagatggtagaagcctaggattcattgtgagctattcctccaagtccccggaaacctgctgagggtaagtagagtcatatctgtgcatgccttacttgcacagaagctcagataccccagaaagcagctggttctgtgttttataccccaggatgtgtgatttgctgggctaaagtgtttaagacattttgtttctaggggtggactgaaacagaggttgggtcgttctggccagtccctctctatctcaagatgttgcatttctagcacattcttcagttattcttaagaaccatgagttgggaaaagagggaagaactgggtaggcccaaggccacccagtgaactgtctagcagcattttgcattttgtaaaagcacattaacaatggttttgagaagctgaagtctgtggactgattctccctgtaaatacaggcctgctttactagcacctgcactttctggttcttatgccccctcaaaagtgtactgagtcatttgaacagaaggagactgcccctccagctccccacaatgggaaattgtcatcactgccacaaaatgaatagaaggacttggccaagttcatcttcctttgtttactgcctgcacttcatcccatttggaagagagaagcaatagcattgaatggtctggcttttttttttttttttttgtaatcatggctatacagcagggtaatgaaggtcagagatgggggcttgaaccacctgcctgtggttttgaggtttccccaaatactctatggttgttaagttccataagaaagggacttgtttttcatttttattttctttccaacttttattttaggtttgggggatacgtgcgcagatttgtttcatgggtaaattgcatgttatggggcttggtgtccagattatttcatcacccaggtaatgaatgtagtacctggtaagtagtttttcaatcctcaccctcctcccatcctctaccttcaagtaggacccagtgtctattgttcccttctttgtgttcatgtgaagtcagtgtttacctcctaagtgagaatgtgcaatatttggttttcttttcctgtgttaatttgcttaagataatggcatccagctccatccatgttgctgcaaaggtcatgatttcattcttttttatggctgcatagtatattccatggtgtatatgtaccatactttctttatctagtctgcaattgatgggcatctaggttgattccctgtctttgctattgtaaatagtgctgcaatgaacatatgtgtgcatgcatctttaaggtagaatgattattcttttgggatttatacccatgaatgggattgctggattcaaccttagttctattttaagttacttgagaaatctccaaactgctttccagtgactggactaatatacattcccatcaacagtgtataagcgttaaagggacttaactgctgaatagtcttcacccaactcaaagcctggctctcagtagatactcaatatattgcttatacaattaaaggaatggttaaaaggaaggaagatgtatgcagaatctgtgtactgctaagtcagcaaacatttgctgagggtctgttgaatttggtcctgctcaacattgaacttgcccacttctcaccaccattaaggctccagaaaatttgtttatccacagccttcttcgtctaccttattaccttgtcatttctttgagacctaatatccattcctcctgatctccagctcaactccctagaatccatagcttctagagttttgtttatttattccatttttatttatttgatttattccactttcattgaatatcaagacctccaggcatagttccaggcacctggtatgcagcaacaaatatgatgttcagataatctcttgctgcataaaaaagagcctgatcccacagtggctggaaacaaatatttggtattattgctcatgactctgtgttgattgggctcacctacgtggttctcatttcaagtcctatgcagttgtagtcagataatgactggggctggagtcatctgaaggcttgactaggctggccatccaagatggctgagacacatggctggcatgatattggctactggttaggagctcagttggtgctgtcgcctggagcactttcatgtggcctttctatgtggtttgggcttctcgtagcatagtggtgtctgagttccaaaagtgagtattccaagatataggaagtagcgcttgatagtcttttaaaacatggactggaaaagggcacagtatgatttccaccatattcaatacgtcaaagcaatcatggaggtcattaaagtcaagggagagggtgtagatcccaagagattgttgtgtgtttttgtttgtttgttttttgtattttttttgagacggagtctgcctctgtcacccaggctggagtgcagtggtgtgacctcggctgactgcaacctccgcctcctggattcaagtgattctcgtgcctcagcctcccgagcagctgggactacaggcgcccaccaccacatcagctaatttttgtatttttagtggagacggggtttcactgtgttggccaggtgggtctggaactcctgacctcaggtgatctgcctgccttggcctcccaaattgctgagattactgatgtgagccaccgtgcctggccctaagggattgctttgatgtaaaaatgtacagccatttgaaaatggccacaggtggtctctgctgtcaaggacttcagagttgataaagagatagtgatgaaacctatagtaggctgaatcatggccactcaaagatagcaggttctagtccgcggaacctgtatatgttaaattataaggaaaaggagtctttgcaggtatgattaaattaaggatgttgacatggggagattattctggattatctaggtgggccctaaatttgattgcaagtgtcttataagagaaaggcggagagatattacacccagaagacaagaagttgatatatccagatggaggcagagattggggtgatgccactccaagcaaggtaatgctggcagccaccagaagctggaagaggcaaggaacagactgtcccctagcacttctatagggaacgagctctactgacaccttgatttcagtttattgcaaccgatttcagtcttctgacctccagacctgggagagaagaaattcctgttgtttgaagccatttagtttgagatcattgttacaaaagtctcaggaaatgaatacaaacccagacaatgacaagcaagggtggaggtgatatggaggaagcatataggaggcacctgaagcccagcccagctgggagagaagaaagcaggaatgcttctttaagctctgatgttcaaatgagaacacatggacacacggagggaaacaacacacactggggacagttggagagtggggggtgaggggtgggagagcattaggacaaatagctaatgcttgtggtgcttaaaacccagatgatgggttgataggtgcagcaaaccaccatgacacatgtatacctacgtaagaaacctacacattctgcacttgtatcccagaacttaaaaaaaaaaaaaattctgacgttgattcatccctaggaagtgtggcatcatggtgatgttcattcatccctaagaagtgtggcatatgacaacatgtggaacttgaatccattaaacttctttttctttacaaattacccagtctcaggcatgtctttattagcagtgtgagaatggactaatacaaatattatgatgaatgaggacattctcatatcttccacaaaaccatcatggaagacattatccatcatttggttacatttcccttatgtaaggatccaaggggatctggagtactgcttttctgtttgcgtctcaactctgccacatactagctgggtttataggctgctgtgaggtttcaatgagtaaatcaaaacctgtaaacacttggtgcatgcatagtaagtacttaaaactggtattgttataattttcgggatatggtaaaggatattgtttttctggggaaagacactaggcccatcatgggggtaataccctcgtgacctcgtctaacccaaattacctcctccaaatgccattgcactgggggctagggcttcaacgtgtggatttggtggagaaagacaaagacattcagtccataacaattttccttggatttttatgtatatgatcaagtcacctaggaatgatgactgtttcatttcttcctttctggacatttcccccctgtctaactgcactagctaggatatccaggacaatgtggaatggaagtgaggcttatgggtatcagtgctatgataccatccacagggagaaacctttggctttgtatgaaaagctgatgggtagggatattgatatggtttgtctgtgtccccacccaaatctcaacttgaattgtagctcccataattcccatgtgtcatgggagggacccagtgggaggtaattgaatcaagatggggggtcttttccatgctattcttggccagttgtcagcctgcccaacatattgtgaaaccgtgtctctactaaaaataataagccctctcttgcctgctgccatgtaagatgtgactttgctactcctttgccttctgccgtgattgtgaggcctccctagacatgtggaattgtgagtccatttgtgagtccacctctttttctttataaattacccagtttcaggtatgtctttattagcagtgtgagaatggactacttcagatgtcatgatgaatgaggacattctcatatcttctgcaaaaccatcatgggagacattatccatcatttagttacatttgccttatgtaaggatccaaatggaattttttttgaattctattctaagaaaaatcatttcctttcctgtgaacagctatacttccctttgttaaatgatgatattcatgtgtcctttatgttttctttttcttttgctctggctattagggagctaaaacccaagagcacacgcaatcaaaataaccatattaaatgagttttcttatgtatttgataaataaataatttttcttttggtttccctttgggtgtaccttttattgcaagctgtctcaagaagtttttttcacagtaaatggggataaaattattttaaaagaataatacctgacctgattattacctgggtttatttcattgactgaatggtgagactaatgaatggacaagagctttatgaactgtaaaatgccgtgtctgttattaactaggggaagaacatgattgtccttgactttaaccaatgtaccttgtgtcttccttagttggcactgatggttctgagttaggtaaccatgctccctaaagcctctgagatttcccctgagcatcctggccactcagtgcttattttgcaccactcttgtgtgtccaggatgactccttcaactttatctttcttctagaaagttgctatccattgtttacatccagtggctcatgcattcatagactgcagcagcattttctaagcaccagctgctgggtatgtattggttacctgcccagcaacccttttctcttcttctttgctgagaccatcccattttcattcatgcatcagttggcaatatgcccagagaaatggagccccttccttcctcatgctcttaggcatggaactcagttggcccaagccaggcatgctcatcttgtttctctcactgctgactggtttagccttgggcacatgacctggttctcagtagtgagctagtaaggatcagaaaaaccacaaagccatgacattattgaattaacctgtctggaccacctacgcctggattttgtgtgggagatacaataaatctggattataggttggtgcaaaattaatatttaaatcacctgtagttcaactctgtgttgcttgcagtcaaaagtatccttatcaggctgggcacagtggctcacgcctgtaatcccagcattttgggaggctgatacaggcggatcacctgaggtcaggagtttgagactagcttggccaacatatagtgaaaccctgtctctactaaaaataaaaaattagctaggcgtggtgacacgtacctgtaatcccagctactcaggaggctgaggcaggagaatcgcttgaacctgggaagcagaggttgcagtgaactaagatcccgccactgcactctagcctgggtgacagggcgagactccatctcttgcaaaaaaacaaaaaaagtcctaatcaactgttttagtttggatgctcactgaagtagactctgaggcaaggatttgagtgccaatagtttattaagcttgaggaggtgggggaaaggggacaggcaagggagggaagtggcaagaaagatgcattatcatgtcagttaccagtgtggggaatcacagtttaatctctctggggaactctggaaaatgacacagagcagggatttgcaaactattggcccatggcaaacctgttctgccacctgttatttcaataaaatgttcctggaatacagtcacaccctttcatttatgtatagcccatggcagcttttatacaacagcagcagagttgagcatctgtgagagacaatatgacctgcaaaacataaaatatttactatatgaccctttttcaagaagtttgccaaccctagtgttgagcatgtagctcagaatcaccccctggaggagtgaaggagctgggatatttatacatccctccagttagtcactggtgaagacctaatgcaggaggtatgttaattctccaggacttccgacctgtcctgtgcacaggcattgtgggccctggccaagcaaagagatgtaaataccgattgttgggatttgtgcaagtatggaccctactggtccataccagtacactaacagagatggccacatcagtgcatccagagatggctgagaagtgcacctgtcctccaggaacccatagtctgaaggcaaggttggaaatggccaaacatttttatttttattttttttgagatggaatctcactctgtcacccaggctggagtgcaatggaatgatctcggctccctgcaacctccgcctcccaggttcaagtgattttccctcctcagcctcccaagtagctgggattacagggacctgccatcatgccggctaattttttgcatttttatagagatggggtttcaccatgttggccaggctggttttgaactcctgatctcaagtgatccacccacttcagcctcccaaagtgctgggattacaggtgtgagcaatcgcacctggcctttatttttattttgtgagacagggtctcactctgttgcccaggctggagtacagtggcacagtcatagctcactgcagcctcaaaatcctgtgctcaagtgatcctcccacttcagcctcccatgtagctggaaccacaggcctgtagcatcctacctggctaatttaaaaaacaaacaaaaaaaaaaacaaaaaaaataaagtgtgtagagacagtctcactgtgttgcccaggctggtctcaaactcttgggctgaagcattcctcctgtccccgcctctcaaagtgcttgggattacaggtgtgagtcactgtgccctgctcaaacattttataattaagtagaaaaaccgacatgtcagctggggtcccctgaatcctcaaagatctaggtaagatcttctatgcaggctacttcctgctaatctggggagggcgaccttctcaaggtcgtatctgcctctggccctggtgcccccaacccacgctggctctgctttttcccctacaggagcttaagtgcagaactttgcgtctcccattgcctgcaggaaacctactcagctagtgagttcatagggcttcactgaagactgggggattctggaggggatgattttctggcacattcaggcttctagaaccctctattctttccccagctctgcttctcgtttttttttttgtctggctccaaaaccttactccttttattgagcacattatttctctccagttcccacctctgcatttcctttcctgaatgcttctagggcctcagcagaacaaggaacgcctcattgatgacgttaaaaaacaacaacaacaaaacaacctaagacacaagacacagacaaaactttttttttttttttttttttttggtattctccagacaaaacgtttgcagcatgagatgaggtcccctttggaaacatctccccacattctgtgattctgccaagtcctctaaattttgtctcctccttcatccaccaggtggatttcaggactcctactgtcagaggcttggaataaacctctggcatgctttgcttctgttttgctttctttctttctttttttctgagatggagttttgttcttgttgcccaggctggagtgcaatggcgtgatctcggctcaccacaacctccatctcccaggttcaagtgattctcctgcttcagcctccagagtagctgggaagctgggattacaggcatgcgtcgccacgcccatctaattctgtatttttagtagagatggggtttctccatgttggtcaggctggtctcaaactcctgacttcaggtaatctactcgcctaggcctcccaaagtgctggggattacaggcatgagctatcgcatccggccctgtttggctttctaaaatagactgtgtgtctcacccagcatgacgttagatctgtttagcatgacagcattccattgagtcaactccttggacatactatatgttttgtttccctggtagctaattaaataagacaactaagtgcagtctagaaagttcctctcataacaaagttcccaagaatttacgtctttgctttacttacttactttttcgtggtagttgaagttcaagtggaaactgattataaaggagaaacctaaatcaagttaggtgaattctgcagtatgaactgtgcttggaaaatctaactggtaatgtatccacattgggaacttggtccttcctctcacaaagaaaattccaggtcaatttcatcccctatgctaagcatttgagtgttcaggaatgtgattttagttttataaaaattgttctttttaaaattcctgtcaaataatcagatttttttctcagcacatttagaagtaaaaatggaaagtttagagcattttgatattttagtatttccatgaagtcatttaaccctcccagactagtttcagagttttgtcttccagcccatctttgtgtctcactgtacattttctgcatgtacaatgagaggtgatttttaattggaatcccttagatttttagagagaaagctctcctcctctattcttcttcctctcctctcactgtctctcattttaatccagagaatcaaagtgtctcttacaggcttggatatcaagctgaactgttaaaaacagtggggtccaggaacctgagtttaaaacaagcacctctgattgtctaagtggacttagagaaagacaaatgctgtgtgatctcacttatttgtggaatttaaaaacgttgaactcatacaaaaagagtagaattagctaagtgaactaattcagacagagaaagacaaatgctgtgtgatctcacttatctgtggaatctgaaaatgttgaactcagaggaaaagagagtcgaattagaatggttgccaggggctaggaggaaatgttgctcaaagggtacagactttcggtgataagatgaataagttctgggcatctcatatttggcacggtaactatggttaacaataccatattgcttacttgaaatttgttaagagagcagctcttaaaattttttttttactttttgtgggtatataataaatgtatatatttacgggtacatgagatgttctgatacaggtatgtggtgtgtaataatcacatcatgaagaatggggtatctataccctcaaatatttatcctttgtgttacaagcaatccaaatacactctttcagttattttaaaatgtacaattaggccaggcgtggtggctcacgcctgtaatcctcacactttgggaggccgaagcaggtggatcacgaggtctagagtttgagaccatcctggccaacatgatgaaaccccgtctctactaaaaatacaaaaaatgagccaggcatggtggcatatgcctgtagtcccagctactcgggaggctgaggcaggagaattgcttgaacccaggaggcagaggttgcagtgagcccagatcgcgccactgtactccagcctggtgacagaccaaggctctgtctcaaaaaaaaaaaaaaaaaaaagtgcaattaaattattgactatagtcactctgttgtgctatcaagtagtaggtcttttttttttttttggagtgaagatctcatttctgttacccaggctagagtgcagtggcatgatgacagctcactgcagcctcgacttcctgggctcaagtgatcctcccacttcagcctcctgagtagctgggactacaggtgtgccccacaatgcctggctattttttgtatttttagtagagatggggtattgccatgttgcccggctagtcttgaaatcctggccttaagcgatctgtccgccttggcctcctaaagagctgggcttacaggtgtgagccaccacacctgaccaagtagtaagtgttactcattctttgtaactatttttcttgtacccattaaccatccctacattccccagcccactacccttcccaggctctggtaatcaccatcctttcactaagagaccagatcttaggtgttctcatcacataaacatccaaagacaactatgggaggtaatgaatagggtaattagctggttcatggtgatcatttcacaatttgtgtatacatatatctccaaagatcacattgtacactgtaaatgtattccatttttatttgtcaattttacccctctaaagctgggaaaatgaaataaaataagcatcctgggcaggactggctgcatagttttcagggcccagcacaaaacgaaaatgtggggattcttgttatgaaaattataggaattctggctgggtgcaggggctcacacctgtaatcccaatacttttggaggctgaggctggggagttgctttgagtccaggagtttgagaccagcctgggcaacatggcaaaactgcatctctacaaaaaaaaaaatgaataaattaaaaaataaataaataaataaatcagccgggaatggtggtatacatctgtggtcctagttactcgggaggctaaggcaggaggaccgcttgagcctaggaggttgaggctgcagtgagccatgttcatgccactgcattgtagcctgggtgacagagaaagaccttgtctcaaaaaaaaaaaaaaaaaaaaattataggaatttcaaaatgccagcatcacagtggggtcgtctaattatggggccttgtgcagttaccccaggcagcatagcaggaagcctggaagagctttgctgcaggattcagatcccagaccatggtgcccatgagtttcaagatcttgtaacatgaaggcgtgtcttcaacagactctctccaaagaaatcctctcttgctcttggcccttctttgtgcctgaaaagcgtgagaagagggtgtaagcaggacagaaccacttttatttttatttatatatattttttgagatggagtctcgctctgtcgcccaggctggagtgcagtggcgccatctcggctcactgcaagctccgcctcccggggtcacgccattctcctgcctcagcctcccccgagtacctgggactacaggcgcccaccaccacgccccgctgatttttttttttttttttgtatttttactagagacggggtttcaccgtgttagccagggtggtctccgtctcctgacctcgtgatccgcccgctttggcctccgaaagtgctgggattatagtcgtgagccactgtgcccggccagaaccacttttcaaagattttgtttgaaaatctgccttttgattttgtacttgattttggaattctttattattattattattttttgaaacgaagtctggctctgtcacccaggctggagtgcagtggcgtgatctctgctcactgcaagctccgcctcccgggttcacgccatcctcctgcctcagcctcccaagtagctgggactacaggcgcccgctaccacgcccggcaaattttttgtatatttagtagagacggggtttcaccgtgttaaccaggatggtctcgacctcttgacctcgtgatccgcccgcctaggcctcccaaagtgctgggattacagtcgtgagccaccgcgccgggcctggaattcttgatgctttaaacaaaacttaacatcttgcctgacatgtttttgtagcccaacaggataactaaaacgccagcattaaaactcagtccctggcaagatgttgtctgtgatctccttcatcttcacgacaagatcatctagggttgtatgctgaggttagcagcagagtctcagtggagtcgaccctgcaggtgggaagccacacttggaattcctccatcgtgcttagttcaccttgaggactaggtagctatctaatggcagaatggtttcaaaacccaagtatctgtgaagagctttctcttttgtgaattcttcggtccagctcagtgacttccaactgttcgaggggcatagttatgacttaaaatgattacatacacaagtacatgcacactctataaattatggttgatttaaaggaatctcaggagtaattttgaccacaaataatttttcctcttctgtactaactatggaaatgaaatgtttgtgtaatatatgatttcattttgccagaatatatgaatacttctgtgaaagtgtcctgaaataaatgaaatgctgtctctgcaaaaaaaaaaacctaaaaaacaaaaacagttctttggctgtgacatggacatgaataaaaaggttataactagcatcaaattcaagcatttggttttattgcttatgtgaacacagcatggaacatcttttgattcacgttttccccattcttagtcgtgttatctgttcgtgactatgcaagtggttttgtctctcagggacatttggtcatgtctggagacattttcagttgtcacaactggggatgaggaaatggtgctactggcatctggtgcgtagacttcagggatgccagtaaacatcctgcagtgggcggaatagccctgcatggtagagaatgatccactctagatggtgtcagtgccctctaaacattacgtcctgggctgtacccactctctggatgtgaaaatggaggcctagggaggctaagcacttatttattatttctttgtagttaaaaaaaagtccatcttgttccaggaaggaacaatttactttctaaacatgaggcataaaacagaaataactaggaaatcggtggaaatgtgttttcatggggaccgtgtagactgaggacaaattttcaggcttctatttgtccggtgaggttagtgcttgtgcgctgggccaagtcaacatcctcttagcggtgtcttgtctccttcctgatttagaaaaggcaaacccacctgctgtcatgaaaaataccttctagaagctaccgggtaattgggtgatatttctggatttgtctccctgtctaatgtacatcagttaaacttttgactcttcagtgccttctggagaaagtaataatcggaaactaaatcgacttggttttttctctccccctttgccccgtatttgtaaagattaatcttcagtatctatgagtgctgggtgatttgcggaaactgcagctgctttgtcaatatcagcttggcctccattgatcaaaccctcatttaggcgttcactgccgtctgctggaaacagcccagggatgaggagggaagggaaaaggccacttcgggaggccaccttgccttggagtttccgtcgttttccgaggtgagcttggatgtcactgctcagcacagttgattaaagaggttggtgctgtgagtgagtcactgtgtgggaatcaatcccgatggtggcagatatgaataaagcgtcggtgtaactgtcctggctggattgtttttctccgtctcaccatactgttttccctctgcacgtgtctgtgacctccggcaggcttgcagataaaagtgatgcatcttcattttgtcggaggagttaattttgtgtgtattccaaggtaagatgatactcacggtgcttatatcttgggcacccactgtgcattggacactttccataaattaactcaaatttttcttagcagcttgctatggctcttcactgtttctccaattcgatttacaaaaccttgatttcagtgggatccctgtttgctcttgcaaactcttcactcaccacctgctttttgcccactccacttcagctgccctgaactttgtgttgctggaattgactttgctcactcacacctctggtcctttgcacatgctgtgccctgggcttagtacatttcactttcatcctcttaacctcgttcatatcttgcttgggacaacagatacggctgtaagtatcagaaaactctattatcatggcttgaaggtgcaagggtttatttggcttacacaataagctaaacagtaggcaagccatgttggtagagtgaatcaaagagaccatcagaaacccccacttttttcattttcttgctctgctgtgcaatttctatcctcatggttacaaaatagctgcttcatctccaggcatcacgtcagcaggcatagaagccaagggagggcagcaagccagaaaactaaaggtgcgctctcccttcttttcactggtcacaactacgtcagatggccagccctagctgcaagagatgctagtgaaagatgatttttagctggatacattgtcgccctcagcaaaataaagatgcatttttcttattagcagaatcctaacaattaagattcagtgctcagttttgatgccactcagctgagtggtcctccctgaatccctgtgacagagttgggacacacaggtattaggcaatctcatagatggcattggagttacatgaaattgtggtcttgtttccctatctggattgaaagctccatgaggaggacttggtctacctttcacacagttgtatctctactacctacatagttccagatatatagtagatgctcaataagtaataaatgaaggagttacatgaaattgtggtcatgtttccctatctggattgaaagctccatgagaaggaggacttggtctgtctttcacacagttgtatctctagtacctacatatatagtagttctagatatatagtagatgctcaataaatacttaataaatgaaaaatagctactattttgcccctttgtagttgacacctagagctttagggagataagataacttgccctaagtaacacatgtactccttaattcctccattcagtaatgtttatagtgcaccttctatgagccaggtcttgtttcagacacttgggatacatcagtgaacaaagcagataaaacgactgcctttgagaccattatccctaatattttattacaaaaaatttcgcacatacagcagagttaaaccaatttcatagggaacacgtgttcagttactacctaggttctaccagtcactggggcacattgataccagtgggggaaggcacacagtaaaccggaaacaaaacaagtaaattacatggcattgtagaaggtggcaactgctatgagaaatacagagaaggtaacggggtgtagggcgtgcagttcggggtggtggtggtggccaggcttggcctcattgagatggcgacagttatgcaaagacttgaaggacatgagggagcagtgtcgatattggagggcaaagcagttctaggtggaggcaacagccagtgcaaaggtcctgaggtgggaatctctgttccaggaggggcaaggtggaatgtgtggttggaggaggagcgttgatggtggctgggttagtagaggaggaggagtttggggaaaaagatcaagggaactcagctttggacaggctatgcttgaacaactcaggggcagagctgggatttagatcccagacctcacaaccttcctgtattagggttctctagagaaatagaaccagtaggatatatatgtctatttattatatggattgttgtatgcagttatggaggctaggttccatgctctgccatctgcaaggtggggtatgaggaaagccaatgacattaagtcccagggtaagtctgaaggcccaagaaccaggagctctgatctccaaggtcaggagaaggtgaatgtcccagctcaaatagaaaatgtacacttcctttgcttttcgttctgtttgggctctcaacagatgggatgatgtctgcccacatgggtgagggtggtcttctttttttctttttttgagacggagtcttgcagtgttgcccaggcccgagtgcggtggcatgatctcggctcactgcaagctccgcctcccaggttcacgccattctcctgcctcagcctcccgagtagctgggactacaggtgcctgccaccacgcccggctaattttttgtatttttagtagagatggggtttcgccatgttagccaggatggtctcgatctcctgacctcgtgatcggcccaccttggcctcccaaagtgctgggattacaggcgtgagccaccgcacctggctgagggtagtcttctttactcagtctacagattctaatgctaatctcttccagaaatgccctcatagacacacacacccggatgtaatgttttaccagctatctgggcatcctttagctcagtcaagttgacacatgaaattaaccgtcacactttaccattttgccaacatctgtcccccagtcattcaaagacactgtgaccagctggccaggtggcaagaattcctagggcacaagcctgaagccttcgggagaaacttcagctttacagggggcagaatgtttggtaactatttagatttaaagcagaagcactttggattgagcaatttcatatgtgacaactgtctttgccacaagcaacagcagagacctgcagatgagaacacctttatgaagaacaagaccatgctttgaagttgggcagagatcttggttcaaatcctggctctgctgcttgttagctaagtcacttcaggtaagcgatttaacttctttgggccttgctttcttgatctgtcaagtggaggttcataatagtatcaccccttgagggcagataaactgatgtatgtttatgcatacataaactgatgtatgtgatgtaatttagcacggtgctggtccacaggtgaatggagatgatttttgactttctgtctcgcagaaagtctgtacctccccaaggacatctcatgcccacagcagcccagcattgagtcctcaccaacccagactgactttccagcctcatatcctcaaaggatctgacattttccagccaccaaccttggtttgcactatgcccttcatcaaaaatgtctttgcttctctttgatgcctgggtatctattcctttagaacccatttcaaatttctcctccttaaagatgccgttggtcactgttccaatctgtaggatactctgttttgcccagatcccttttgcactgccttctgggactcagatacagagggggcaaaacatcccggaaggggtggggcccatggactgctcttggagtggggacagagatcaccacgagatggcgctattgagccatcactgtcaactggtttttctctgttttcattttcttacttgatgagaaatgtgtgatttccaaatagtcccagaaggaatagaactgtgactgtgtcccaccactaaaaaggtggttttgcatatctctgatcgtcctatcacatcgcccactgttaaaaattccatccccacatgcaggggatttagaaggagaatatcacacacttgctaccacccccaatccatgcaaataccttggtacttgctatagacacttggtacacaaatactgcctcagtcttttattaaattatattttatatattgcatcagagtattaagcccttaagggtaggacctggggtccatgccaacttactagaacggtgtcgacttctctaggatatggaatccacacagctccttggaaagctggaaaatgcagttttgaagcaaccctgcttcatttccacaccaatggaaaggaaagtgataaatcctttatggccaagagtccgttctgtttatttcttcctggaaatgctattgatggtggctggggaagttgtttgttttttaatctttcccttggcaaggtctccttactcatagcccttccttatgttccccaaatggtgcagggggcagtgttcagaagcccagtatgcaggtcttgcacagaggagaattatggcttaaagaaacttggctaagtgtggtggctcacacctgtaatcccagcactttgggtaggtcaaggcaggccagatcgcttgagtccaggagtttgagaccagcctgggcaacctgatgagaccccatctctacaaaaaattagccagggatggtggtgcatgcctgtagtcccagctactcaggaggctgaaatgggaaaattgcctgagtccgaaaggtggatactaaagtgagccgagattgtgccactgtactccagtctaggtgatagggtgagaccctgtctcaaaaaaacaaaacaaaataaaaaccaacaacagaaaaagaaacttgggtgggatcatgtgtccaggcctcagcactgttgtcccttactctaactcctgcagagaggtccttgaacagacgtaagcggacacaccttgaagtcaaggtgctctttgcaaagcaacacaatgttattgacatattccatttgaataaccaaattttgtagttgattgtgcgctaaggtggatacgcattacattatgttcttatgtagggaagtagaagttagtgccgagatttaaagaaaaatcagtggggaaaataacagttgaatcttatttgtttaaaaacttaggacttatttattcttctgtccacccattcatatatacatttaacaaaagtatttgaaattagttttatattgctatttattttaaaaataggtattatacacgtatggctcaaaattggaaagatacaaaagagtgtatagtaaaaggtagtttccactcccatccttgtcctaaccagtttgtttcttcacagaaatggcaaccactattgatagttttctatgttccccttgagaaatattctatattgtaaatgtatattcatgtattcatttattcacccatctatccatttattcatctacccatccatttattatctagccacctatccatagatggatccatttatgcatccatcaatttattcatctatttacccatccatccattcatccatttatccatccatctatctatttactttccattaatctatccattctttcatccacttatccatccatctatccatccactttgcattcatctatccattcattcatccatccatttatccattcattcatccatttatccatctattcatttacttacccatttatccatccatctatccatccacacacacatccatttatccatccatccatctattcactcatccatccatttatccatctaatccattcattaatccatttacccatctatgtcatttttttccaggaagaggaaaagggcagccattatttggttttagatggtagaccaaatttgtgctactgttccactggaaaagagatttggaaccactccttggcgttaagccagccactccaaagctgtagtgttgcaatgtcatacatctgtcagggaaggctgaacattttaaaaacaattgggtatggccattcagattttattttggcccagcataatgagtttgtgtttgattctgaaggagagggagatttgtaataaatcagcaagtgaaattaaaagtgagccagtgaggtgccataaaagggtggttggaatcagacattctcaaatccatatcctatccccacccatgttaaaagctatataggaggttatttaacttcttgggagtctcaattttcctcttatgttctgagatggggataattgtatttttctttgcaggttaaaggctaacacaatgcttggatatagtcagtgctcatgtggtaactgcccttaacattattaagcccacataattctcttcttttttgtaagcagttgagatctttaggttgaagattcaatatacaatgtaacagagtcagagggtgggtggcaaaaggtacatacatactgcagggcagggacttggagtatggaatggagaaatagcagaggacatcttccagctgcagttgggatgggtgctgagctacaaagctactagagaaataggaaactcaggtctcatcattgcagggacccttgtttcctgcaaagaatccttggagaaatctctcccactgtctctgggcattgtattcagaaatgtctggcctggatgatagtcttcctgcttttggcctcaccctctatccactgtcctctgctgaatctttctaaaatgcttgcttaaaactccttatctccttcaggagaaagttaaatcctttaccacacaaggccattacctgggggccctttctaactcctcccacctcaattttgtcctctttctgcaggtatctaagtgtcatgatttagatgtcctggcatgcactgtgctctttttctggaagcctcctttctttcttcatccaactacctcctcttcttccttcgagattcagctgagactctcttgagcaaattttccaagactccttaaggggaaggacctggtccaagttgacttggtgtctccgtcatcaagcacaatgcctggttcacaatggattcttcatgcatctctttctacaagatgagaaggatcagagggtgaggattggagctgggtgtcttaaaaatctgtgagagtggaagctaagccagtgatgtttgctttgtaagctattcttgtgatattacaatccttcagagtggtgaggttggtgggagtggtaaaaacaaacaaacaaacaaacaaaacctagtttctttgtcttggattttcctgtgtcagtttatagagagagactatccatcatattttattttagcttaaccaaagtcctactttttgttgtttctttttttctttgctgggatcttaaaagagattgaataaaaattcagttgtaggaatggctttaccttcctctctggtcttgttgttttgtttttagactatgatatcacatgtcaagactatgatatcatatcaggactaggatatcaagtttataatagaacaataattatgtattatttaaacttattttcatcaaactataactaatacacaatggattttttaatggtatatacagatatttaaaatttgaaataattttagatttatagaaaagttacaatgatactatagcaagttccaagaaatcccttctcagtttcagtttttcttaaattttgttgttgttgttgagacggaatctcgttcgatcaccaggctggagtgtggtggcacgatctcggctcactgcaacctccacctccttggttctagcaattctcctgcctcagccccctaagtagctggcactacaggcacacgtcacctcacagctaatttttttatttttagtagagacgaggtttcaccatgttggtggtcaagaccaccaggctggtcttgaacttctgacctcgtgatctgcccacctcggcctcccaaagtgctgggattacaggtgtcagccattgtgcccggcttctttaatgttaaaaaaatgttaatgtctttgtcacaactttggaaactattaattgcattccaaattttatttgaatttcaccagtttttctactaatgtctttttcctgtccaggattcaatccagagtttcatgttgcatttattctcacgtctctgtagtctcttctggtatggaacaatttctccatctttccttatttttcatgatcttgatagttttgaggggtactgggttagggattttgtagaattggacttggtgattagaacctaggtctggccgcctacccatcacagtatcagtaaaagcctcccttgaaattgaccaatggcatgaacatttcagatgagtctgccatctttggtgctcctgggacacgagagagacctgtcttggagacagagacctcacagactcagagattcaggtgctttttctggtaatgattttgtctgcgggctgatcacaaaggtggatgagactttggccaaagctaaggctgcagggtctgggctaaaaaattccagaaaaactaccttgccatgggaggctgagttccaaatcgcagcccgcgtgcagcctgctttaccaaataatgaggcactgggtgctttttaaggcagctgacctttggagcaaattatccaaggaaatctgattagctagttcactgggttcctgcaaaatggagcttggtgtgtttctgcagcagaaatgtcagcataattggagtttctggagctcaaagagcttctttcttattgtttccatcctttggaggaaaaaaaaacaccccaaacaaacaaaacccaaacccccaaagaattgttctttgacttacattctttgcttttgcacatggttcagaagctgctcctgactgtgtttacgactttattaatcaggggaacagcccgaacatcatttaaacaaacaaggccaaaaaaaaaaaaaaatccatccctaaacagatgatgtgagcttaatagagatggccaagccaaagaccttaaataaataaactgactttaatttgtaggaaggagcatggggtggtcattacttgaggctgtgtgccatgcgatgtaaccaaatttgaaactcgctaatttcattattttaatggaagtctgcctcccattcattaggctgacatatgactagccattagtaacagtccatttccaaagctatggtggataaagggtgattggaaatgagcgagggccaggcctggtggaggctggcaatttcagaagggaactggtgggtgggatttatgcaagaggcagggaacacaactaggaaaattgtcaatgtggatggaggcagcaaaccattgagtccaaatacaggcttgagagacctgggtttgaattctggttctgccacatactggctgtgtgaccttgggcaagttacacccccgcactgagcttcagtttgctcatctgtgagatgggagtaatcatagttcctatctcgtagggttgcttgcaatgactcaatgaggcaaattcttaggaggctctagtatagggcttggcaaaagtaaccacttaataaatggtagctatgatgatgataacgttggccaaagtccccagtatttagggacttggagattttgctaatgaagaaatgaaggctgacagaaataaagtaaggtatccaagtttgccccgaacttggactcaaatttctgattcttaatcctatactcttaaaaaaaatcctatactcttaatcctatactcttaagacccgtatttttaaaattgtttcatttcttgaacaggccagtaattcatatgattgaaaaatttaaaaacaagagtatgctagaatagtcagtgaaaattgtcccttctgcctggaacatttccttttcacagacagccattgttacgtgtttcttctttatctttgcagaatttcaggtacgtacaagcaaatacaaatgtatatgcacttcttttttttttattacacagacagttctgtatcctgccttttaaaacttatatcctgcttatctttctgtatcagggtatagtgagttctttcattcttacttataattatatgtttttctattataatggctatattatgtcttatttaattatttctctcttgatgaacagttgggaaagttctcatcttttgctattacaaaccacaatgcgatgaataacattgcatgtatgtcattgtgtacaggtgtacgtatattctaggataaatttccaaaagtagaattgctgagttacagagtgaatgcatttctgattttgatagtgctcaaaggtctgggggcacatagagatggtgctttagcagtgagcttaggctgacagcggttaagagagacatgcctcaggttgccagttaaaaaaaaatctgcataatgtgttgcttaaagaatgtggtaaggtgaaagcttggaaatactggtgtcattggaaagacagaaataagacagagattgtgttgggaagagaacacggaatttcgagtaatttctgcctgggtttgcatcttgaccctgccactcctggctgcatgaccttgggcaggttgcttcacatctctgagctcagtatcctcacctgtaaaataaagaccatgataacttccattataggctgctggaggaagtaaaaaagaaaatataaacagcagttagcatgatgcctggcacatggtgtgcattcaggatataactggggcctttgggtgagtaaccaagttcataatgactcatagctagctaacattattatattatatatactatactgtattagtgggaaatagctaacatttattgagtgtttactgtgtggcacgcactgtgcttactgcctcccatgaaacattccacttacctctcataacaactctgtgaagtattcttgctcacctcagcttacagatggggaaacggaggcaggacactcaagtactttgtctgttgaaacactgtgaacaaacgacagagcttatatttgaactgaagccacttgtcttggagggctcctctgatcccacatcctgttctttttttttttttttttttgggagatggagttttgctcttgttgcccagtctggagtacagtggcgcaatctcggctcactgcaacctccctctcccaggttcaagcagttctcctgcctcagcctccggagtggccgggattacaggcacccaccaccacgcctggctaattctttgtatttttagtagagatggggtttcaccatgttggccaggttggtctcaaattcctgaccacaggtcatccacccacctcagcctcccacagtgctgggattacaggcatgagccactgcacccagcccatcctgttcttttgatccacgtattataacataagaggctgacttattctgagacaaggacatcatgggtggagcccccttctcatctcggtgtgacctagttcagcttccccatctcttaggcagataccattgggttcagaaaggttcaaggacactttttctcctcttagcttagtgcttcctcaagtgatccatgacttatgaccttatgacgatgccgtgtggtgagtctgaaatcagatgaagatttttatcccgacatgatgaacacaagcattgcataacctgactcgggttacccaggatctttcctctgcttgtggtcaccactgctaggattttggaagaaccctttaaaaactaagctctctgaggacaggcatttttgtttggttcactattgtgatgccaatgattagaaaaatgcctgggcccataggagggactcatgttcaatgcagaggtggataaatgagaaagagactgtttgccgcagaatactaagagattttattgttcttgtcataggaaccaggcaatattccagacacacatgacatcagtaacatccatatgtctgtgatggggtaggagagaagactacttttcaggtgggacattttgattggagagggtctctgattcagagagtgaggtgagctattttcttcttgggagttcttggcatttgataatccttggtgtttatttcaaaatatggaagaatttgagatttacttagacatcttggcatgcagtgctaaacctcagacttcctgaatttatttaccagctaggggaagcatattcccaactttaattgtatttacaaagggctctaatctggtgtgaagtctgaaggcatatttgttgtaggagttactcaattagccagtgagaaaagaacaaaggaaaagtcattatgcagatgtatgcccattcaaatctattccgcctctagatgctttcttcgtagtgaagggaagaactccagtctgcaagtctctcgtctctgctgtgttttctgctaattctcttctaatattaggccatgaatgattaataatattgcattttgacactgttagattttgtcaatttttttcaatataaaagcagataattacagattactttaacatccaggaagtgaaatcaaccatgaattacactcagactcatccacgaccccttgaatatctgtcttttttttttcaataggagattgaagtttctttagtcaattacacaagtcatgtctgacaattgagaaaatgctgttcacataaaacatcataaattaaaaatatacagtgtttatattttaatacagtagggtcccaggattcaaacaaagaattttgatctcagaggttgcattatgtagttatgtgttctgctttaaagaactatactggaggtaaacttgaaactgcctttgcagaaattataactgaggaaattatgacagtgaaagagatcagacctaaccaactacaccttttatctaatcttaaagctatccttattcattcctgggcataggccgaaataaccttgggaaggaatttagtttacagtttgactctgaaacaaaattgataatagccgtttcctgaaaagacctccttcttgcctggtgaccagtctgcctttgtaggactaacaaattggctacaagattggaaattatggtttaggggtcatgcagcccctgactccaagagtctgaacctccccagattgctcctagggatagcgtcattattgtaaaacttaagatcagtgcttgagatattttgcaaaccctgcactcagtggatcagctgacaccacccagactggtaacttggctcccagttctgccatcccacccaggaacagaagaccacaaaaaaacctcacttcgaccccctatgataccatctccaacctgaccaatcagcaccacttcctgagccgctacccaccaaattatctctaaaaactctgatccccaaatgctccaggaaggctgatttgaataataataaaactcaggtctcccgcacacgtggctccgtgtgaattactgtttttccactgcagttcccccatcttgctaaattggctctgtctaggcagggggccaggtgaacccattggatggtatatttctcaagagtcaaatattaataggtttaacatgtaagacttacatatgtgtgtgtgtgtgtgtgtgtgtttacatatacatatatttcaatagcttttggggttcaagtggtttttggttacatggatgaattataaattatatagtggtaaagtctaagattttagtacctgtcacctgagtagtgtacactgtacccaatatgtagtttttgtatccttcattcccttttcatcctctcctcttctgagtctccagtgtccattatatcactctgtatgcctttatgtacctatggcttagttcccacttataagtgagcatatatggtatttggttttccatccctgagttatttcacttagaataatggcctccagctccatccaagttgctgcaatgacattattatatcattattttttcatggctgagtagtattccatggtgtatatgtaccacacattttctttatccactcattggtcgatgggcacttaggttggtttcatatcttgacagttgtgaatcctaaattttacgtgcaaggttttgcatctgtagaggaagacaggattctcagtgcatgtgccaatttttgggttttccacttgagaatcttcaccagttttctcttcagaatcaaattcctgactatctggtgcttcagagttatccagaggttcatcattcagtctctgggttgcctctgtcatatactgtactctgccgcttttgccaattgtttactctccttttccaagtggtcaatttcattgttctttcttcaatttctctgtgaagcctctcattttccttaagtgtttcatagagggtgttcctttgttctgctacttctctccaatattgaggggataaatttcatttaatcctaaaatcaaatgcttcttgggtgactcctccaagattttaattgtcactctattctgggacaatgacaactctagagtgggaagtcctggctgtcaactggtcattccaatgcttcctcttggatatgctttgggccagtcacttttttttttttttttttttccgacaagagatctggctgtggaaggatgaatcatcttcagagttcttcttggggagaaactgttctttacatctttgattcctccttgtttctactttatcctaggattcattatacagctggtaaagcacaaaagatgggaggagaggattaatgatcatagtgaattcaggtgactgtggcacagccaacctacattgatccccactgtcgctggagtggctggggcacactgctgaaaagacttactcctcttgaacatactcctttgagtagtttttatatatgtaattttgcatatttttttcattttttttattattatactttaagttttagggtacacgtgcacaacgtgcaggttagttacgtatgtatacatgtgccatgttggtgtgctgcacccattaactcgtcatttagcattaggtatacttttaatcgtagtgccatacaattgtattgcattttccatttatagcatattataattattttgacttttattatgaaactttcaaacagaaaagtagatagtataataaaataaaataaaaagtatatatataacaagtatgtcggctgggtgtggtggctcatgcctttaatcccagcactttgggaggctgaggcaggcagatcacttgaggtcaggagttcgagaccagcctggccaacatggtgaaatgctatctctactaaaaataaaaaaaaattagctgggtttggtggtgggtgcctgtaatcccacctactcaagaggctgaggcaggggaatcacttgaacctgggaggtggaggttgcagtgagccaagatcatgccactgcactccagcctgggcaacagagcaagactccatctaagaaaaaaattatatatataacaagtatgtaaacaaaatacataagtaaaaggtagaataaaaaaagatagcataatacacacccatgtatttattgcttagaattaacactaatattatattttctttgtgcattttttttcttaagtggttcaaaagaaagtacagacatcatgatattaaaccctaaatcagtggctctcaactgaggttgactttgacccttgtcctccgcaagaggacttttggcactgtctggagacaatgttggttgtcacaaaaggaagcatgcctgcatccctggtagagatcagggatgttactaaacatgctacaatgcacaggactgccccctccaaaacaaagaattatctggttctaaatgccggtagtgctgaggttgaaaacctttggtctaaatgattaagaatgcgtttcttaaaatgcaaaatttcacataaccacatagcaccatcacttctaacaaagagaaaaataactctttaaaattgtctaataaccagtccatgtttccccaccattccactaaaatgttttttacagctggttttagcaaacactttccattttattagcactgttaatagaatctcactctaaatgactacagaatagtctgttaaatggattccctgaaatttattcaaaggatctatttttggatattagttttgcttccaggttttagacaaattatatttttgtaaataatgagagtttacttcttttctaactttgtgccttttctttcttttatttgccttatgttctggctaaaaacttcagtaaatactgaacacagcatatgagagtgggcatccttttgttgttccagattttaggagaaaaagatttaatattttattaagtatgatattaactgtaggtttttaaagatgaacgttatcatattggagatggtcccatctattcctagtttcactgagcgtttttatcataaagaactaatgatttctgtcaaattttttttctgtgtattttgaaacgatcaaatggttttcaaactcttactctgttatagtatgatgaattatattgattgattttcattaaaccaaccttgctttcttggaataaaccttgcttggtcatgatgtattattctttatatgtatgtataaatatatatctatagatacatatacatatatacatatatctatctatatatatagatatgtatacatatatatatagagagagctggattctgtttgcaaatatttggtttagaatttttgtgcctatgggctgggcgcggtggctcacacctgtaatcccagcactttgggaggccaaagagggcagatcacgaagtcaggagtttgaaaccaacctcaccaacatggtgaaaccccgtttatactaaaaatacaaaatttagctgggcgtgttggtgggtgcctgtaatcccagctacttgggaggctgagtcaggagagtcgcttgaaaccggaagggggaggttacagtgagtcgagattgtgccactgtgctcctgcctgggcaacaagagtgaaattccgtgtcaaaaaaaaaaaagaatttttgtgcctatgttcgtgagggattaggctgttattttttttacttgtaatagctttgttatattttggggtcagggtgatgctggccttctatattaaattgggaagtgatacctcttcctctatgttccgaatttgtgcattattgatatttctcccttacatgttttgtagaatttactaatgaaccatatatgtggaaaattttctttttagaaaggttttacaaatttaatttctttaatagccatggggttatttattttctgtgtcttcagttgttagtaatttgtgatttggattaattaatataagttgttgaattgttagaatgttttaatatttatcctttttaacatttttagaatatgtagtgctgtttcatttttatttatgtgggcaatttgtgctttccctcttttttttgtccattgttgttaagactttgtattgccactttactattagtatttcctttcttttacttgctttagatttaccttattcttctttttctagcttcttaagatggaaggttgtatatacctttcttctccagtgtaagtatttaaagtcataaattttcttctaagcactgcgttagctttatttcacaaattttgatatattttcatattattcagttcaaaatattttacagtttcctttatgatttcttttttgatctatgggttatttaggagagggttgttttattgcccaatacataggggatttgctagatatcttattgtgaatgattttattctatcgtgttactctgtatgatttcattctttgatattcattaatacttttatatgatccagaatatggtctattttactgaatgttccatgacaactttaaaagaatgagttttctgcagctgttggatgtagtagtttaaaatattatgtcagtttggtttacagagttgttcaaatagtgtttactgaatctttgatctgcttgttctatcagttataagttgagcatccctaatttgaaaatctgaaatctggaatgctccaaaatctaaaactttttgagtgctcagagtaaatgctcattggatttggagcttcatattaggaatgctcaaccagtaagtataatgcaaatattccaaaatctggaaaaatccaaaatccttctggtctcaagcattctggataagggatgttcaacctgcaccaagagggtttacattctccaactatgattgtgaatttttttttatttctcctttcagttctgtcagtttttcctttgtgagttttggaaatgtgttgttaggtacatctatattcatgattgttttcttctcaattatcctttttttattattttgaggtattcttcttaatatccagtcatactctttgtttaaatgctacattgtctgatattaacatagtcataccagatttcttatttttggtgttttcatactgtatctttttctttccttttactttctattggcctgtatctttataataaaattgtgtttctcaaaaacaacctatagttgggtgttgcctttcatatccaatttactaagctctgactttttcttagaggagttagtccatttacatttaaggtaattattgatatgattcgacttatgtctcccatcttggtatttgttttatatttatggtatttattctttattcctttgttcatttttgtcttttcaggggaaaattaagtattcttaatattacttttatatcctctgtggatagttagattatatttcctttttaaaaaatttagtggttactatagaaactacatgtaaatgttcacagtataccttcaaacaatgtttaacctaattcacagtataaaaatcatgctgcagtataattccacttatgtccaatcctgccttttgtgctcttgttatattctgtgttacagtgacacatatggtattaatcctatcatacgttgttattatttccagtctacactgtaaatagtcacttaaatatttgagaaattataaatgtaaaaataaaagtcaaaaaaggtcttttccatttatacaaatatttaccttttctggtgtttttaattcctttctgcacatctggggttccatctgatataatttccctcagcctgaagtatcagcaagtatctcagattttgtctctctaaggatatctttatttcatcttcattttgaaggatattttttgctagacatagaattctctgcttccatttcttttttcttgtcatactcaatgatgtcatttaattgttttctggctttattctagattctgatgaaaagttagccatcataaatttttttctaatgtatttaatgtgtcattttattcctattgctttttagatttgctgtttattgttttatgtgatttttggttgttaaatagctaggtaaggttttctttatatttatcttgcttagggttcactgagcttcttggctctacaggtttatgtctttcatccattttggaatgttctcagatggttattattatatcaaatatattatctatccagtttttctcttctctttctggaacttctattacatcacttgatatcatgttagattcatttatactgtccaacagatcttgaatattctgttgtattttttccactatttttgccttttgtgtttcagtttggatactttctattgatctgccttttgtccctgatgctttcatctgttttttttccagtgtgctgttaagcacatctgatgttattgatttctaatattgtatttttcattgctacttatcccatttgattttcttctaacatttcctggtgaacatgtctttaggaaattttccatttcttcatgcatgttatctatatttttcgttaggcttttggcatttttattatagttattttaaattccctgtctaataattccaacatctgagtcatctgtggatctgtttttcttgattgtttctactcttaactataggccacttttttgttgttctttaaaaaaatattaatacgtcttctaatgtttgattgtatactgaaaattctgtataaaagaacagtagagactaaagtaaaaaatatttacatccaaaagagcatgcttttgataagacctgtagtaaatctctcctctcctctaaaatgatcttcactttgtggaatttagttcatttggatttttctgtgtccttagttcactgaaggttttcttttttccaaatagctttgtagctcatctaatttgttttgattatttgcatgagaatggcattttctgttgactttctatttctgaattcaaagtagtatgcaaccaaatatgcttcaacaaagatgtgcattcaccaaatatttttttaaaaatttacaataatttccttaacataaattctagaaggtagacattgatcaaaatatctaaagattttttatggttcttaataaaatatggtcatattacatctcaaaaaaacaaggaagttatacctatttttaatgagtgcaaataaccattttgcttcataagctttaagtgttataattaatttgactttgctaacttattcaaaaaatattatttcatattacatacctttaacttcaagcactgtacaggatcaaaatcttatgttcattttttagcaggactgactttacctggagaataagtgaacccattaaacatcagaattgtttgagtagatagatggtaatgactgatatttattgagtgctttttatgaaaaaagtggtgttttaattctcacagtgacctgtgaagaaggttatcatttcatcactccagaaggagggtttattccctacagaggagaaaagagaggctctgatataatgggacaggattaaattcaggagaatctgagccccaaacctcagtcttccaactttgatgtgatttaaatcatatctgaatgcaaccaatattgctatctgtattagtcagctgttgctacaataatgccatataacaaacaccccctaaactcacacttaaaacaatagttttgtattctcattgagctgcagtttggcagtagaagttttgctttaaaactcccctcttagtcatttattgaagaaaaacataatgaatacctcttattttccaagcactcttctgggctctggagaaacaacaatgaataaaatacacataaatgctgcccttaggaaacttactttcttgagggaagagacatacagtaaataagtagactatatagtaagtaagatgctgataatttctttattttgtttatttttctttttctaaattggtttcctcagattgaagataatttctttctttttttttttttgagacggagtctcgctctgtcgcccaggccggactgcggactgcagtgggcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgataatttatttcttttgtttttttttttgagacggagtctcgctcggtcgctagactggagtgcagtagcgcaatctcggctcactgtgacctctgcctcttgggttcaagcgattctcctgcctcagcctcctgagtagctgggactacaggtgcacacaccactacacccagctaatttttctatttttagtagagacaaggtttcatcatgttggccaggatggtcttgatctcttgaccttgtcatctgcccgccttggcctcccaaagtgctgggactacaggtgagagccacagtgctcggccagattaatttctaatgacagctataaagcagtggaagaggagaggacgggctgtcaggtgaagaacagcaacagggattgctgttgcaatgtgctttctcttatcactgcgcttcctagcataccgccaaaccctggcatctctgttcatttttacaatgcagagctatttcactacttctttgtttcactgtcttcttctaaactgtgccctggggggcctcacatttcataaccaaagctgcctatcaaagtgttttgctaaagaaaatatatttagtctggagagaaataatgtctctcccttagggacagaagcagctgcagtcagtagtagttttagatagcatttttctcctctgtcacgcagcattgcaatctcttctttatttaaaagttgaaggtcagaggtgaagatgtgtggaaacttactgaggaaaggagacatttgcagagcacccactatgtgctagatctggtgcaagcagatgtcttcaaataatccttgaattagacattatgattcccattttcctaatgcaaaaactgagctgtatgcaggcaaaataatccactctcggacacaaaaccagcagttgcagatctaagttttaattcttgagtgtgtccttccagcctcctcccaaccaccttcttgttgctttggattggatgtagagagctgcttattttataatctttgtggctagacctggaatgctggctttgtgtttctgggcctctctcccgcttcatggctagtctgtgtggtatagcccaactgctgccccagtaataggaggaggcagtcaggtctggggggaaatgaaagaattcccagggcacccggcaaatgaatgaattccactgatcttgtttggttccttatgggatcatccatcatgatttaacaacttgcagcccagggtaactacaggcatgcttcttgcccaaagccacagacacagtgtaattcatggctgaaaaacagatttgtttttctgttattattacctgtatcatgcccattatactatattatatgctgtgttatcatgtaatttagtcctctgtctgccgcattgacgtttgcttttgagaagactcggcttttctcattcttttgtaatgcactaaagtaaacaaattccctggctgtaatgtaagcagatatttgttgagggcccactgtgtgtacagtagatgggatacagaaaagctctggttttgctcaggaaacttaccctcctattgttttctgcatttaattttatttttaatttttttctgaggcagagtctcactctgttgcccaggctggagtgccctggcatgatctcggctcactgcaacctctgctgcctgggttcaggccattctcctgcctcagcctcctgaggagctgggattacgggcaccggccatcacacctggctaattttttttttttttttttgtatttttagtaaagacggagtttcgccatgttggccagcctggtcttgaactcctgacctcatgccatctacctgccttggcctcccaaagtactgggattacaggcgtgagccaccatgcctggcctatttttaaattttttaatgcaatatttgaaacacagaaataatatatatatataacatgtaagttatcaaacatatcaacaaaatgaagacccataaaatcattgctgtcttagtccatttgtgttgctataaaggaatacttgagactgggcactttattttaaaaagcagtttatttggtgtatggttctgcagtctgtacaagaagcctgacactgcatctgcttctggtggggcctcaagctgtttccacttagggcagaaggggaagtggagggactgtgcacagatgacgtggtgagagaggaagcgagagagagaggaggagatgccaggctcttttcagcaactagttctcctgggactaagaatgagaacttttttttttttgagacaggatatccctttgttgcccaggctggagggcagtggcatgatcttggctcactgcagcctccacctcccaggttcaagtgattcttgtgcctcagtctcctgagtagctgggactataggcgcctaccaccacgccctgctaatttttgtatttttagtggaggcagaggttcttcatgttggccaggctggtctggaactcctggtctcatgtgatcctcccgcctctgcctgccaaagtgctgggattacaggcatgatccactgcacccagcccaaaatgagaactcacttctttgagaatggcaacaagtcattcatgagcaatcaactcccatgccccaaacacctcccaataggtcccacctccaacatggggagagatttcaacacgatgtttggaggatcaaatatccaaactacattaagtgcctaactgattgactaaaatgaccagttctactggatccatctgggtggaaagtgcctcttgcatcccccatcctatccccatgtggaaatctacaatcctgttttgtgtttatcatcccctttctttgctttgttagctttaccacaaagctttatcagttttgcttgcttttgagctttataaagatggtctcataccttaaataatttttttttttttttgagacagagtcttgttctgttgcccaggctggagtgcagtggcacgatcttggctcaccgcaacctccacctcccaggtccaagtgattctcctgcctcagcctcctgagtagctgggattataggcatgtgccaccatgcctggctgatttttgtatttttagtagagacgaggtttcaccatgttggtcaggctggtctcgaactcctgaccttgtgatctgcctgccttggccacccaaagtgctgggattataggtgcgagtcactgtgcctggccttaaataatattttaagacttgctttgttcacactatatggtttctaagatttattccatttttcttcatgcttcttttctttcttttctttaaattgaggttttttgtttgtttttgttttgttttcaaactctgcttttccctttacttgttggaattttaaaattccaaattcaaatattaagattctaaaaattctaaaattccaaaaatttaaaacctcttttctatcatctctcccttgaaattttattgtgtgtatcaaggaaaattgaaagcccataaatatcttaacttccccttccaaatactgtaaggactttatgatactttaatgtcaatgacttccccattacttaaatgtcaatgttgtcagtagtttcaatctcatcttaaattctcacaaatcagattgttactattaatattttatatagataatgttttagatttatctcctagtttgtaagcttacttgctaactattcttcttacactcgaaatttttttttctgggctatttttttttttttttttttagtattcttttagtgggaatttatcggtggtaaaaatctctcagtttttgtttatatggaagtgtcatcatttcacactcattcttaaaagacacatttgcctgaagcgcaattctagaatgatggttgttttcttttagaattttggagatgttattccagagtcttttggcttctgttgctttgcctgaaaactcaggtgatgatctaaatgtagtgtttttgaaggttatctgcccctttcccctgtgagcttttaagtcttctctgtctttgatgttctgtggtttcactgcaatatgtctagctatgaatttctttgcattcatcttgcttatatatgctgtgcttggacctgaagattttatgtgtgtgtttgtgtatatgattatctatctatctatctatctatctatctatctatctatctcatcatgcctcacttaacaatcgggatatgttctgagaaatgagtcattaggtgatttcatcattgtgtgcatatcatagtgtccttatacaaacctagatagtgtagcctcctacacacctaggctatatggtatagcctatggctcctaggctacatgactgtacagcatgttactctactgaatactataggcagttggaacacaatggtaaacctttgtctgcctaaacatatctaaacatagaaaaggtccagtaaaaatacagtattacaattttgtggagccactgatgtatgcagtctgttgaccaaaatgttatgtggtacgtgactgtattttaccatttttacaacatttctttccccctcccctcccttcccctcccctcctctcctttctctctcggacagagtcttactctgtcatccaggctggagtgcaatgacgcagtcttggctcactgcaacctccgcctcctgggttcaagcgattctcctgcctcagcctcctgagtagctgggactacaggcatgtgccaccgtggccggctaatttttgtatttttagtagagacagggtttcaccatgttggccaggctggtctcaaacttctgacctcaggtgatctacccacttctgcctcccaaagtgctgggattacaggcatgagccaccctgcccagcctttgcaaaatttctatctattatcacttttaatattgcctcttatccagtctctctattctctcctaatattatgtctaatatattagacatacattagtctgtttctttctgtcctctgtatctcctaacttctctttaatagttttaatcacctaatctatttgtgttgttgcaccctagataatttctttagacatatcttcaatttctaattctctttcctgctatttttaatctgaattgagtttttattttatttttcttttttgttatatatatatttttgagacagattctcactctgtcacccaagctagagtgcagtggcacgatcctggctcactgcaacctccacctcctgggttcaagcgattcttgtgcctcagcctcctcagtagctgggattatagacctgcgtcaccaggcccagctaattgaattgagttttttacttcgacagttatatatttgatttccaaaatttttatttgaccatttttcaactatacctcataatttttttataaacgttgattattttcccatttttctaattccatcttttatttgtttaaatattttaatcagaattattttatattatgtatctgattatttcaatggttccaatatctgaagtttgtgggagtaaaaatttgttgtttattaattctgctgattctcactcatggtggcttatttcctaatgagtttggtggcttttgattataagctcacagaggcttgatcttaatctatggaaattcttatgacccaagtagaaaatgctttcacacagggagaattttcatttgcctccattaggagcctgggacaccaccagcattgtcttccttcaaaataactagccttacatgggagtctcagattccccaaccttgtcacagtcagtgactagttgttaatttaatcataatcacttgatgtatttttttaatgtcacacactgtccggtgtgttccacaaacattatttctaacttgcaaaataatcttgtaaaccacttcactgttgaggagataaaagctgggggaggccttccacacaatctgcttctcacaattctcctacacttctacaccatctctgcccatcaaaatccctcccctccttctacaccgtcctcaaatgctgcctcctcagggacactattcttgagccacaaagctgagcttaggcttttgctcctgtttatttgtttgttttttgagacagagtctcactctgtcacccaggctggagtgcattggtgtgatctcacgtcactgcaacctccgcctcccaggttcaagtgattctcctgcctcaacctccctcccaagtagctgggattacaggtgcctgccaccacacctggctaactttttttgtattttcagtagagatggggtttcactatgttggccaggctggtctcaaacccctgacctcaggtgatccgtctgccttggcctcccaaagtgctgggattacaggcgtgagccaccgtttgttcctagaacacataatttatatcggtgattcaagtaatcatcccatttcacagatgaagcatttgaggccctggagtttcatttgtaggcatttgtgcggatctacctaaaatgtcatctggctgcaaggccatcgcttcagtgttatttttgcatttatccttctccatccctcctaggcaacccctagttccttaccttcctcatatacatacagaatgcaagactaagaggaaggattccaaaaagttggatacattaaatttaggtggagagatgaggaacatatggagaacaggccatcagcttagtgattgtcaggcgattcctgtcatcaatatgtacccccgtggcccatgttaagtcccttactcattgggactgccctggtcctccgttgacctcaggtaaacaatcatttaagtgggattttattcaaaaattgcacttagagtggttttagtgggtcacattggctcttccatgaattctttgcgtctttttaagccagatctttggcattttatcaatctttgctttggcatcacgtttgaggatatattcaggggattttttttatttttaaaaaaactcttttgtttattgacagaaatagcatttctactaatacctcaagagcaagtactatcatgaatttaaattatttttccccaaatttaatcaagagtacttgagttaccagcttccaggttggccagaagtcctgaattaccttattgagactttctgctccagttccagggttcttgtataattaggagtcctcacaacttgtactcccaattagggaaaagcgctggtatttgtcagcctgtttgggtttcctactgagagaagatggcactgttgaacacggagccagtgctgctgggctacaatgtagtgcgggctggtaactctcacggtaacccctcttagaggtcctgttctggatgaggtttgtttatccactcaccacggtccccacaactccaatgccttttccaatgacagcaggtgaatgagacctacccaggatcaggccatttttactttcagcccctgagagagaaaagaaattaatttggttctcttttctgaacaatagagatttattcgttctaaaaattctacaaaccatatccagcaggcaaagaatgcctggactttagataaaccaaaagggcagtcatcctttgtggcagagtgctaatttttctccagtatttattttctccttcattttgttagcagtagaacttctcaagctttcactctgtatgtgaccatctgggtagagactacctttcttagcttctcttgcaactgtgtgtggacacgcaactaaattactgcctccagggtgtgagcagaacggatgcgtgcagcttcaagtcacagcactggaaaggaaaatacttgcctttcattctctatttcctctttctacacgttggaatttgacggagttctggcaagtctacttcaaccatgtggatgaggacaatacttcagaggaaagaagaacattaaaatgcaaggaaccagatccctagatgactgattgcaaggggcaaagaaactatggcagccctagactatgtacctctggaccaatctgtgaaagagaagtagattcctacttggcctgagtcactgtgtttttggatctcttgtaccagcaactcagccagtgtcctaaataacatgcatcctccctagtgggactggagagcttataggttcagtctcactgatgatccaacctctttagagcaggcaagaggaatttcatgtacctcttgataaagcggtaagcaaaacacaaattcagtgggacactccactgcaggtgattttgaggttctgcagtctgtctatcaagttaaatgagaaaaaagaagatagaggatcctggctgcataatcacacatgcacggaaggcaaaatcatttggacgggagccttgagtggtggagaaagcaagggctctgagccagatatttcagagttcacatcagtgtgtctttataatttagttgtttaagtcactactttctcatctgcaaaatgggaattgcaatgcatatttcatgtacttgttccaggaactaaatgagataatctatttaaaggtcctggcacagggtctggtaaaaattaggtgttaagtgaaagtaagttcccttccaatgtctgggcttttgatcattgcaccaagctgcctctgcaaggcacacaagactctaggtgatctgattcctccctttttcaccccttcagcttcatctggggccacttttcccttgcccatgactctctgactcctaagcccatgactagtttcccttcagtaccaaagccattctaaattctctcctgcctctggatcttcatacttccttttccttctgcttgcaaccctttctcatgatcacatttcagagaagccctcctgaggaccacgctatctaaagtagtttcttgtccactgtgttcagcagaataatgacaccccgcaaagatgtggtttttatgaagacagaaacatctgtcttatttaccagctcacctgctacagtatggattatgtagcacatactcaatatttattgaatgcatatatgaatgaaaaattgaatgggaactttgaaattcatcctcatccctggaacccaagagtatgttaagtgacatggcaaagggcaattaaggcagcaggcgaaattaagtttactaatcagctgaccttagggagctattcctggaatatctggttggacccaaaggaatcataaagatctttaaaagtggaagagaggggcagaatcgaagagtcaaaggtaggagtgtgatgacggaaacaggtatgttactgcccttgaagatggaggaaggggccacaagccaaagaaagcaggcagcctttagaagctggaaaaagcaagaaaatggatgttctctagagcttccagaaggagcagccctgctgacatcttgatctttgcccagtgccttgatttcagctcagtaattttagcccatgttggacttctgaagtacagaactgtaagataatacgtttgtattgttttaagccactaaatttgtggtaacttgttccagcaacaataagaaactaatatacctgtatgccagcccagtatctaatatatatatatcgccctctttatttgctgcctaacactcagcacgatctgcaattatcttatccatttatgtgtcctcttgacttagtcaaatggggcttttatgaagacacaaatgtctatcttatttaccagctcacctgctagagtacgggttatgtagcacatactccttctttattcatttattaattatactttaagttctggggtacgtgtgcagaacgtgcaggtttgttacgtaggtatatacgtgccatggtggtttgctgcacctatcaaccacactaagtatttctcctaatgctctccctcccctagccccccaccccaccaacaggccctggtgtgtgatgttcccctccctgtgtccatgtgttctcattgttcagttcccacttgtgagtgagaacatgtggtatttggtcttctgtgcttgtgttagtttgttgagaatgatggtttccagcttcatccatgtccctgcaaaggacatgaattcctccatttttatagctgcatagtattccatagtgtatatgtgtcacatttctttatccagtctatcactgatgggcatttgggttggttccaagtctttactgttgtgaccagtgccgcaataaacatacatgggcgtgtgtctttatagtagaatgactccatatttttttaatgcatgcatgaatgaaaaattgaatggaaactttgacattcattttcttcatctgcagggcttgtttctgagagtgtgcacggagattgaagggcaggggctcatgtgacagtgtgaagcaggaattctgaccgttggccaaaccaagccctgaaactcaagttctgtttgggagtgagaggcaggttagaggagataaacacccagccttttaattttttttttccagcctgctttaaatcacctgtaaatctttagtggccaccaggaggtgaatgactcatgctaccttttctcagcaaaggctcttcaggatgggacactccaagtttttaactcccagcaacagttcggctcacagcgagaccgggccctctgctgtcactgaagtgtgtgtttgtttaattagggcgccgagtagagcctcatcctggtggcagatgttgccatgtgtagtataataaataaaagtctttataggacccagcaggcagtagagccttcagttagcagatggcgaaatattaaactggcagagcaataacttaactgcctgaatcagctggtccctgcccggatttgctccaacatgaatcaacttcatataggaggtgtcgctcagcctcagatgtgtaccctcacctgccctcgctcctggtccctgctaggaccatgtttgccttggcataccactattaaagtcagattactgggtttaataccattattaaagtcagatacataagtttttttataaccttattagctggtcaaagagaggtgcttgctgggctggaccgtagggttcttttacaggggaaggaaatgcagtaagcctgtggatgtcctctgtgccagtttctgcttggctccagattagccagacagtatgttacctggcccctgggccctcgtggtgcaggagaaggatcccacttggctccaggaatcctcctgtttaagaccaggaggatggttcagttagcccagggagaccccactggaggagagaacagggctttttgttctgaaaagacccaaaaaagggattgactgacatctattacattgctgcaggggtggagtgaggggcattggacttgtttactaaattccagattatacgactgatatttacagagggcttgctatgtgttgggactttggataagggctttgcagacgaacagaaacccaccccatctttaccataaccctgtgaggcagtaacaacgaacccttctagcgctgtgtgccaggccccgttccaagagcttaatgtacattgactcactcaactccccaacatgaaacattaaacccatttctcacatggggaagctgaggctctgagaggtgtgatgatttgttcaaaaacacacagctagaagataccggagctaagatgcaacccaattgtgtctaaactcagaggcggcagttgcctttgactccaggaggcataaaagtaaacttggacagaagatggtgaacccgtaggcaaaatgccacctagaaaatgaagtggggaactgatactaggaaagaggatataaaatttatatttgttgccatttattgccataaattcggctactttttaacagatatctgaaataattttctcctttaattcttacagaaagccttggaggcagcttcaattagaagctaattttactaattagaaaattggtatcagaaggacgattgaacgtgtccaaggtcacacagccagtaaggagaggggcctggactggagcagacctgtctgattcactcagacaggactggagcagacccttgctttgttcactcaatagttttttccaaaggctttttaagaagaggactttggagttgtaaagaatttagatacgtggaaatgagagaaaggccttccaggcagaggaaacaggatgaacaaagtcttggcaggtatggacaactctgtgtgtgtgtgtgtgtgtgtgtgtgtgtgtgtgtaggtaggtaggttggttgttggagacagacccagggaagccttgaatggcatgctgaaagaattggtctttctgcccgggcttggtggctcatgcctgtaatcccagcactttgggaggccgaggcaggcagatcacttgaggtcaggagttcgagaccagcctggccaacatggtgaaatcctgtctgtactaaaattacaaaaatatcagcccagcatggtggtgcagggttgcattctcagctactcgtgaggctgaggcaggagaattgcttgaaccccggaggcagaggttgcagtgagcagagatcatgccactgtactccagcctgggcaatagagggagactccatttcaaaaaaaaaaaaaaaaaaaaaaaggtgcttctttctctggcaaaggaggatgctcaagttttctaagtcaataattaagctcatgcaaacaaagggccctttctgatcaccatggtgggtttccactgcctgcttctccgctaacttctataacgaaaatgatactcaagacttttcttgccatcatggtcaataatgtgagggtttgagcacatcctcagagttaggctttggaatttcttgaattcctgctgtgtggggcgtgctggggagtctttggtctgagggctggctgctgctcgctttggccctttgatctcccagtgcccgggatctttcagtctagcttttcctgtgtcctgcattgccagtccccccaccctctggatctgtcccctttttgttgtctctgagctaatgggacagattccatggatgctggcctggacctctctttcttcagcctgtctcatgacctctaaggcctggcctgaggaggaggcataactctaggaggtcgaggtgagcctggcgctgcaagtatgcccctaatttgtgaaaccacagtcatagatatcacagttggttaatacactcgtccttggattctttcaaattcattgctcctgttcaaaaaacatttctctttttttcttattgcagtagtaatacatgcttattgtatgttatgaagaagatgcagaaaaatataagtgatgaaacgatagcccataataatcccacaaccccaagacaatcattattaaccttgggtatattttcttacagtcattcatacagacgtatacaaaacacacgtctgtctatatgaaatacttacgtgcttaaactcataccagatatatgattttgcattccatgtttccactcttataaaatcagtgcaatttttttacattgctaaacttctttgtaaaaatttatatagaaaaacactgtaggccaggcacggtggctcatgcctgtaatcctagcactttgggaggctgaggcgggtggatcacctgaggtcaggagatcgagaccatcttggccaacatggtgaaaccctgtctctactaaaatatgaaaaattagccgggcatggtggcacttgcctgtaattctagctacttgggaggctgaggcaggggaattgcttgaacccgggaggtgaaggttgcagtgagctgagatcacaccactgcactccagtctggtgacagagcaagactccatctcaaaacaaacaaaacaccataaaacaatattaaagggaaaaaagcagaatttgaattcatatgtttaatataatttcaattatgttagctaaaaacacatgggtacacgatgcctatgcactacaaaagtaccacacaggatggaagcagagactacaaaatattaatagaggttatctctaggggatgtgttttattttattcttgcatctttccatgttttccacgtttttcccacatattaatcatgaatttttctaatgagaaaattttgcatagctacataatagtccaagatatgaatataccattgtttatttaattattggcctactaaaggcctttgggtagtttcaaagcttttacatttataaataatgttgtgttaaatgttcctttatctgttcaacagatatttgagagtctatggcatgccttgtatcttggtgcctatatctgcatatgttatataaataatattttatttttgtggaaactgaagagcaaagaaatcaccgagttagttggggacacggatgggtctgtgcttttaggtctttcaattctgaggatttatctttgccagactgctttcctcaaacctctggtctccctttggcagaatggtggcaaattggaggttctcttgggtatattgagtcacagatctccttgaatagtgtgtgacactactcaagaagtacctacttggcccccagcctattgcctggtggcctccttcttgcagatgcacccattttgcagatgggtcaaagcatgtagtcttacagcacaaatacttgtctttgtggaaagtcatcctccctctgcttggctgctagactttcctgtgtgtccatcataggtgtggctttgtggcacccagtcaatctgattaagatggttcttgcttatcagcttggtgctatttgagatgatacattggaagtccacctcaaatatcacctcctccctgaaattatccagatactctcagacaaagttcacagctcttttttggatttttttttttttgtgtgtgtgtatggccttattttaaaaacatatctctccaaaccatggctgtgtctgtacatctttttctcatcaagtaggttattagctctttaaggtcagggaccacatgttatccactttggtaccctgtccatttgcttctgtttctcagtctagcgcttgccttcatctccactgccactattcaagtgcacaccttctatcaccacccacctagaacactgaaccagtgtccgacctgctgggactccctgcatctgctctcgtgccacttacaatccagttttcccatagcagtgaaagggattatttgaaatcacaaatcaaatgtgccatttctttccgtagctcagcaagatctggccctcgcctgcctctctgacatcatcccagtgaactcatccccattcctcacagcacttctctctgatcccttttatcacatcattctgcataacagtttggattattgcccagcaagtgttgatggcctccccgctccaattgtggatggtatttacttccctaccacatgattttgggcttggccatatgactcgttttggccaacaggatattagtgggtagaagtgaacagagatttgaaatgtgatagagtggttgggctcacctactttagttcttccatggccatgagggtaacatgccctgggtaacctgttggtcccagaagagtgagagatgcaaggaacagacatgaactaaacatatggcctggagccaagcccagcctagatcagccaaacccaggacaaaccatagttgcataaatgaggtacacatgcttgctgttgtggagttactggctgtatgctacccagcactgctgtggcatagttgactaacacaccctattttatgcacttcataattattattttgaactttccgtcttttctaatcaggacatagtttctatgataaaagagacattgcctattttgctctataattccagctatatatatgaaatcaccaataaatatgcatgtatgtgtgtatgtatgtatgtatttttgagacggagtcttgctctgtcgcccagtgacgcgatctcggctcactgcaacctctgcctcctgagttcaagtgattctcctgcttcagcctcccaagtagctgggactataggcacgtgcacctttttttatttttgtatgcctggctactttttgtatttttagtagaaatggggtttccccatgttagccaggttggtcttgatctcctgaccacgtgatctgccagccttggcctcccaaagtgctgggattacaggtgtgagccactgtgcctggcctgccaataaatatttattaaatgactgaatacccccggcatgcttagcacaatacctgtgcccgatcaatatttgctgaatgcagttggtgaaccatccaaagcagcctgtattgtgtcctaacatgtatatctttaaactcaacttggcacgtgggtgacacctctatcccctctcttcctctctctgatcacataaaagatcctccttgtaagaatacacacactgaaaacagatgatgtgtcaatgccgtaatttaaaccatgaatctgtacttgcttaaagatgaacttgtttggaagaaaaatgaggaaaatgcttgtgcccgtccaacagagtccccggataagtacatcaattttgcttcttagcggatccagcacataataaaagaaaactgctgaggtcagcagcagcagagaagccacacttcttattttcacaaacacagttttggggatggtaatcatatctattagcaagggtgacaccactgtgggcctggcagaaaaatgagctctcccgcattgcaaaatgagcaaagtggagatcgataaatcataaaattagttgagacatcatctatctttcatggctttccctttattcctgccacggtccctcaggacactcattcatttactgcattttattgttgggaaaacacgtcaaggtttggaggctgcattcagttaggggagcaggggccataatgtgtgtcattaattaggcaggtttgggaggttcaatccaaagtctggtctcaactgacttccataaattgagttttaggactgcttctgcgtcttgtgtgacttcatcaaaaagagaacgttattgaaatatgccctgagagggagagagagagaaagagggacatgtctgctcactctgtagaaacgataaatttagggacaaaccaggtgataagccagatgcaatctgagttgtctaaagattcttgctgttatctacatgtgattgaaataaatgtgagacacagagcttggagtgcatagatacgtcatctggtacctatattcttcatgtcaaggcatatagtaaacagattttttttcaaaaaattattgtgataacacttaacatgagacgtaccctcttaacaaattttaagtgcacaataccttgttgactctaggtacataatgtgcagcagagctctagaacgcattcatcttgcctgacggaaacttcacgcccattgatgagtagctcctcattttctcctccccacagccctggcaaccaccattacactcttttgttctacgcatttgactatttcacatgacccctgtaagtggaaataagaaatatttgtctttgtttgacagatatttaacttaccataaagtcctcaagatttaattcttgttctcacatcttgcagaattttctcctcctgctcctcctccccctcccacctcccccctccctcccttcccccccacttctcctcctcctcctcctcctccttctccttcttcctcttgttctgatggagtttcactcttgttgcccaggctgtagggcaacggtgcgatctctgctcaccgcaacctccgcctcctgcgttcaagcaattctcctgcctcagcctcccgagtagctgggattacaggcatgtgccaccatgcctggctaattttgtatttttagtagagatgggatttctccatgttggtcaggctggtcttgaactcctgacctcaggtgatccacccgccttggcctcccaaagtgctgggattacaggcgtgagccactgtgcccatcccaaattttattctttttgaaggctgaataatattccattgcgtgtatataccacattttctttacccattaatctgtcatttaggttttttccccattttggctgttgtgaacagtgctgcaatgaacatgttagtgctaatatttcttccacattctgattttaatttttatgggtataaatccagaagtaggattgctggatcatatgctagttctattttcaattttttgagaaacctccgtactgtttttcttagtggttgtaccattttgcattgccaataatagtgtgcaaaggtttcaatttttctacatcttcaccaacatttgttgtcttttgtctttttgacactagccaatctgacaggtgtgaggtgatttctcattgtggttttgatttgcaattagtgatactgattatttgtggtattggacattttttcataaacttgttggcttaactaaggaggtgaaagacttgtatactaaaaattataaaaccttgaaagaaacgaaagaaggtggcccggcatggtggctcatgcctgtaatcccagcactttgggaggctgaggtgggtggatcatgaggtcaggagtttgagaccattctggctaacatggtgaaaacccatctgtactaaaataaaaaaaattagccaggcatcatggtgcgtgcatgtagtcctagctactcgggaggctgaggcagaggaatcgcttgaatctgggaggcggaggttgcagtgagccaagatcacaccactgtattccagcctggtgacagagcgagcctttgtctcaaaagaaaaaaaaaaaaaaaagaaatgaaagaaggtataaacaaatggaaagacattccaaattcatggattggaagacttcatattgttcaagtgtccatactatgcaaagcaatatgcagattcaatgcaatccctattaaaatccaaaaggcatttttcacagaaatagaaaaaatgagtctaaaatttgtatagaaccacaaaaggccacaaatagccaaatcaaccttgagaaagaagaacagtgttggaagcatcacacttcctgatttcaaaatatattacaaggccacagtaattaaaactggtataaaataaaatatggtactggcataaagacagacatataggccaaaggaatacaatagcaagtccagaagtaaatctacacatatgtgatcaaatgatcttcaacaatggtgccaagaatatgtaataggggaatgattgtctctttaataagtgatgctgggaaaactggataaccacatgcaaaagaatgaaataggatccttatctaacaccatacatgaaaatcaactaaaaaaggactaaagacttacaagtaaaacctgaaactgtaaaactcctagaagaaaacataggggaaacacttcatgatgttggtcttgccaatgatttcgtgaatatgacaccaaaagcacagacaacaacaacaaaaataaatgatgagaactatgtaaaacgaaaaagtgtctgcacagcaaatgaaacaatcgagttaaaagacaacccacaaaatgggaaaaattatttgtagaccatctatgtaatgagttaatttctaaaatatataaggaatttctacaactcaatagcaaaaaaaaaaaaaaacctctaacaatctgattaaaaagtgggctaaggactttaatagacatttctctaaagaagatattaagtaggtttctaaaatcgtgatgtgtttttcatttgatgtgtgcatttaattgacgctcattactccatcaaaagcatcctgaaatcaaggaaacagtacttactagaatgtttcagtgatcgatttctgcctattaaaccaccccaaaacttaatgcattaagactaatttattattgctgtgattctgggacaaaacataactaactttttattcccctttcaaggtgtattttctgcagaacccccatctcagtaaatgccactatcatccactcccttgctcagctccttaaacttggagtcatccttgacatttttctttctctcatgcccctcatctagtttatccacaaattaccaagaaacacccacaagcctcctctcttcagcactacccccgtaatccaagccaccatcccatctcccttgggctattctggtagcctttataatcggtctcctgctttacctcttgccttattcagtctattcttcatatagaaaccagaatgatctttaaaataaatataatcagaggatgtcaacctccccaccacccggaccccacagcttatgactatccagcagctacctgttgtattcagaataagacccttataaaaccacttgctatagtctacaaaggccctgccctcctctcctcccttagctcatctctagccacactggccacactggccttccttctcccctttagcatgcatggacgtttacaccccagggcctttgcacctaatgtatgtgtgtgtgtatatatatatatatatatatatgtatatttgttgttgagaggaagtctcgctctgtcacccaggctggtgtgcagtggcgggatctcggctcactgcatgctccgccacccgggttcacaccattctcctgcctcagcctcccgagtagctgggactacgggctcctgcccccatgcccggctaatttttttgtatttttttagtagagatggggtttcaccgtgttagccaagatcgtctcgatctcctgacttcgtgatccgcccacctcggcctcccaaagtgctgggattacaggcgtgagccacccccacatccgcacctagggttcacaccgaaaaaaaatagtaggctctggagatgcaacagaccctgctttcattggagctttcagagagggaagacaagtgaacacatgaataaatgttaagaggtagtgagcattaaggagataaagtaggtatagagaatggagagagatgggaggtgtgaccccgtttcaatagggtggtgagtgaaggcctctctgaaaaggtggctttgagcaaacgcccaaataaatggaggggctgagccgtgcaggtatctggaagcaaatggggcaggggaaggagctgtttcaaaggatccaagatgggcaaatacctgcagggcttagaaatggtggctataatctgaaagcatgtagcaatagaagccttgcagctgaatacatgcatttgaggcagcaatgacttctttctagggggtttatgtgaggagggatttttctttttgggaaaaaccctgaggtacacgtattcaaaggaaatatttgttgacttggatggaaagggcctgtcttcagctttcgttctgctctgcctggctgcctctcagtgttaggttcaatgcttgaggctgtgccaagttgatttccctgtgagagcagacgcctgatagtagggcacagtgccagtcccgttgataatgaaatctttgcatccccgttgacacttctataaaggacagaagaggaactgtaagttcccattctgatcttttatttctgttttgtcaccctcaagaatacctgtcagaaagcttttgggatctggactcagatggacctgaatttgaagcccactgtgaattttactgcagtgggattttggtgagagctgctcaaacctgaacttgaggccaggcctggtggttcatgcctgtaatctcagcactttgggaggccgagacaggaggatcatttgaactcaggagttcaaggccaggctgggcaacatagggagatcctgtctgtaataaagaataaaaaattaaaaccctgaatttgagaggagcacgtggtgacagtgctcagatttgggttattcatgcccaatattgtggctctttctgtttttgttttcaaattttgttttatatttgtctttacagaacattaacattgttccaaactaataactaaataaaaaagccatcctcagagtaggtacagagtggttagttgccctggttggaggagtgggagagttctatcaccaatattgtttagaattgccagtaataataaaaatggatgacctttaattgctttttgttcatgtcataatactcgtgtatgaaattcatatatttttagaaataaccacgttgttttggaataattttagatttgcagaagttgcaaaaatagcacagataattcctatagttacccttcatccagttccccctaatgttagcatcttacatcaccatggtacatttgtcaaaagaaattaatattaatataacactattaactatagactttactcaaatttcatcagtttttccaccaatgtccttttttcctggatccaaaatttgatttagataccaaattgcatttaatagttgattgtattactgttttttaaattctctacagacaaggcacctattgactgcacctggcagaacaaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatgtgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcaacatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggcgtgtagggatgcctcagtcgcttacatgttgattgagtgaatcgtcggtttctttctggacactgacttcaaaaataaaataggatatgaaaatggctccatttgttgtcaccattttgtggggatcctatgtcctttgaagtggtcaggagtgggagaaacgtgataggggaagaaggagtggtgtggctgatggatttaacatgtgttcttttatgttggcaaggaagcggatgaccttaccccttgttcctcagatcctgtaaatggctttataacatgacccagggctgcttggtgtgggactagaccccagggtttgagggtctgaagacaatttaggttcgtgctggcaggatgtcttggctcagagacaagtatttctgtggggtgatcccagcatcctcccagcatactgctgctgttgctaggcagagaccccggagtggggagagggtgatagcatctggatcatccattcctacctaggtggttttggctcatagtaaaagggacctcagcacctatccgctgctcagcctcggagctgcaggtgtcagggatatcatgcactgtccaaaaagacatgcaaaacttaacacccgtgcattttcatggagagaccccgtggagcctctgaccagaggctgaaagaaatgtgtcattcaaaagaccagggaaccactgccaaggacccctacattcagcaacacatctatactcgtgcctgccacgtgtccgcacttagaggccattgtctcacctcagggtcaggagtgccaggtgaaagagcacacaggtctctgggcaaggcagagtttgaagctaggtctggaccaacgtctgagagtatgacttcaccccaggcgaggaagttcactttgagctcctggccagggagaaagcaagctctgggagacctaaactctgaatctcacttggcttttcagtctaatccgttgttgccaaagacatacttggcaatcccgaatcctcagagggctccatacgtgctgcgcttcagccttcgctcacggttcatcccacctggaatgcctttttctctccaaagatgttcccaagagccaagttaaatgtcacttccatttatcttcctccaaaaggaacatgtgttttacttcatctttctcctaaaaatgtggatgccttaatgagactaataatggttgttagtgcttgccaggcgtggagctaagagtgttacatatattatttaatctgagcaatcctgcatcatgggtactattaccagctccagtttttttgagacggagtccgttttgtcgcccaggctggagtgcagtggcatgagttcaagcgattcttatgctccagccttctgagtggctgggactaccagcacacatcaccacgcccggctaattttttttgtattttagtagagacagggtttcgccgtgttggccaggctggtcttgaactcccgtcctcaggtgacctgcccgcctcagcctcccaaagtcctggaattacaggcgtgagccactgcgcctggcccagctccagttgttcaggtgaaaaagatgaggcacagaattggaaagccatttgtccaagaggctaagaagtggtcacgtgagcatttaaatgtttttaagcctcagcctactcctctccaggcccttagcgtgtttcgtcctgcgttttcctggtctttcccagtgtttattagatgtctatagtgtccagacaatgttaggcagacgggacacaagggtgcacaaacaaacagtctgtgcccttattggaacctgttaatccctaaagggctaagcctccctacagcaagaaccctgttagtcacctgtgtatccccagcatctcgactctccacgggcatggcactatgctgtaaaaaaaataatccctgaccctcatggctatgggaaagcatgccttttaaagcataatccggctgggtgtggtggctcacgcctgtaaccccagcactttgggaggccgaggcaggtggatcacctgaggtcaggagtttgagactagcctggccaacatggtgaaaccccgtctttactaaaaatacaaaaatttgctgggcgtggtggcaggtgcctgtaatcccagctactcaggaggctgaggcaagagaaccgcttgaagcctggaggcagaggttgcagtgagctgagattgcgccattgcactccagcctgggtgacgagtgaaactccgtctaaaaaaaaaaaaaaaaaaaggataatccaatctaggtgcctctgcctcagtgttgcattcacagaattccgtggacccaaaaatcagtcttggaataggctgggatatggacaggacacccaggttctgcccctacacctatcccccacctggcttttttttttcttttccttgagacagtctggccctgtgagctgaggttgcaccactgcactccagcctgggcagcagagcaagactccatctctcaaaaaaacaaaaaacaaaaaaacaaaatggggttaagagaatgggctttggaatctagtggcttcactggttgcttgctgtgtgatctcgggccacttgctgtgcctctgtgcgtcagtttccttgtctttagtagagagatgatagtaacatttcctgtagtggttgtgaagattatacataatgtttgtaacctgctggagtggtcattagagctgttcaccaaatattcagattctccccggttggcacatggtgggagtgccttgtccatgtgactaactggccagtcagctgggagcagaagtgcctccttcaggcgggggcctttagtggctggcaggagacctctatggctcctctttcttttttttttttttaattaattttttttattatactttaagttttagggtacatgtgcacaacgtgcaggttcgttacatatgtatacatgtgccatgttggtgtgctgcacccagtaactcgtcatttacattaggtatatctccaaatgctatccctcccccctccccccaccccacaacattccccagagtgtgatgttccccttcctgtgtccatgtgttctcattgttcagttcccacctacaagtgagaacatgcggtgtttggttttttgtctttgcgatagtttactgagaatgatggtttccagcttcatccatgtccctacaaaggacatgaactcatccttttttatggctgcatagaattccatggtgtatatatgccacattttcttaatccagtctatcattgatggacatttggcttggttccaagtctttgctattgtgagtggtgccacaataaacatatgtgtgtatgtgtatttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgatggccattctaactggtgtgagatggtatctcattgtggttttgatttgcatttctctgatggccagtgatgatgagcatttttttcgtgtatcttttggctgcataaatgtcttcttttgagaagtgtctgttcatatcctttgcccacttttcgatggggttgtttgtttttttcttgtaaatttgtttgagttcattgtagattctggatattagccctttgtcagatgagtagattgcaaaaattttctcccattctgtaggttgcctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattaccaagtcaatcctaagccaaaagaacaaagctggaggcatcatgctgcctgacttcaaactgtactacaaggctacagtcaccaaaacagcatggtactgggaccaaaacagagatacagaccaatggaacagaacagagccctcagaaataatgccgcatatctacaaccatctgatctttgacaaacctgatgaaaacaagaaatggggaaaggattccctatttaatacatggtgctgggaaaactggttagccatgtgtagaaagctgaaactggatcccttctttacaccttacacaaaaattaattcaagatggattaaagacttaaatgttagacctgaaaccataaaaaccctagaagaaaacctaggcattaccattcaggacatagggatgggcaaggatttcatgtctaaaacaccaaaagcaatggcaacaaaagccaaaattgacaaatgggatctaattaaactaaagagcttctgcacagcaaaagaaactaccatcagagtggatatggctcctctttctttctgccatggtgatgggcgattatgcccaggagcggctgcttcatttgcctggcacaggagtgagggtgacaatgcagagatccagccacccagcaatgggtgtgtagcagcaagaaatgacccttttgtgaattaagcaactgcaatttggcgtttttataacctaacgtatcttgactgatacaaatgcttagagcaacctctgatatttagtaagggcttattcagtggcagaatagaaaagaatgggatctagagtaataaaagggattagccttctctttgtcagttagggatgtcaagagattatctgtagcaccctctgctgtcaacatgcctgtcttccatgaccagcctgtacccccctccctccacatgtttttgtttttcccagacagggtctcactctgtcacccaggctggagtgcaaatcgacctcctgggttcaagcgatcctcctgcctcactctccctagtagccgggactacaggcatgtaccaccatgcctaattttttattttttgtggagatgggacctcactattttgcctaggctggtctcaaactcctgggctcaagcaattctcctgcctctaccttccaaagtgctgggattataggtgtgagccattgtgcccagccacatggttcttcaatactcacccccaccccaaaccctctgacacatgcgtttagtcctggggtggggcacctgactcaacccaggttgaagatactttaggatattttgaacctgggagatgtgagggttgtctctttaaaatggtggaaattatgagatatttgggaacggcactactgatcctcctaatttatttttaattttttttttaggccgaggcgggtggatcacctgaggtcaagagttcgagactagcctggccaatatggtgaaaccttgtctgtactaaaactacaaaaattagcagggtggggtggcaggcgcctgtaatccgagctactcaggagactgggactacaggtgctcaccaccgcgcttggctaatttttgtatttttacaaagctttaaataaaaattgcttaaagctgaaaattgggtgggcgcagtggctcacgcctataatcctaccactttgggaggctgaggtggacagatcacttgagcccaggagttcgagatcagcttgggcaacgtgatgaaatacgatctctacaaaaaatacaaaaattagccaagcatagaggtacacacctgtagtcccagatactccactgaggtgggaggatcacctgagccgggggaggttgagggtgcagtgaggtgcgatcgcgccaatgcactccagcctgggtgacagagtgagatactgtctcaaaaaacataaaaataaaaaataaaagctgaaaaatttatatttaatattttgaaaacttaaatcttattgcatattattattaaataactttccagttctagtgttcaatgtcagtctaattgctcatctaaaggactgatattgcaacatacattttgtgtctcgatcttatatacaaattagagagtgatacaaattgtttaaatggctaaatgttcctcagctacagtgagtagccatattggtctcttttaaaaatttttattatttttatttaaacaaagttttaatttttttttgtagagacagggtctcattatgttgcccaggctggtcagccacaagtgatccttctgcctcagtctcccaaagttctgggattataggcatgaactaacacgcctgacccagattactctctaactcatgagtatgtctggaggcgcaatttggaacatgaagagaaacagaaaaatggactctcagtacttctgagaaatgatacttgttatacaagaatctactgcattcagcctccctgagaagaggaatttaagaattaatttctgcttcctcttacttaagtgtttcaacactcaagtcctttgcatactctgaagcaatgtgtgtctccaacattgggagcagctgcaacccacaaaccttcttgacataaaatagttgcattcattcattcatttatttgctctgccgcacaggctggaatggcagtggtacgatcttagcttaccgcaacctccacctccctggttcaagccattctcctgcctcagcttcccgagtagctgggattacaggtgcgcaccaccatgcccggctaatttttgtattttttagtagagacggggtttcaccatgttggccaggctggtctcaaactcctgacctcaactgatctgcctgcctcggcctcccaaagtgctgggattacaggcgtgagccaccacacctggccatagttgccttttgttttgagattttaggacaagagatgaatatgtttttttttttttttttttgagtcagagctttgctcttgttgcccaggctgcagtgcaatggcatgatctcgactcactgcaacctctgcttcccgggttcaagcaattcttctgcctcagcctcccgagtagctgggattacaggcatgcgccaccatgcccggttaattttgtatttttagtaaagatagggtttctccatgttggtcaggctggtctcgaactcccaacctcaggtgatctccctgcctcagcctccgaaagtgctgggataacaggcatgagccaccacgccgggcagaaatgagacatactttggggcctgaacagtgtttgttatgaaatggatgtttagggctgcagattgtgctgagccagtactgaacataagatcctgagtggacaggaacacctttgtggtcattagtgaatctgtttttaagagctgggagtggtggctaacacctgtaatcccagcattgtgggaggctagggtgggatgatcacttgaggccggagtttgagagcagcctgggtaacaaaacaagactctgtctctacaaaaaaggaaaaaattagctgggtgtggtggcatgagtctatagtcccagctactcaggaggctgaggtgggaggatcgcttgagcctaggaggtcaaggctgtagtgagttatgtttgtgccactgcactccagcctatttgagacagataatgtgtctcaaaaaaaaaaaaaagaaaaaaaaagaaaaaaaactcttggccgggtgcggtggctcacgactgtaatcccagcgctttgggaggccgaggcagctggatcacctgaggtcaggagtttgagaccagcctggccaacattggtgaaaccccttctctattaaaaatacaaaaatttgctgggcctggtggcacgcgcctgtaatcccagctactctggaggctgtgggaggagaatcacttgaagccgggaggcagaggttgcagtgagccgagatggcgccactgtacacactccagcctgagcaataagagcaaaactccatctcaaaaaaaaaaaaaaaaaaaagaaaagaaaagaataaaagaaaaatccattgaaaaaatcatacatttgtgagatggagagccaatcttgctaggaactgagggggttactggctgcaagggagatggggaaaacaagtcctggcctccacctaggggatctatagactcacagtgcaggaatttccccggagacagaggagcgctttaaaggtactgtgcggcccaaaatggtggagtagggaattccagggctccatccctcccccaacacaactaataaggtggcaaaaactgtcagaatcaacttctgaagtactctgggatctagctttttgttagctttcatttttttgagatggggtctcactctgtcccccagactggagtgccactgtgcaatctcagcccactgcagccttgacctcccgcctcagcctcagagtaggtgggatcacgggcgcaagccaccatgccaggctaatttttgtattttttgtagagacagggttttacaatgttgcccaggctggtattgaactcctgagttcaagcaattcaccagcctcagcctcccaaagtgctgggattacaggcttgagccaccgcacccagccttctagtttttaaaaagggaaacaaacaaacttataactagcacgggaaaatttggagaaagaaagctctgaggctgggcgcggtggctcacgcctgtaatcccagcactttgggaggcaaaggcgggtggatcccctgaggttaggagttcgagaccagcctggccaacatggtgaaaccccggctctactaaaaatgcaaaaattagctgggcatggtggcacatgtgcctgtaatcccagctactcgggaggctgaagcaggagaatcccttgatcccaggaggaggaggttgcagtgagccgagatagtgccactgccctccagcctgggtgaaagcaaaagtccgtctcgaaaaaaaggaaagaaagaaagctctcctgtgataagagagtgtgattgatggcgtttttgcttgctcatgtaacatccccccaaactccagatcagcagggaccatgaggatgtcagcctgcacttctggggctggttgctagcgtagggggagtacacagaatttactctcaaagaattgtggttgtaggctgggtgtggtgtctcacacctgtaatcccagcattttgggaggccaaggcaggtgaatcacgaggtcaggagtttgagaccagcctggccaacatggtgaaaccccatctctactaaaaatacaaaaaattagctgggcatggtggtgggcacctgtaatcacagctactcaggaggctgaagcaggagaatcacttgaacctgggaggcagaggttgcagtgagccaagatcgtgccactgaactccagcctgggtgacagggcaactccgtcttaaaaaaaaaaataaataaatttggggttataggtctgacgacttccccaaggactagcagaaaggtttctgagctttttaaccagggcattttcagggctggcatggcttcccaggtggctttagacaaaagcattgaaagacataggtattggcctcaataccctggggcaggggacaacacttgggacaagcaatagacagaccgagcagcctgggaaggaaaagtttggaaaaagagatgtgtgtctgtagaggcttttaaaagtgtctacataaaccaggaaatcaagaaagctgtgtgcaggcccatagtcagttgcaagctcagaaaaggcctaagaaactttgtgaggccaaggcggttggatcacctgaggtcaggagtttgagaccagcctggccaacatggtgaaatcttgcctttactaaaaatacaaaaattagccaggcatagtggcacacacctgtaatcccagctacccgggaggctgaggcagaaaatcactttacctgggaggtggaggttacagtgagctgagattgtgccactgcactccagcctgggtgacagagtgagattctgtctcaaaacaaaacaaaacaaaaacaagcaaaagaaaaggcctaagaagaccctgggctttcatctctttctggccttcagtctctgtgcaagcaggaagtgaaggctaaggcagagtataaatggcttggttaagggttgagagagtgccccaaacagatccaatttgcaaagactaggatagtgtttttcttttcttccttcctccctccctccctcccttctttcctttcttccttccttccctccttccttcctttctctcctttctgcctgcctgctttctttctctctctctttctctgtctttctctttatttctcctgttttcttgtttctttccttttattcttctttatttgttggcttcagccattttaggtagctctcaaaataccagctgactgacaagcaaaaagaacagaaacaaacaaaaagaacagaacagaaaaaaaaaaaaaaaaaccagaaacagaaacacaaagaatacagactttacaataatagtttggaaaatttaccaaacaagcaaaccacagcaacccacgatatacagcaacaatagaccctggggagggaggagaatctgattttcagtgttgccataaattgaaaatgtcaacaaaaaccctcatggcatggaaagaaataataaagttccactcatttgtggcaagaaagaaatgactagatactgtctttgtggcaacccaggtattggtcttactggcaatgactttttttttgagacagagtcccactctgtcgcccaggctggagtgcaatggcacgatcttggctcactacaacctctgcctcttggattgaagcgattctcctgccttaccctcctgagtagctgggattacaggtgtgcgccaccacgcccagctaatttttgcattttcagtagagacggggtttcatcatgttggtgaggctggtctcaaactcctgacctcgtgatccacccacctcagcctcccaaagtgctggattagaggcgtgagccactgtgcccagcccagcaatgacttttaaaaaaaattatttatttaatttttttttagagacagggtctccctctgtcactcaagctggagtgcagtgatgtaatcagagctcactgcaatctctatctcctgggctcagtgagtctcctgcttcagcctcctgagtaggctggaactacaagtgtgcaccacaatgccaggctagacaattactttttttttttttttttttgagatggagtcacactctgtcacccaggctggagtgcagtggcataatctcggctcactgcaacctctgtctcccaggttcaggtgattctcgtgcctcagtctcccaagtaactgggattacagatgcccgccaccacgcccagctaatttttgtatttttagtggagacaggttttcaccatgttggccaggctggtcttgaacttctgacctcaagtgatctgcctgcctcagcctcccaaagtgctgggattacaggcatgagccaccatgcccagccgacaatgagtgtaaattgactgtcttaaatatactcaaagagatgaaggaaaccatggacaaagtcctaaagagagagcactttgcagaagttgtggcgccttgagagccagcagggcagtgggccagtgagatgttgagttattactattattaattcaaatcacatgaatagcaaaccctcagagaacaagaagtctttgttgtatcacaagggctccatcagcagaggtggagtcctgaactcggcacagtgtctggcatatactaggtcttcaagaaagttttagagtaaacaaatgcatccacaatgcttttatgttgggtaaggtctttctagcagtcaaaattttctttctttctttctttttttttttttttcctccttgtgatggggtttgcgggaatgggaacaatggcatagaggaagaggaaaccaaaattatcttgagttagcagatgtctttctcctgtctcctttcttcactaagaagaacagtctttgctgggcatggtggctcccacctgtaatcccagcactttgggaggccaaggcgagtggatcacctgaggtcaggagttcgagaccagcctggccaacatggtgaaaccctgtctctactaaaaatacaaaaattaggtggggtgctgtgtggctcactcctgtaatcccagccttttgggaggctgaggctggtggatcacctgaggtcagaagttcaagactagcctggtcaacatggggaaaccccgtctgtactaaaaatacaaaaaaaaaaaaaaaatagctgggcatggtggtgcatgcctgtattcccagctacttgggaggctgaggcaggagaatcgcttgaacctgggaggcagaggttgcagtgagctgagatcatgctattgtactctggcctgggggacagagtgagactctgtctcaagaaaaaaaaaaataaaaaaataaaaataaaaaacctaaagaaacaaaaaaaaaaacaaaaattagccaggtgtggtggtgcacacctataatcccagctactcgagaggctgaggcaggagaatcgcttcagcccagggatgcagaggctgcagcgagccgagatggcaccactgcactccagcctgggcgacagaacgagactttgtcttttttttgtttgtttaaaaaaaaaaaaaagaaagaagaacggtattgtctttgggtaagcacaggcacagagttaaaaaaaaaaaaaaaagagtcgtgtctttgggactgagtggatgggcatgtgttctgagttagtgtgcccaggtgtggtgaaagacacggagaaaccactgcttgatgcgttctcttttgttgttcaagttgtgggctgctgtggggtggggttacatgtctgcatccccttcgaaaagcacacaatatggcaagtggaagctggagagagctcctaggagtgcctcgtgccaggtgaagaggttgcattgcgggtggtgggtaggtgcctagggagaggaggtccacgcctgttgtccttccagcacgatggctccaaaagcagagcgaagaggtgatgttcccacttcccaaggcatccaagggacggggcttgaagaatgcagcctagcaaccatgtgcgtaagactgtggggaaggagggcttgaggatgagcctgagagtcaactggactgtggggaaatagtgtagccttctttcctttgagcttcagttatctcgcctgtggtgatgatgacgatgatgataaagatgataccatacttctatggcacatactatgttccagatattgttcatataactcatctaattttcatagcagttttacaagatgagtactatttgtttttgtttttttgttttttttttttgagatggagtctcgctctgttgccaggctagagtgcagtggcgcaatctgggttcactgcaacctctgcctcctgggttcaagcaattctcctgcctcagcctcctgagtagctgggactacaggcacataccagctaatttttgtattttcagtagcgacagggtttcaccatgttagccaagatggtcttgatctcttgacctcgtgatccacccgcctcagcctcccaaagtgctgggattataggcgtcagccacagctcccagccaagatgggtactatttttatacctattttatagaagaggaaactgaggcatagagaagtcaagtcacttgatcatacagctagtgtgtggaggaggcagattcaaaccctggcttcggtcttagtcactgcattggcttcatgggcttatcatgaggattaaacgcgtgaacatgctcagtgtttagttcagtgtctggcacaggatcaatgttcagaaaatcctaacagctgctgtcagtatcagaacccaaacaaacaggtgggactttcgccaactctctaacatcacatgtgcttgtataatcagccactgtttttttcatgaaaaaaaatttttttgagacaggttctcgctttgtcacccaggcaggaaggcagtggtgagaacacagctcactgtagcctccacctcctgggctcaagcgatcctcccacctcagcctcttgtgtagctggaaccacagcatgtgccaccacgcccagctattttttaatatatttttttattttttgtagagatgaggtctcaccatcttgcccaagctgttctcaaactcctggactcaagcagtcctcctgcctcagcctcccaaaaggctgagaatacaggcatgagccactgcgcctggctaatcagtcacttgttgttgttgttttttgtttttttgagatggagtcttgctctgtcacccaagttggaatgcaatggcgcgatctcggctcactgcaagctctgcctcctgggttcaaatgattctcctgcctcagcctcccaagtagctgggactacaggtgcacgccaccacacccagctaatttttgtatttttagtagagacggggtttcaccatgttggccaagatggtctcgatctcttgacctcatgatccgcctgcctcagcctcccaaagtgctgggattacaggtgtgagccttaatcccaaagtgctgggattacgtgcctggccttaatcaatcacttttaaaggagagtggggaacatcatgttttgcaactattttttgaactcttggatatttacttggaacaaataaaaacacttttgtaccatgtgaaaggtaaaatttgctcaagccgtccctcatcctgccctggcctgcttccacatgcggctgggtgagctgaccccattctctgtttatttattgtttttgttattgtattttattttacttttttgagacagagtttcactcttgtcacccaggctggagtccaatggcatgatcgtggctccctgcaacctccgcctcccagattcaagcgattctcttgtgtcattctcctgagtagctgggattacaggtgcctgccaccacgcccagctaatttttgtatttttagtagagatggggtttccccatgttggccaggctggttttgaactcctgacctcaggtgatctgcccgcctcggcctcccaatgtgctgggattagaggtgtgagccaccgcgcccggcccattctcagcttcttgatggcttccccctactgggacattgatcacttattcatgacattgactggtcatgagccactcctccgccagcccttggaggatccaagtgattcacaaatggacacaaggaatatgattagtcctctgtgagtgattctgaggggccgtggtatagagagagagaggggaaggaggatgggaaaatgccggcagttccctccccaacccattctgacagtttgctggttagagaaaaatccccatgtcagagaatttttttctttgtttatttcctgtgaaatagaatgtgggtctggcattggggaggactctagtaattcatattttctgcttatttggctcctggctgaacaggaatttacattacttaatgtctgggtttttcctggggaatcaaaataagttttctattcaattattaagcaaatttcacagccaaataatcctcttatttttacaagtggtattttccctggcagagggttttctggcttctctgggtacttgatccgtctcctctcttctgtttcctctgtctttgtctggctatgaaggaagctaaagcccctcattcatggattaggggcttctcaatggcagttggcagactttggctttgcaagctagagatgaatcttttttttctttcttttttttttttttcgagacggagtcttgctctgttgcgcaggctggtgtgcagtggtgcgatctccactcactacaacctctgccttccaggttcaagctattctcctatctcagccttccaagaagctgggactacaggcatgcaccaccacacctaatttaaaaaatactttagtaaatggctaatttaaaaaatatttttagtaaatgggaggttttaccatgtcggccaggctggtctcgaactcgtgacctcaggtgatctgcctgccttgtcctcccaaagtgctgggattacaggtgtgagccactgcgcctggcctagagataaatcttaatgtccgccagccatggggtaagagtccactccctctttctgctcttcagtctattgactttgggcacaggcacagctgcagctctagtaggggttgggcctggagtcagtggagacaaaatgtgaaggtaacaggacagtgcacggggcccagtgtgctctgcctgggctgctcagggaagaaaaatcacacacacacacacaaataacaaccctttttttggcagaagtatagtgaaagatctctacgtcttggccagcatttgttatctttttgcttctttgaaaatagccatcctgggccagatgcagtggctcacgcctgtaatcccagcactttgggaggctgaggcgggtggatcacctgaggttaggagtatgagagcagcctggtgaacatgatgaaacctcttctctactaaaaatacaaaaattagctgggcgtggtggcacgcgcccataatcccagctactcgggaggctgaggaacaagaatagcttgaaccctggaggtagaggttgcagtgagctgagattgtgccattgcactccagtctgggtgacagagtgagactctgtctcaaaaaataaataaataaataaattaaaaataaataaataaataaaggaaacggagtcagtgtgttgaagagatatctgcactcccatgttcactgcaatattattcacaatagacaaggtatagaatcaacctaagtgtccatcagtggatgagtagataaagaaaatgtgatacacatacaccaatgtggtatatatactcttcagccttaacccatctccataaaattaaggaaacaaagaaggaagtcctgttattggtgacaacgtggatgaacctggaagacattatgttaagtgaaataaatcaggcacagaaagacaaataccacatgatctcacttatatgtggaatctaaaaaagttgaactcactgaagtagagagtagaatggtggttaccagaagcaaggtgagggtgtctgtgagagggttggggagacattggtcaaaagataaaaaatttcaattagccaggaggaaaaagttcaagaggtctattgtgactagttaataaaagtgttctaaccacaaaaatgatccatatacaaggtaacatatatgttaattagctttatttagccattccacactgcgtatatcaaaaaatcatgtacaccataaatataattattattattttttgagacagagtttcactcttgttgcccaggctggagtgcaatggcacgatctcagcccactgcaacctccgcctcctgggttcaagcgattctcctgcttcagcctccctagtagctgggattacaggcatgcaccaccatgcccagctaattttgtatttttagtagagatggggtttatccatgctggtcaggctggtctcgaactcctgacctcaggtgatccgcccacctcggcctcccaaagtgctgggattataggcgtgagccactgtgcccggctcataatttttatttataacaaaaagtaaagtgaacctcctgtagacagagtacagttggatcttgttttttcaacctattcacctactctatgtcttctaattggggaatttaattcatttatacttaaagtaattattgatagataatttacttagtagaagtataactttgagcctgttatttaccttttctaaatgagttttcatttctgtgaaatgggcacaattaaagaggccgcctcctgggactggggtcaggattagttgagatagtctgtgtaaggctaggatggtgcttgacagccagtgttaattattattttttgatcctgtgggatagggcaacccagatactccggtgggaaacacttgcaaccagagaaccttgactcaaaatcttggtcctacttggtttgaaggatcccattgcatttgcattgctgccccttctgagaggttattcacactgataaaccccattttgcaacttacacgtgcaggattcagctaattggacagcagtggacactgaacctaaggtgaaaaatccaacaaatagagaggaccaactgaaaaattcagttgctttcttttgaagaatctgaatacgagacacagagaaaggattagtagtcagtattgagggcagaaacagaaacacagagaaggaaagttataagaggaagctttgagtcagcagaagctatgggtgaataggagccatgaattgacaggaattatgagtcagcagaaacttgagtcgtggcaagagccacaagtcagcagaaactatgagatagagagtagcatggagatagcagaggaataggccaagacccggagatgctgcgtcaccatcttggtggagcctagagggcagagctaggatggtcccctgaattacagagctgctgtcagtgatgagtgtaacctgaagatgttccagcctctggcagccctgactgggtggtgagactttggccttccagctttcataaagtaaactgagaatatttctgtttctggccaacttacaagaatctgactgacacactacccatatcaaactcctctgagactcagttttcttgcctgtgaaatggggacagctaaatatacaagttgaatgggttgagaaaacaagatccaattatattctgtctacaagagactcattttactttttaattacaaataaaaattatatgtatatatgatattttgatatatgtatacagcatggaatggctaaatcaagctaattaacatatatgttaccttgtatacttgctttgggctgcttagcatcccttttttggggataccagcctttatttgacatctgccagtaacaggattctacctctaaggtggccacataatccaggccgggcccgtcagagcctcattgtagaaatttgccttcaggtcaggaggtggaaaccctgagagagttcctgggttctgggatattctaagctgtccaggctcctgtgttttctttgtttttagagacggagtctagctctgtcacccaggctggagtgcaggggcacaatctcggttcactgcaacctccgcatcctgggttcaagtgattctcctgcctcagcctcctgagtagctgggattacaggcatgcgccactatgcccagctcatttttgtatttttaatagagatggggttttgccatttttggctaggctggtctcaaactcctgacctcaggtgatctgaccgccttggcctccgaaagtgctaggattacaagcgtgagccaccatgcctggccggctcctgtgttttctaaggccagtttattcaactctgttttctttctgagagtttccgaatggagtcatcccttggtatccatgggggattagttccaggactttccatggataccaaaccccacagaagctcaagtccctgatataaaatgatgtagtctttgcatttaactatgcacatcctgctgtatactttatttttatttattattattatttttgagatggagtctccctctgtcacccagactggagtgcagtagcgcaatcttggctcactgcaacctccgcctcagctaggttcaagcgattctcatgcctcagcctcttgagtagctggaactacaggtgtgtgccaccacgcccggctactttttgtatttttagtagagatggggtttcaccatgttggtcaggctggtcttgaactcctgacctcaagtgttctgcccatcgcgacctcccaaagtgctgggattacaggcatgagccaccatgcctggccctcctgtatacattagattatctctagattactcataaaaatgaatacaatgtaaatgccgtgtaagtagttgctatactgcattgtttagggaatcatgacaagaaaaggagtctgtatgtgtttagtacagatggtttttgttgtcgattaaaaatatatatatattttatagagacggggccttgctatgttgctcaggctggtcttgatcttctggcctcaagtgatcctcctgcctcagcctgccaaagtgctgggattacaggcatgagccactgtgcccagccttcctgaatatttttttaattctcggttggttgaatccatagatgcggaactcacagaggcagagggccaactgtagccttcctacagatatttttatcttgttaaagtaataaccctaacctgacccacacctcacaggtctgttgtgaagtgacataagccagcacataagtggaaaagcttggtgaatgatttaaaggaatcttctggcctggtgcgggggctcacgcctgtaatcccagcactttgggaggccggagtgggtggatcacctgaggtcaggagtttcagaccagcctggtcaacgtggtgaaaccccgtctctactaaaaaaaatacaaaaatcagcccggcatggtgacgggtgcctgtaatcccagctactcgggaggctgaggcaggagaatcgcttgaacccaggaggcggaggttgcagtgagccaagatcgtgccactgcactctagcctgggggacaagagtgaaactccgtctcaaaaaataaaaaaaggaatcttctggcctctgtttcagttgaacaaagtgaggtctagagaggggagaagtgagcagttccaggtcgcatgggcggtcaggggtgaaaggggagtggggacgtgaactccaggcgggtgctctttcgcgcctcctggtcgctccctccccttccctccccttccctccccttccctcctcttccctcccccgctctccctgatgtgcctgccttccctacctaacagctctgagttctgcctacctgaattagcccaatgttttcaccctttgaaagaagattctaagccgaaaccagcccccagttccccgtgggctttgcccactccttgccaagcactctgagtgctaccctttctctttctgaatagggtgagatacttgacgctgccctgaatcgaagtcaaacgggggctcctctctgcagtaccacagagctccctgtaggtggcagggtaggactgcaaatgtcctggaatattggtccctgagcgcaagcccagactggagctggggtacagcatttacttgccgtggggaagaggaggacgccggagggaggaggaaggaaagtagaagtgttgccagtcttgaggcaaaagagagttgatttgagggccgaaggacaggaatagttggtgtacctcatccgtctatctctccatccacctacccacctatatacccaactaccctccatccatccacctactctccattcacccacccactcacccatccacccatccacccacccacccatccatctacccatccatccatccatccatccatccacgcattcatccaaacacccatctatccatccacccacccatccgtccatgggttcattcatccatccatctaccaatccactcatccatccaataaatatttttgagcacctgtgctaaatgcatatacacacacacatatctatgcacacacatacatacacactgatatatatcacacacatgcatacacacacacggagaataaccggtactgccttttgttgagtgtcaaggttgcttttatctctccagctggagatttctgcacctgtctgtagcatccattactagcatcccattcccaatattattattcactcctttacttccgaatataaagcagatgtcatctggggccctttttgccccttctgatttcaataaaattttccccaacgtcctgtcttcctcctcctcctctatcccattcctgaggcatctcaagtcttcccttggatttctgtcaactcctgacttttctgcctctagagctttggctcctagtaggatatttctgacctgcagcatatcatattctttgtttttaaaatttattattgttggccaggtgcagtggctcatgcctgtaatcccatcactttgggagaccgaggcaggtggatcacctgaggtcaggagtttgagattaacctggccaacatggtgaaatcccgtttctactaaaaatacaaaaattagctggatgtggtggcatgctcctgtaatcccagctactcgggaggctgaggcaggagaattgcttgaacccggagggagaggtttcagtgagtcgagatctcgccactactccagcgtggacgacagagcaagactccatctcaaaaaaaacaaaaacaaaaccaaacaagcaaacaaaaaaaaaaaaacaagaaaaggcagctcagagaggtcaagtgtctagcttgaggccatacagctaactgggtcagaactgagatttgaacccatgtatgtctgacctggtgctgggctcttttctgtagaggattcatccagccccacatacctggtctagaagaagggaagtggtgggagaggagcaccccagagagaggagcccgaatcatggggctgcaagctggtcctgggtcccatggagccatggggtgaggaagtggcaggggctaccaccaaactcagatgcgggcccaaggctggttgggggagaggaccctggctgtgggtgcccatctgccagcttgtatgaaggagtaggcggggtaggtgggagaagggaagtggtgcttcggtgggaccacaggaaacgctagattttggttagtagttggaaagtaccagcaatttctctttcaacagaaaaccagaaggaggtcaggtttttcttattaaaacagagacaaatgcagactttgcaaaggaagcagggatttgcagagtgaggctggaagtcaccgaagctgagtgatattccccagagaaaggttttacattcatgtggagtgggtcagaggaccttgagttgagctgatgagcagccacaggatggcaccaggttttcacgatatggagagaaggggacctggtggtggtttggccaccgtgtcctgtttcctgaagaacagagggtgtacgtgacagctggggcctcatagccagttactgccagcaggactccatctcaattcagatcttacttcatgggactacacagaaagaaggaaagccaggccgggcatggtggctcatgcctgtaatcccagcactttgggaggctggggtgggcagatcaatagaggccaggagttcgagaccaacctgaccagccttcaccaatggtgaagcccatctctactaaaagtacaaaaattagctgggcgtggtgacgggcgcttgtaatcccagctacttgggaggctgaggcaggagaatggcttgaacccgggaggcagaggttgcagtgaggcgagattgcaccactgcactccagcctgggtgacagagcgagactcggtctcaaaaaaagaaaaaaaaaaaaaaaagctgggcttcgtgaagggctcacacctgtaatcccagcactttgggaggatcactttgggtggattgcttgagcccaggagtttgagaccagcctgagcaacatagcgagactccatccttacaaaagataagaaaacaaaagacagaaggagtggtttggagctatgcaagtgtccctcttggctctggcaatttctgggtggataaccttgggtagcacccttctctttgaatctaagtttccttatctaaactggcgatgataagacctcccttgctatgttgttataaaattacttgtgtgcctagcccagagtaggtgtgcaatgaatgagtaaatggatgaatggctaaattccacacatatttatggagtgctaagtctgtgtcaggcattaccttggggacacagctggaagtgaacaagccccagtcttcggtttttaggagcccacattctggcagaagagacaggaagtagctgggcagggtggctcatgcctataatcccagcacttcgggaggctgaggtgggctgatcacctgaggtcaagagtttgagaacagcctggccaacatggtgaaaccccatctctactaaaaatacaaaaattagccaggcatggtggcatgcacctgtaatcctagctactcggggggctgaggcagggaaatcgcttgaacccgagaggtggaggttgcagtgagccgagatcgagccaccacactccagcttgggtgacagactgaaactccatctcaaaaaaaaaaaaaaagagagccaggaagtaagtgagacagataagatcaacacagagcatgctaaacagaaaagtaggaaagacatactattcagtgttggggtgggtggggagattaatatttcagaaagggtagcctgggaagggctcattgagaagctgactgttgaataaagattggcaggaattacgcaaccagccgtgtagatctctgggagaggagaattccggggagaagggacagtcagtgcaaaggcccttaggccagagcatgcttggggttcaagaaacagagtgagtgccagtgtgcctgaagcccagtacagaagggagaaggttgtcggagatgaaggcaaagaggtaatgacgggtgggttagagtttgcagggcctttggaagctgtgagaaggattttggctttttttctgggtcagaggggagccagtgcaggagtttgagcagaggagtggcatattacggttctccagagaaagggaaccaacaggatatacacatgtctacattaatcaattaattattttgagggggttctccagagaaagggaaccaacaggatatacacatgtctacattaatcaattaattaattttgagattgagtttcgctctttcacccaggctggagtgcagtggcacgatctcggcctactgcaacctccatctcctgggttcaagtgattctcatgcttcagcatcccaagtagctgggattacaggtgcccgccaccacacctggctagtttttgtacttgagacagggtttcaccatgttggccagcctggtctcgaactcctgacctcaggtgttccacccgcctcattcttcccaagtgctgggattacaggcatgagccaccatgcccggcctatattaatttctttacagagatttattataatgaattggctcgcatgattatggaggccgagaagtcccaagatcggcagctggcaaacaggagacccaggagaactgatgatttagctccagtgtgaggcccaaagaccctgtgagttcccaggagagccaatgacataagttctggtcctaacgcgagcagacttgagatgcaggaaaagccaatgtttcagttcaagtctcagggtggaaaagcacagtgtcccagcccaagcaggcaggcagcaggagttctcttgtactgtgcctttttgttctatatgggccttcaacggattggatggggcccacccacattagggagggcgacttgctctattcagtctgcagttcaaatgtgaatctcacccaggaacacccttacagacacacactcacaataatgtttgaacaaaaatatctgggggccaggcatggtggctcacacctgtagtcccagcactctggaaagccaaaatgcgtggatcacttgaggccaggagtttgagaccagcctgagcaacatgacaaaaccctgtatctataaaaaaaaatacaaaaattagctggtatgatggcaccacatgtggtaccagctactcaggaggctaaggtggaaggatcgtctgagttcagggaggttgaggctgcagtgagccatgactgactgtgccaccgcactccagcctgagcgacagagcaagaccttgtctcaaaaaaaaaaaaaaaaaaaaaaaatctgggcagcccgtggcccagtcaaactgacacatcaaattgaccatcccaagtggcttcactggatgtagctttctacaggctctctctggctgtggtgttgagaatagtatgaaggtaggggtagggttggggagtcagaagcaggaaggtgaatttggtggctaccatatagtcatccaggtaagtgtggtggtggcttggactaaagtggtagtaagaggtgtgacgaggttattagattctggatgtattttgaaaggagtgcagatggggtgagagagagaagaagagaaataatgggtgacctgtggtttttggcttcagcaccttaaagaatgaggttgccactgattgagaagggagtatcaggagtatggcggacacgttgagtgtgagaaatgtaagctttggaggagatgtggggtcagcaggtagatgtccatgcctggagtccagcagagcagcctgggccagacagctggatttgggagctgtcattagcacctgcctggctgtcttcattattgcatcaagagtggctcttggttgcaagtaacagaaaacctggctgcaggccagacatggtggctcacgcctgtaatcccagcactttgggaggccgaggtgggtggatcacctgaggtcaggagtttgagaccagcccggccaacacggtgaaaccctgtctctactaaaactacaaaaattaaccgggtgtggtggcatgtgcctgtaatctcagctactcaggaggctgaggcaggagaatcgcttgaacctgggaggcagagtttgggtaagctgagattgcaccattgtactccagcctgggtgacacagcaaaactccatctcagaaaaagaaaacttagttgccttgagcaaaaacagaaattattggaaaactctaggggtccacaaacccaccaggaagctggggatccaggctggggaaatgagtgggggccaaggaggctgtgaagatctgagcagcggcagccacagaaaaggccccggcaggagcaatccggtcctaaaacccccatggctaccatgtggataggccctcctgcggccccttgctgggatcaccgctcatgatgcagagtctgaggagagcagctcattggttcaaccaagccacatgaccttcaggctggggtgcagggagggaggcctggccacttagggtttccattttcttttttctgagacagagtctcgctctgtcacgcaggctggagtgcagtggtgtgatctcagctcactgcaacctccgcctcccggattcaagtgattctcctgcctcagcctccccagtagctatgattacaggtgcgtgctaccatgcttgcctaattgttgtatttttagtagagacggggtttcaccatgatgaccaggctggtcttgaactcctgaccttaagtgatccacccgtctcggcctctcaaagtgttgagattacaggcgtgagccactgcacccagcccactgagggtttcctagtggaggaggaggccaccatcccctcattgtggtgtttataatggggaactcccagaggagccaccagggtaaaagaggaagagatgagatgttggactggcataaaaaaagaaaagcagaccaaaactccagcgtgacagcagcaaagcccatcacaactgcatcataattatcatcagcagcaatagcagctggagtgatttcttttctttttttgagacagggtcttgctctatcacacaggctggagtacagtggtgtgatcgtagctcactgcagcctcgacctcccaggctcaagcagtcctcctgcctcagcctcttgagcagctgggactacaggcacaagccactataccaggctaagttaaaaaaaaaaaaaaaagtgtagagatggagtctcacttaggctggtcttgaactcctggcctcaagcaatcctcctacctcggcctcccaaaatgctgggattacaggcaggagccaccttgccaggctgatcttttaaattctttcagcgtcaaagccaaagttttctcaatgtcctaaaaggccccaggccctctgccctccctcccctgctaccccgccctgtggcctctctgacctcatctcctgttgttcctgccttgctcattcttccccagcctcactggtcccctggctgcggctccaaaacgctggccactcctgccccaggacacttgcctttgctctcttccgtgcccttcccagacatccccacgacttgctcccttactgccttcaggcttctctctctctctctctctcttttttttttttttttggagatggagtctcactctgttgcccaggctggagttcagtggtgtgatcttgcctcactgcaacctccatctcttgggttcaagtgatccttctgcctcagcctcctgagtagcgggggttacaggcgcatgccaccatgcccggctaatatttgtatttttagtagagatggggttttgccatgttggccaggctagtttcaaattcctggcctcaagtgatctgcctgcctcagcctcccaaagtgctgtgattacaggcatgcgccacggtgccccgctgagacttttctccaatgtgaccttctcagccagacatccttgatgatgccatttacatttgcaatgctccctctatcccatctcctcccaggaatgcctcttcatgtctttgctttttttttttttcccccacagaacttctcatcatcttcatgctacatatctctgtttcttgtgtatctccctcctccatgtggatgggggtttccagaaccgagcctggtatggagcaggcggtcaggatttgctcttgaatgaaggatgggggttcactccctggagctatgttgggagccctgttctgaggagctctggcttcgtgggtccccaggacccagggtaagacagtccactccttgggcaatgactgggaccagtacctggggaggttggggcccttcatcccaactcagtcccatccttgagggaatcaactgtgactcacagctaacagggtgagcagagctgcttcttcagtcacgaatgaaaataaccttgtctctgtaaacaaacagctctcaatttattcattgggaagaaagaagtgtgtgtggaaagaaggaggcactttcctggggggcggagtgtcagagtgttagacttgagttactcagagtaattgattcacgatgctgcgtgtcaggggtgttacatctaatcgggagctgtccatacaatttctcactaattgtcactgggcgccataacaggataatgactgttggggcacaagagacttggatgtggtgagccaagggtatcattttgatttttgttttgagatgtgctggaactcagatgaccctccttaccgaaaggctccatccctttaaatttttttttttttttttttaagagatgatgtttttctgcgctatgttgcccaggctggtctcaaactcctgggcttaagtgatccttccacttcagtctcccaagtagtggggaatgcaggtgtgagccactgcacccgactgaaaagctcattctttttttgttgagacagggtctcacgctgtcacccagacttggagtgcagtggcgtgctcacggctcactctagccttgacctctcaggctcaagctatccttccatctcattctcccaggtaggtgggactacaggcatgtgccaccatgcctggctaatttttttattttttgtagagacgggggtctcactatgttgcccaggctagtctcacactcctgagctcaagcgatcctcccaccttggcctcccaacatgctgggattacaggcatgtggaaggttcattgtttagccagagttttgttctggaccggagacaatctagagggatgcagacctgggcttggaccaccagaggtctggctggacccctgggggccagaagtgcctagttgaggggtatcttcttggactcgttacttactcctcactttgaacctgtcaccaagtgtgtcagttttgcctctaaagcatctgtcagctctgtccacttctctccactcccactgccaccccctgctttcacctggtgaccacagacgctgcttagcttctgctctgtctcttattcccttccctttgcctctacccgggagcatacatgtaatggtgacagttccctgcataacacactgcagcggtcccattcccttgaggatgaagaccaaaatccttaacatggctcaagagatcccacaaccatctggcccctgcccacttctcagcctcactgttcaccattttctccaggcaaaaggaaggaccagtgacctaagaatgccatggggctgctgccctcattttgcactctaggattttgaccttattatttcctgtgcatgggatgctttcttcccctccctccctccctttcttccttccttccttccatccatcctctttctttctctctcctctccctctctctctctccctccctccctcccctcccctgcctcccttcctcctcctcctccttctttcccctctctctctctttctttttgagacagggtctcattctgtcacccaggctggagtgcagtagtgtgatcgtggctcactgcagcctcaacctcctgggctcaagtgatcctcccaccctagcctcctgaggagctggataccactgtgtgcagtgagtgcatgccactgtgcccagctaattttttgtattttttgcagagatggaggttttgccacgttgcacagtctggtctcaaactcctgggctcaagtgatctgcccacctcggcctcccaaagtgctgggattacaggcatgagccaccgcacctggcctaggagctgcttcttagatcttccgcagctctttctcatcaccagctaaaatgctgtattctggtagcattgtctttatcctcctctggactgtatctctcttgaagtcttccattccagttcatttctcctgagcctagtacaataatacatagaaagcgctgggatatttttaaaaatactaatgtttagaatcaattttaattccttctgtaaaaaatatacgtattttgcctttttaaaaaaatgcaaaactgggccaggtttagtggggcatgcctctagtcccagctacttgggaggctgaggtgggaggatggctggagcccaggagttcgaggctgcagtgagccatgattgcaccactgcactccaacctgggcaatagagtgagatcctatctcaaaaaaaaaaaaaaaaaaaaaaaaggaaaactcaagtccttttagtgatcacaccaagttcctgcaccttgtcgcttttttattttattttattttatttttttgagacagagtcttgctctgtctcccaggctgaagtgcagtggcatgataccaacttactgcaacctccgcctcctgggttcaagcgattctcctgcctcagcctcctgagtagctgggattacaggcatgtgccaccatgactggctaaattttttgtatttttagtagagacagggtttcaccatgatggtcaggctggttttgaactcctggcctcaagtgatccttctgccttggcctcccaaagtgctgggattacaggcgtgagccatcacgctcggccagcccttgtttttatgaacatcgtgtatccttaaggaccttcaaatacttctgcatccatttgtatgcatctttagttttgttctgaaaacctcaagatatagcacgctatgtgtatagtttgcaacttgaatttttttcactcaacactgtgtttctgagaccaatcctcgctgatacatagagagctagttaattcctcctgccttctgcatagcatctcactatgttattaattgccttttgttttctcaagctatttctgtgttgatgggcatttgtgttgtgtctactgccttgctattgaaaatagcacttcagtgcgtgcaccgcgtaggcctctgtgtactaccgtgaagtgtttcctgaggccagtagttctcaacttggctgcagacagaatcacctgaacgttttttttttaacaatcacaccaactctctgcctttccccaaattcttaattgaatggttcagggtaggcatcggcagttttagaagctccagggtgcttctaaatgtgcattcagggttgagacctgctgttctggggtgtacattggggatgttggtgttgcaatgactgggccaaaagaagaacccaaccccgtgttttaccaggctctgcccaattgcctttcaaggtgactgaactgatctacatcctgctggcagtgtgtgagcgaataatgactgttttgtgtgaacaagtgactaccagtcactgcaggtcagtgaaccagagcgttctccactgcacaaactgcctccaagtggctcatcaccatgggctacagcccacaaacgtctgagcttggaatgctttgtgtccttaggtggcagcttggtgcagctgaaaaggtgccaggctgctaatgggacaattcggagtccagttcagacccaggttctaccttgctatgtgtcctcccaggtcacatccccacactgagcctcagcatccctgcccttggagggaggagagctggaaactcacctgcggtcattttcatgtttctcttctgtctgagccacacgttacttgcagcctgtggtctgagcatgggcgttagagcccagtcctgaatagtttctgcactgtgggccctgttggtatctggggaagcctattacccttctcagagcaatgtttctttttcttctcttttctttcttttcttttctttcattttttgtttgagacagagtctcgctctgtcactgaggctggagtgcagtggcatgatcttggctcactgcaacctctacatcctgggttcgagtgattatcctgccttagtctcctgagtagctgggattacaggtgcctgccaccacgcccggctaatttttgtatttttagtagtgatggggtttcaccatgctggccaggctggtctcagacagctgacctcaggtgatccacccgccttggcctcccaaagtgctgggattacaggcgtgagccacctcgcccggccttttttttttttttttttttttagagacggagtgtccctgtgtccctctgtcacctaggctggagtgcagtggcttcatctcagctcactgacctccgcctcccaggttcaagtgcttctcctgcctcagtctcccaagtagctgggactataggcatgcaccaccacgcccagctaatttttgtgtttttcagtagagatagggtttcaccatgttggccaggctggtcttgaactcctggcctcaagtgatctgcctgccttggcctcccagagcactgggattacaggtgtgagccactgctcccagcctctgagcaatgtttctaaatatgaaatccaaaggcttgtgaagacaactgattatatggaaatacagctgatataaatattacaaaattattacaaaaatattacaaagccaaactgtgatatagcaatacccatgcctctttattaacacaccaaataaggcgatctgatggtgggttggcaacattattacgattgcagtttaaagcagtgatgagtgtaaatgatattccaacatctttgcaacaaatgtaacaggacatgaaaatatctgtgattcctgttggtgacaaagttacaggttctgttgacacgacggcagtttgctgcctacactcataatggaaagaattgctacattgcagtttgatgttagtaaaattaagaggtctattttttcttccgagttcattgagttcattgattgcaggttactggcccttgctagagttatatagacttgagtttctttcttttttgtgagttttttttttttttttgacggagtcttgctcgtcgttcaggctggagtgcagtggcacgatctcggttcaccgtaacctccacctcccgagttcaggcgattctcctgcttcagcctcctgagtagctgggattacagcatgtgctaccacgctcagctaatttgtgcatttttagtagagacagggtttcaccatgttggtcaggctggtctcgaactcctgacctcaggtgatatgccccctcccctccttggcctcccaaactgctaggattacaggtgtgagccattgtgccctgcttttttgtggctttttaaaaatttttattttgtagagacgaagtctcactgtgttgtccaggctggtcttgagctcctgagctcaggtgatctttctgcctcagactcccaaaatgctgggattacaggcataaaccaccatcccaggctagacatgggtttcaatctctgctctatagcttcctgtgtgggtgcatttgggtaaattccttttctttcctgagtctcagtttcctcaactgtaaaatgcatgtaagacagtgagctcctagggtgctgggaagagtaaatgtgacaaatcaaattcaacacacatttgtagagaacttttgatgtgctcagggccattttcggtgccaggatgctggaccgaatgagaagggcaaaatccttgcccctctggagtttacagttcgggggcagagacaatgaataatgaggcagataagtaaataacggtttcagataatactaagggcaatgaagaaaatagtacaggtgatatgaaagggaacaaatgcctggtgcaggtgacattaaatagggcaattaggtaataatacagacagaaatgaacaatattgatgcataagacgagagaatgtatttgaagtatcagctcggcacctggtacgtggtgtatgttccatttgtgctggccacggtgatgatgatgatgatgccatctctccggctacactgcgagcacagatcacagctctctgtagctgatgctggctctacccactgtattcggggctggatgaaggtggggccatggaagcgttctacacaagaactcagcagtcctgttggagccagattggaaggaagcaggtctgattaaaggaagataaagtcttctctctgctaagtctcgcagggagagctaggcaatcaataggtctcgcagatcagtggagggtgcttggaatctggcagcatggggctttttaattaaacctataactgtgagaaaaggtaactgccttatttctgcagcttgtgtttctgtctgcctgccagaaactgaacaaatcaatgcacttccagaggttctgaggatcttgacaagggggcctctggttttgggatggccagaccctgcagggataaactctcgagtggccagggtgtcaggtaccaattctggagggtcaggtgttgccttttacatttaaatacccatagcaggtgtgattagcaactgcaattcaggggaaggcgaggccccttcccagccagcagcagcttgccttccaggattttataccaagctggccccctaccaccacaagatgtcaacattcctttttttaatagaagattttcttttattgtgggccaggcatggcggcttgctcctataatcccagcactttgggaggccgaggctggcagatcacttgaggtcaggagttccagactatcctggtcaacatggagaaacccctgtctctactaaaaatacaaaattagcttggcatggtggtgtatgcctgtaatcccagctactcagaaggctgaggcacgatcatcatttgaatccgggaggcagaggttgcagtgagctgagatcacaccattgcactccagcctgggcaacagagtgagtctccatctcaaaaaaaaaaaaaaaaaaaaaaaaagattttcgtttatcatgaagtagaattatgctgtttagggtatggtccatgcaccagcatcacagcatcatctgctgggaatgtgtcagagatacagaactccagccccaccccagacctactcagttagaatctgcattttaaccagatcatcaggaattcatatgcatattgatgtgtgagaggcactgaaattgaacatacatatgagacttagaagacaaagaagccaaatgccaatatgcagaccttatttaaatcctgagagagttaagaagttatctatgagataatttgagatttgaacatttgcagatattaaggaattattcatttcctaggtgatagggaggttttatttcaaaaaaaaaaaaaaagagcccttttggccatgcgcgatggctcatgcctgtaatcccagcactttgggaggctgatgtgggtggatcacctgaagtcaggagttcaagcccagcctggccaacatggtgaaatcccgtctctactaaaaatacaaaattagctaggcgtggtagtaggtgcctgtaatcccagctactcaggaggctgaggcaggagaattgcttgaacctgggaggcagaggttgcagtgagccgaggtcttgccactgcactccagtctgggcaacaagaatgaaactctgtttcagagaaaaaaaaaaacccttttcttttagagttacacatgaaaatacttagagataaaatgatttcatgctcgcatttgttttaaaatactggtggagctagacaaagtcttgacgtttggacacagcacgaatgactgtgagttgatggtatggggaactgtgtcacgacccaggcagacacagtacacagtatactgtttacttagtatatgtttcaaattccccacggtaaaaacctaagatgatgatatagaatattcacatagaaaatgcatgaaacaggctgggcacagtggctcacgcctgtaatcccagcactttgggaggacaaggtgggcagatcacctaaggtcaggagtttgagaccagcctggccaacatggcgaaaccccgtctctactaaaaaatacaaaagttagctgggcatggtggtgggcgcctgtaatccccgctactcaggaggctgaggcagggagaattgcttgaacctggaaggcagaggttatagtgaactgagatcacgccactgcactccagcctgggcgacagagcaagattctgtctcaaattaaaaaaaaaaaaaaaaaaaagaaaaagaaatgcatgaaacaggaaggtgttgtgatgagcattagttcaagtggacatccataaatctgttaccaggtcattaccggctcctgccctctgtcagaacctctgccccagagtaatttcttccctcccattctctggggcgctctcacccctagctgcctatggaatcgcctgggaaaactttacaaaacaatgcagttgagcctcctccagtccaatgaaaacatactccctgggagtgcgcacaggtgattctaatgtgcgaccttagctgccctagcttttcaggtgaatgccatatttgtgcttgaatttctcaacgagcttactgctgcttacatccaacaggcaatttcactttctcatcaagggactgagttgctggactgttgtataagcacaggttacattgcaacccatttttttccttttttttttttttttgtttgagactatgtttcgccgtgttgcctaggctggactcaaacttctgggctcaagtgatcctctctcttcagcctcttgaggagatggggctttagctaccgtgcctggcttgcaacccatttttgaaactaatgggtttttgtgtatttgtgataaatgtgtatctaccacatattgagtgctttccatttctctggaactctgctaagtactttattttatttaatccccaaaacgattgtggggtcagcatccctgtccctattatactgatgaagaaacaggctcagagagactatgtggcttgcttcaggtcacccagtttaaaaagtgctgagtgtggattgggttcatagctctctgacttaatgctcttaagcatcattttgtgccgttcattcagggtcttgattgaagagttgagggccagttagccacccacaatgaactggaagtaaacatggagaggtcgtcacagtgtcactcgaggcacacttaagtggtgtgccttggagctgagtttccgtctttgtcaaatggggacagcactgttttgtcttctctggctgacaacctcttactcatctctcaaaagtgcgtcagttgtcacagaatggggaagccggaaagctcctctgaatttcaagggacctcctggctaaagcagaattagtcatgtcctcctctagcctcacagaccacttgtccaggtctctgagagcagtcgacaggagccctacacttgtcatgtgagacactggcgcgtctaagaacaggtgctgttttgtagctatttctctgtctgcagagtccagcccaggggctggagcatggcaggggcccctgcatgtctgcaatttgaatgaaagacgagggtactgctcaaacaccaaagctttggtcagagcctaggatgtactgacacaggaccctttgggcagagatatatcacacacagccacaggagagtggttaggaacctggactctgaatgaagactgcctgggttcaagtccaagctctgccacttacaagctgaatgaccttgggcaagttatctcacttccctgggcctccctttcctcatctgaaaaaatggctacattgcagccttgttataaggattgaatgggtgggtgcagtggctcatgcctgtaatcccagcactttgggaggccgaggaaggtggatcacaaggtcaggagtttgagaccagccaggccaacatagtgaaacccgtctctactaaaaatacaaaaattagccgaaaaattaaccgggtgtggtggcacgtgcctgtagtcccagctactcaggaggctgaggcaggagaatcgcttgaacctgggaggcagaggttgcagtgagccgagaccatgccattgcactgtagcctgggtgacagagtgagagactccatctcaaaaaaaaaaaaaaaaaaagaaacttaactgggcatggtggaatccacctgtagtcccagctcctcaggaggccgaggtgggaggatcacttagcccaggagtttgaggctgcagtgagccactgcactccaacctgggtgatgtagtgagaccctgtcttaaaagaagaagaagaaaaaagaatgagtttgtattttaaaagcacttcaatgatgcctggcactctggtgccaggggccaaaggaaaagttagtaataccaatcatttcctgaagactgtgatatttgtttatcatgggtatttttgcattaattttgcattaattttttcattctttttcgtttttaaacatattgcatccaagtgttatttatcttgatgactgggtgtttggtgcctccttaaattttgctcccggggagaatgtctcacttgcctctccctcatcccggtcctggcacctaagaagcaacacatcagttctcatttgtctggagggagctcagcatcattatatgtatttaaagaaaaagatgaatgtgtatatattaccaatacttattcagaatctacaaaactctgagcactggggatgggactgtgtgatggttaataccgagtgtcaacttgattggattgaaggatgcaaagtattgttcctgggtgtctgtgagggtgttgccaaaggagatgaacatttgagtcaatggactgggaaaggcagacccaccctcaatctgggtggataccatctaatcagctaccagcatggccagaataaaagcaggaagatggacatggaaggacttgacttgctgagtcttctggccttcatctttctcccatgctggatgcttcctgcccaacataagactcaaagtcttcagtttttggactcttagacctacaccagtgtttgccaggggctctcggaccttaggccacagacggaaggctgcaccgtctgcttccccacttttgaggtgttgggacttggactgatccactactggcttccttgctcctcaacttgcagacggcctatcgtgggactttaccttgtgattgtgtgagtcaattctccttaatacactccctttcatatacacatatatcctattagttctgtccttctagagaaccctgactaatacaggctgggaatgagacattctcagccacggtctttgacctcaaggagttgacagatcactgattattgttaccacttattgagcatttactgtatgcaagacatggtgctagtgatgtttttattaatccttgtggtgacctttccagaaagaatcattacattcattttacagatgaagaaattggactcagagcaattaagccacttgcctgaagtcatgaagttatgagctggggtcaggatgtgaacccagtctccctatctatctatctatctatctatctatctatctatctatctatctacctatctatctatctatctatctatctatctatatcagggtcttgctctgtcacccaggctgggatgcagtggtgtgatcatagctcactgcagcctcaacaccctaggctcaagcgattctcctgcctcagcctcctgaggagctgggactacaggtgcacacaaccatgcctggctaatttttagatttttattgtagagatgggggtctcactatattgcctagctggcctcaaactcctgtggcaaagtgatcctcccacctctgtctcccaaaatgttgggattacagttgtgagccaccatgcctagccctgtgaacccagtcttttagactttctaccacggtatttgggtaagtccagagctctgtccccatcttctgcaagaacatcttgaaagctgaagttatcagatggatttttctgggagttccattgctgagttcctctgattcatgtctcaggaagctggagtctagacgtggcggggcctgtgggaggtggccctccccttttcagagtggatctgtgcagccatctgccatcacccattcctgtgggggaaaacacagattttcctgtgttaaaaaatctctgagacaagactttggcaggatctgaacagactggcgaagtggctccaggatttcctggaaaaggatgagaagggggaaagagagggcaaaggagaggaggagagagtgggagggaaagaaggaggtcagggagaagaaaaatgagcaggaagagccagcagacagcctcccaggtggatgtctttgaaggtaactgaaatgcatggtggggttttcccaaagggtttctgttagacatttcccactcccagtagggaaactggcttccctaatcagggaagggcagttcagggcagtggagcagtgggtgtcgataatgcccatcttgcagactagttgcgaagttccagtgagattgaatatctgaagtgtagtgttggcacacaataggtattcaacaatgtcagttcagttctctccttttttattttttatttttatttatttatttattttttgagatggggagtctagctcttgtcgcccaggctggagtgcaattgcccaatctcggctcactgcaatctttgcttcccaggttcaagggattctcctgcctcagcctcccgagtagctgggattacaggcacccgccaccatgctcagctaatttttgtatttttagtagagacggggtttcaccatgttggccaggctagtctcgaactcctgacctcaggtgatcttcccacttcagcctcccaaagtgctggggtaacaggcatgagccactgcgcccagctagttctctccttttttaaagacaggctcttactctcttgcccaggctggagtacagtggcacaatcatagttcaccacagcctcaacctcgtgggctcaagtggccctcctgcctcggcctcctgagtagctgggactacaggcatgcaccaccacaccccactaattaacaaattagtggaacgtagtggcaggcacctgtaatcccagctactccggaggctgaggcaggagaatcgcttgaacccaagaggtggaggttgtagtgagctgagattacgccactgcactccagcctgggtgacagatcaagactccatctcgaaataaaaagaaagcaaaaggttccttcattctcctgcctttatccattcactcagcacagtgagcacctaagtgtgccaagcactgtccaaggtactggagatataacagtgaacaaaacagacaaaagcccctgccctcgtggagctgagattctactgcggtaggaaaaagtaaaaaagaaatagataatattataggaacttagagagctgtgaaagctaaggataaacaaagcagagaaggaggatgaggggatgttagggatattggtttcctagttttttctgctataacaaattacagcatgaatctaggggctttaaacaacccatatgtgttatcttatagttctggaggtcagaactctaaaatggatcagcagggctgtatttcttcgggaagctctaggggagaaaccatttccttgccttttctggtttctagaggcttcctgcattccttggatcatggccctacgtcattctgatctacatcactcctcagtctctgaccctcttgcttcccttttataagagcctttgcaattagattgagccatacagataatctaggataatctcctcatctcaaaatccttactttaatcacatctgcaacctcctttttaccatgtaaagtaacattcacaggttctgggtatcagcatgtggacatatttggggagggggtagttgtgaattattctgtctaccacaggaacagagattttagataaggtggccaggaaatagcttatttatttatttgtttttagagacagggtctcactctgtcacccaggctggagggcagtggtacaatcatagctcactgcatccttgaactgtgggctcaagtgaacttcccacttcagcctcctgagtagctgggactacaggtgtgtgccatcacacccggctattttctttttttgtagagacagggtcttgctatgttgctcaggctggtctcaacctcctaggcccaagtgatactcccgcctcagcatcccaaagtgttgggattacaggcacaagccaccacgccttcccagaagaacttattgatgtgacttttgagtagggacctgaaggaagtgacggatagacacctggggagagaaccttccagggagaggaaatgttagtgcaaaggctctgaggagagagtacaatgagtgtctgtgtttgaggaccagcggggaggccagaaaggtcacagcagggagatccaggggcagaaagacaggaactgaggtcaaagaggtcctatgggtgggggtaagggagaggtcatgaaaggccttatagatgattgtgagaaaaatgtcttcctctgaatgagacggaaaaccataagacagtttctctaagcacctgttcaataactgactatgaaagaaaatctgggccaggcacagtggctcatgcttgtaatcccagcactttttgaggctgaggcgggtggatcacttgaggccaggagtttgagaccaccatgggcaacatagggagaccctgtttctgcaaaaataaaaacaaaaaattagcctgatgtggtggcgcacacctgcagttccagctatttgggaggctgaggtgggaggattgcttatgcccagcagtttgaagtttgaggctgcagtgagctttgatggtgccactccagcttgggtgacagaacaagaccttgtgtttctaaaaaaaacccaaaaaaacccaaaaaaaactaaaagagataagtgaaaagagaagtgcaaaatgaggtgtaaacatgtaaaaaggtgtaaggaaatatggaagggacacaattgacaagagaccagaaaattcatagaatgaagtcttcaatgtgtgaagggaaagggctaacataattatgtttcaaagaattcaaacaaatcactaagacaagtccctgaatctgggtagaaaaacaagcaaaggggtgcgaaccgtcaactcactaaagagaaaatgcaattagctaagcacatgggaaaagtcagcctaactagtaatcaaagaaatgcaaattaaaacaacaaaccgttatattttcacctcataaagattctgaaaatgagaatcctggctttggccttggtggaatgaaataggtgcaagaaccctggcagtgggaattggaaatctgattattttgggaaacagtttgacactgggtagcaaaaccttaaacatgggcatcctcattggcccaataagtcaatttttggcaatctagcccaaggaaataattttaaatctggagagagccttatgcattgctgccaaacaggagaaacaactaaactgtgagcaataggttaaataggccacggtgctcattcttttgatatttttgtcaatcatatgaattaggtgccagttatgtgccaggcactgttctaggtgccaggaatacagcagtgaacagaacatcttgaactccttgcccttcatggggttctgattctagtgagggagcaggagagcaaataagaacagatatgaagatgctacatgatgggggacaaagtagggcaatgtcacagagagtggaggggactgcagggtggacaaccaccagtttgctggggacattcagttttaaggctggggcagccctggacaaactgggatgagctagtcacactaagagggtcatccttgtgatgggagtggtcagggtcttgtcctctgaggaggtaggatttggttagggactcaatgcaatgagggagtgaacgatgggagtgctggctgagtaggtttccaggctgacagaacaatacctgcaaaggcccggaggaaggagtgttcctggggcaatgtgagggacttgcacaaggctggagtgtctggggcatagcatgaaggaggatggtggtaagatatagatttcagagagggaaactcttgactcttgcagggaaaggaagaagtttggattttattttaaatccagtgaaagcctatggaggttaagcagggaagcaacatggtaaaatttatgcttttagaaagacgactctggctgctgtgtggagaaggtgatgcaggacaagtaagccccaaagttggggcttagcttgggagggttcttggcttcacccaggaaagaattccagggtgagcggtggtggtggacacttttatttttttgagacagttttcactcttgtcacctgtgctggagtgcaatggcaagatctctgctcattccaacctctgcctcctgggttcaagtgattgtcctgcctcagcctccagagtagctgggattacaggcacccaccaccatgtctggctaatatttttttgtatttttagtaaagacagggtttcaccatgttggccaggttggttttgaactcctgaccttaggtgatccaccccctcccaaagtgctgggattacagatgtgagccaccatgcctggcctagacacttttattgaagcagcagtgcacagcagcagcagagggactgctcctcacagagcagggctaccccataggcagtgtgcccagagtagcagctcagaggcagttctgcagtcatatttatacccacttttaatgatatgcaaattaaggggggatttatgcagacatttctagaaaaaagttggtaacttccgggttgttgggtcattgccatggaaaggggcagtaactcctgggtgttgccatggcaatggtaaactgacatgccacgctggtgagagtgtctgttggaaagctgcttccactttggccctgttttttttttttttttttttttttttttttttttttttttttttttttttggtatttattgatcattcttgggtgtttctcgcagagggggatttggcagggtcataggacaatagtggagggaaggtcagcagataaacatgtgaacaagggtctctggttttcctaggcagagggccctgtggctttctgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttggggataaggttacagattaacagcgtcccaaggcagaagaatttttcttagtacagaacgaagtggagtctcctatgtctacttctttctacacagacacagcaacaatctgatctctctttcttttccccacatttctcccttttctacttgacaaaaccgccgtcgtcaccatggcccgttcccaatgagctgctgggtacacctcccagatggggtggcggccgggcagaggggctcctcacttcccagacggggcggggggcagaggcgccccccacctcccggatggggcagctggccgggcgggggctgcccccacctccctcccggacagggcggctggccgagcgggggctgccccccacctcctggacggggcggctgccaggcggagacgctcctcacttcccagacggggcggccgggcagagacactcctcacctcccagacggggtggcagtcaggcagagacactcctcagatcccagacggggtcgcggctgggcagaagcgctcctcacatcccagatggggcagcggggcagaggcactccccccatctcagatgatgggtggccgggcagagacgctcctcacttcctagacaggacggcggccgggaagaggcgctcctcacttcccagactgggcggccgggcagaggggctcctcacatcccagacgatgggtggccaggcagagacactcttcactttccagacggggtggcggctgggcagaggctgcaatctcggcactttgggaggccaaggcaggcggctgggaggtggaggttgtagtgagccgagatcacgccactgcactccagcctgggcaacactgagcactgagtgagcgagactccatctgcagtgccagcaccttgggaggcccaggcgggcagatcactcgcggtcaggagctggagaccagcctggccaacatggcgaaaccccgtctccaccaaaaaatacaaaaaccagtcaggtgtggcagtgtgcgcctgcaatcccaggcactcagcaggctgaggcaggagaatcaggcagggaggttgcagtgagccgagatggtggcagtacagtccagccttggcttggcatcagagggagaccgtggaaagtgggagacggagacgggagagggagacgggagggggagggggagggggagggcagggggagggggagggagaggggccctgttttatagctagtcttcaatttggtctggtgtctgagccccacctctggagttgagtcctgcctcctacctctaaggcatgttggtggatgcagggtagtgggcagaatagaatcatgtagaccccttagaaggttgttgtaatctagggcagtggttctcaattttaaccatgcatgagcatttcatgcaggggttgttaaaactcagcctcctgcccctggagtctacgtctggagtctgcatctctgactagctcccaggtgatgccagtgctgctggtcctggaccacattttgagtagctaaaagctaggagagagataatggggacttgcagtaaggtggtacccctgctgaggttaggaagagctctggtctgggatgcattttgaagtgaaactatcaatctcatttcagttcccttttaatctgcttacaccaaggagaatagctcaatttgatactagtatgtttctaagacttttctgtattttagctaacagaaagcaggcctcaaagtgtagagcaggctgggcgcagtggctcatgcctgtaatcccagcactttgagaggccgagacaggtggatcacttgaagtcacgagttcaagaccagcctggccaatatggagaaaccccgtctctgctaaaaatacaaaaattagttgagtgtggtggcacatgcctgtaatcccagctacttgggaggctgaggcaggagaattgcttgaacccgggaggcagaggtttcagtgagccgagatcaggccactgcattccagcctgggcgacagagcaagactccatctcagaaaaaaaaaaaaaaaagaatccaatagtgtgatagtggacaaaagaatccaatagtgtgatagtggacatgaaaatacttcatggactacaaagctcttcaccctgctatctgcttcatctttgtggggcaggctgggtgcatcaccagactcctagtcaagtgctctctcttattgttcatggccttgtgttgccccagtcctgggggaggggctgacttttctgcaggactataggaaaggagaatcatagacatatgtccacttgtcagttacctgtgtttccttcttgtgctctgggcagccgatgcactttcctgattgctgtggagcctactaggatctaggaatgaatattgtgcctggctttgggggttcaaaactctccctcttggctcttgagctgcttacttgagcccattcccactctgtggagtgtacttttgcttcaataactctgtgctttctttttgtttgtttgttttttgagatggagtctcgctctgttgcccaggctggagtgcagtggcgcgatctcggctcactgcaagctccacctccagggttcatgccattctcctgcctcagcctcccgagtagttgggactacaggcgctcaccaccatgcccggctaattttttgtattttagtagagacggggtttcaccgtgttagccaggatggtcttgatctcctgacctcgtgatccacctgcctcagcctcccaaagtgctagaattacagacgtgagccactgcatccggcaaatctgtgctttcattgatttactctttcattgctttgtatgttttgtctgagtctttgttcaaactgccaagaacctggacaccctccactggtaacatattttggcgttccagccaggggacaataacgggaaagactccatctatgctacctgatcccccgcttggctgcatcctcaaccactggtatcaatttgaccccaataatctaaggaggaaatgcttgatattcttttgcaatagtttgtccccaatattgcttggaatctggagtttgttgttgaatgggaaagtgggatggtgttgtatgtatccaagcttttgtgctgctgttctaagcagggtcaggcctggttagcatgtggtgctctcttttggtgctgtttggccccggtgttctttggaatttaaaaatcaaactggcatggaaactgctttaccccaaaattttggttcacagccttcactggattacctactggggcaaacagagtgtaaccatgtaaaaccggcgagcttgtattgctatctcatggctagagttccaaggtaaaagccatttggatcttcatttgtgtgcgtgtatacatgtctaaatgtgtttatttgtatgtagacttactgttatatgttgtgcctaccacattggcttataagtaagagagtgcccataacttaataagtccaagcaattttcaagttcacgtgacttaagtaaatctttacgaaactagctagctttaaaattattggtaaatacaaatagaaatgtcttcagaattggcaacatacatttttatctgggttttatgtttttgtctttgctagatattttgaggtgtcaaggctatcaggctgggcgtggtggctcacatttgtaatgccagcactttgggaggccgaggtgggcggatcacctgaggtcaggagttggagaccagcctggtcaacatggtgaagccccgtttctactaaaaatacaaaaattagccaggtgtggtggcatgtgcctgtaatcccagctacttgggaggctgagggaggaggatcacttgaaccagggaggtggaagttgcagcaagccaagatagtaccactgcactccagcctgggtgacagagggagactcactgtctaaaaaaaaaaaagttataaagctattaacccagccaaaacaacaaaaacaaaaaactgtcccttttgcctttggttcactcttggatccagatggaaatctccagctgttctggtgttctggaccaagaagtttgagaaaataagaatccatggacaagaaaattttgaggtagtggttcagagttctggctcgtggcctcagttccaatcctggttctatccttgcttggtgtgaggccttaggaaatctccttgtgtcagtctgggtcctccgagaagcagagcttgctttgagactcaacatgcaaggattttttttttttgagacggagtctcactctgtcgcccaggctggagtgcagtggcacgatctcagctcactgcaagctccacctcccgggttcacgccattctcctgcctcagcctcctgagtagctgggactacaggcgcctgccaccatgcccggctaatttttttgtatttttagtagagacggggtttcaccgtgttagccaggatggtctcgatctcctgacctcatgattcacccgccttggcctcccaaagtgctgggattacaggcgtgagccaccgcacctggcctaacatgcaagggttttgttaggggaaacccttgtgtgaaaggagttagacagtgatgaagcctgactccaagggaggagaagagagaatgttggtggaactgtccgtgctgtgcggtctaaagaaaattggggtttccaaagtcagttgtcaagggcccctgtgttttctaggaatgagctgccttagtttctgtgctgccatacactattgatgggtgagatggattttaaatctagctgggcccttgctctcttatgctccccatagctggaggtcagtggcaggtgcattcttgtggccacgcatcacttaacctctcatgggattgttactacaatcaaatgagacaaggtgtgtaaaacacttggtacaagatctggcataaatactcaacatattttaactattatgattacccagttattctttcgaagccaacaagaaagttttcttctccttttgttatcaaccattccctgcatcagaggctgctaattcagtcagattccctgtaaatgagtgatgtgggccaagtgtaagacattagagagtgggagggactatggtaaactagaaagcacatgaaacatctaaaatggtttgaaaaatagctgggcgtggtggctcatgcctgtaatcctagcactccgtctcaaaaaaaaaaaaaaaaaaaaaaacccaacccaaaaccaccccaaaaaccccagtgaggttgattttcccacccccccaaacccattaataaatttgttgtgtatttgacgacatggagagacctggctggttgatttctggttttgtgcacagcttcagtgttgtcttttctgagaggttttgaatgtggacatcgggattggatggcatgggttgggatcttggctctcccacttgccagccatgagatattgggcaaattatgaaatctcgggcaaattatgaaatttcctggtaactcagtttttccatctgtaaaatggggataataatgattctcccctcatgaaatttcaatgaggatttaatatacagaaggagtttaggacagtgtctggaacatagtaaggctgagtaagtgttgatgttattctggggttgagagaaggagcaagaacaaccttgggttgctggaggctctcatggtttttcctcatcatttcattccacttaagcctaaaacaatatgatcggtataacacccagacaggaatgagtttctcttataccggtgatataatcatatataataatgccacttacataagcttccttagctccttgttaaggccacccacactccgttccacttcacactgttaaggaatgtttctcccacagggaaaaagacacccagctctatgctaattaccactttaaagcagggaccaaggggtgtgagggggggaaaccagcaaaggtgtctttggcagtgctcttgatttgggagagtaaagtctttagtttggaagcagtgagtcaggcctggggacctcagaggagccagaggcaacccatggtgtcccccagattaggcaggcccaacctacgccttaggtgaaaagtgtctgtgagccagccctctgcagacaaatgctaatctgccatttcttttattgcttaaaaaaagagagtctgagacatattctacgtgtgatacaagctcattgtggaaaatatggaaaatagatgggaacaaaatgaaagtgtaaaagtcagaagtcatgagcgatgaatatagtcaagctaacagaaaaaatataaaaagtcagaactcattcagctgaaagtgtcagaaatcaattgcaaactggtttagatgattcaagagaatatattggcccacagaacaaggctgtcacagaggtggatcaggcatggctgtatccagggctcaaacgttattagcggaatgccatcttgcttgctctgtctctatttcatgaataggccttctccagatggtggaaaaggtagacattatcaattccagattaatctccaccaactgaacaatgctactagaaaggaagaggctcttcccagtgctcagataggaaagtctcagggagggacttgattggctgaagatgtaccacgtgtgcatccttgaaccagtccctgtggttggggatgtaccacctgtgcatccttgaaccaatccctgtggttggggatgaggtgctctgattggccagatcagtgagtcaatggccaggggagatgaaatcaaggaatggtccacttaaataggtcctccacagggagtggtgattctgttccaaaagaaagagaaggaaatgaattgatgaaaacaatggatattgctatataagaagcatataacatctgtaatcccagcactttgggaggctgaggtgggcggatcacctgaggtcgggagttcgagaccagcctgaccaacatggagaaaccctgtctctactaaatataaatatatatatatttagctgggtgtggtggcacgtcccagctactcgggagactgaggcaggagaattgcttgaacctgggaggcagaggttgctgtgagccaagatgacaccattgcactccagcctgggtaacaagaacaaaacttcatctcaaaaaaaaaaaaaaaaaaaaaaaagaggtcaggtgcagtggtcacgcctgtaatcccagcactttgggaggctgaggtggtcggatcacgaggtcaggagatcgagaccatcctggctaacatggtgaaaccctgtctctactaaaaatacaaaaaaattagctgggtgtggtagcgggcgcctgtagtcccagctactcgggaggctgaggcaggagaatggcgtgaacccgggaggcggagcttgcagtgagccgagatcgcgccactgcactccagcctgggcgacagagcaagactctgcctcaaaaaacaaaacaaaacaaaaaaaagagaagcaaatgacaagtttccaatacttgcaccatctagaaataatgactgttgacttcttaatgtaaatcctcccagaattcacttccccttatttagctatacttataagcatatactagatacatagaacattgagatatcctatgcaaacttttgtaagctgattttgattgccttgtttaaaaatatcatttagatattttgaaatataagtggcatatcttctgggtagaaaaattagagaatatggacaaacaaaaataaaataactttttttaaataatttttttttttgaaacagagtcactctatcacccaggctggagtacagtagcatgatcttggctcactgcacctccacctcctgggttcaagcgattttcatgcctcagtctcctgagtagctgggattacaagtgcatgcaaccacgcccagctaatttctgtatttttagtagagacggggtttctccatgttgtccaggctgggattgaactcctggtctcaagcaatctgcctgcctcggcctcccaaagtgctgggattacaggtgtgagccaccacacctgatctaaaataacttataattggctggggttaatagtaagacttttaagaagccagattaagggcagggttgagatagaggaagaataatttgtcagagctcctcttatgataccctgtagtccctctttgcagtgctttgcacatttgtaattttacattaattactcaaagtggcttatttaaaataattttattctctaagtgttgctttccttaaaagaaataagaaaaaaaacccagaaaaaaagtgacctaaaataattttattctgaactatttcaggcacacaaaaaactataaagaccagtacagtgaacaaccatttacccgtcactcagtttaaaaaatataacaaagacaatcaagtccttctgtggacccctcttaatctcgtgctcctttctctcttccttccttcccaatgggatctctatcctgcagttgtgtcttatatttcatgcctattttgtattcttattgaatatatgttatccattatcaacatataacattatgttgcatatttaaacactttaagtagactaccactgtatgtattgttctcatggcttgctttttggttcattgttatgattttgcaatttatttttatttttatttatttatttatttttgagacagagtttcattcactcttgttgcccaggctggagtgcaatggtgtgatttcagctcactgcaacctccgcctcccaggttcaagtgattctcctgcctcaacctcctgagtagctgggattacaggcaggcgccaccatgcccagctaattttgtatttttggtagagatggggtttctccacgttggttaggctggtctcgaactcccgacctcaggtgacccgcccgccttggcctcccaaagtgctgggattacaggcgtgagccactgggcctggccgattttgcaaagtgttaatgttgatacaggttatgtttcatttattttctactattgttagtgttaatctgttagtactagcatccatggtagaactcaatcataattaatctatctattctgcagatggacatttaggttccttttttttttttttttttcttgagacagagtctcgctcttttgcccggctggagtgcaatggcgccatctcggctcactgcaaactccacctcctgggttcaggtgattctcgtgcctcagcctcctgagtagctgtgactacagcacccaccaccacacttggctaatttttgtatatttagtagagatggggttttgccatgctggccagggtggtcttgaacttctgacctctggtgatccgcccaccttggcctcccaaagtgctgggattacagtcgtgagccactgagcctggccgtctcccttcccttcctttcccttcccttcccttcccttcccttcccttcccttcccttcccttcccttccctcccctcccctcccctcccctcccctcccctccatctccctctcctccccttccttctttccttccttccttccttcctctttctctttctttttctctctttctttctctccctctttttctttttttcttctttcttttttttggagacagggtcttactttgtcacccaggctgaagtgcagtggtatgatcatggctcactgcagcctcgaccccccaggctcaagcgatcttcccacgccagccttcctgagtagctgggattataacaggcttgcaccgctatgcctggctaatatttgtattttttgtagagatggggtttcaccatattgtccaggctgggcttcaactcctgagctcaagcaatccacccaccttggcctcccaaactgctgggattataggcctgagccaccgcacctgacctgtttctatttttctattacaaacagtgctgtagtaaatattcctgtacaggccaggcacggtggctcatacctgtaatcccagcactttgggaggccgaggtgggcagatcacctgaggttgggagtttgagacagcctaatcaacatggagaaaccccatctctactaaaaatacaaaattagccaggtgtggtggcgcatgcctgtaatcccagctacttgggagactgaggcaggagaatctcttgaacctgggaggtggaggttgcgataagctaagatcacaccactgcactccagcctgggcaacaagagcaaaacgccatctcagatatatatatattcctgtacatttctccttgtgcaaactgatagagcttctcctggtctagggtatgtacctaggagtggaattgctgggctgtgggggttatacttcttcaactttactcaatttcaccaagttgctctgcacaacagttgtaccaatttacactcttacctgcagtacatgagaattccagtttctccgacatttggttttgtcagactttttatctttgccagtttgatgtgtgtgaaatgcagtctgctggcacccagtgttcaatcctgaagagctggatgcataggtcttgttcaccatggttcccccagcactttgcgcagcacctgaaatatagtaggtattccatattttttggctgactaattgagcagcagttttctggctcctctcatgtaaaattccattacaatttgttggagaagccatttgttctgcagggagtcctgttttcatctcactcttcccaattcaaaaccaggaaaccgggccaggcgcagtggctcactcctgtaatctcagcactttgggaggccaaggcaggtggatcacgaggtcaggagttcaagaccagcctggccaatatggtgaaaacccatctctactaaaaatacaaaaattagccgggtgtggtggcatgcgcctgtagtcccagctacttgggaggcagagacaggagaatcacttgaacctgggaggcagaggttgctgtgagctgagatcgccccactacattccagcctgggtgacagagcaagactccagctcaaatcaaccaaccaaccaggaaaccactcagggactaagcagagaaaacagcttttgattgccctgtttgcctttttgttagaactgcagttctcaaaactttcccatacctcagaaccacgtggagggcgtgttaaaatgcaaatcgctgggatccatccccccagaatttcttgttcaggaggtcgagggtaaggtctagggatctgcttttttttttttttttttttttttttttttttttgagacagggtcttgctctgtcacccaggctggagtgcagtggtgcaatctcggctcactgcatcctcgacctcttgggctcaagccatcctccccactcagcctccctagtagctgggactacaggcatgtgccaccacgcctagctaatttttgtattttttgtagagatgagtctctctatgttgcccaggctggtctcaaactcctgggctcaagcaatccacctgccttggcctctcaaagtgttgggattacaggcatgagccaccatgtccaaaataagatttgcgtgtgtaataagtacctgggtgattctgatgctggtgctgctggtctgggaactacactttgagaaccaccggatctgaggaacattcaatccagacattttggatatgatcaatgtggagtgtccttaaagagactgaatgcaaaacttgaaaagccactcccaaagtgtagagtggagggaagaatataacatctaactccacttagccggagtaggaaaaggagaagtctggaatgtttaagacagttggcagcatttatagagactgatataattcagtaagaatatattgggcaccaactgggttgtttccttccttcttctcttctcttctcttctcttctcttctcttctcttctcttctcttctcttctcttctcttctcttctcttctcttctctctctctttctttctctctctttctcccttcccttccctgcccttccctcccctcccctccccttcctttcctttccttccttcctttccttctctcctcccctcccctcccctccccttcccttccttttttttttgacagagtctctctcttgtcacccaggccggagtgcagtagtgcaatcttggctcattgcaacctctgcctcccgggttcaagcgattctcgtgcctcagcctcctgagtagctgagactacaggtgtgtgccaccacacccagttaattttaatttttattttttgtatttttagtatagatggggttttgttatgttggccaggctggtctcaaactcctggcctcaagcaatccacctgcctcggcctcccaaagtgctgggactacaggtgtgagccatcatgtccggccctgactgggttgtttccatctgctcgcaagtcttctacgtgctttcaagccaggatctttttttccattgatacttactcctgagatcaccgcaatcttctcttcttcctctacctcctccccttctcccccccccccctcctctcctcctcctcctccttcttcttctttttcctcttcttccatgaattaaattcagatgtggacttggctatgtgttgaaactataataaagatagctagcatttattgaggtcttggttgccaaatgcttttgttagtgttatctcacttcatcctccctcagacttcaggagataggtaccatagttacatccactttgtggatgaagtttagaggttacacagcaggtaaataacaaagctggggctgcaacccaggtcaccccaattccaatgtcttgttctttactgaaactatgtaccatacatctgtgattcttagcttccttattaattaattcaccaaatgttttctgagcacctcctaggtgctaggccctttgctgctgatatgggcaaatgagacagacaaaattcctggtagcacgacaatatgttttggccctgtgtccccacccgagtcttatctcaaattggaatccccataatccctaagtatggagggagggaccaagtggaggtcattgaatcatgggggcagtttccctcatgctgttctcgtgatactgattgagtgctcatgaaatgtgatgatattatagggcagtttccctgctcctgctcattctctctggcctgccaccatgtaagatgtgcctacttccccttcccccatgattgtaagtttcctgaggcctccccagccatgcagaactgtgagtcaattaaacttctttcctttataaattacacagtcttgaggctttctttccttttttctattttgtgagacagagtcttgctctgttgcccagactggagtgcagcggcatggtctcagctcactgcagcctctgcctcccaggttcaagcaattctcctgcctcagcctcccgaatagctggtattacaggcatgtgccaccacacctgggtaatttttctgtatctttagtagagaggggtttttgctatgttggccagtctggtgtcgtactcctgtaatcccagcactttgggaggcttgaggaaagtggatcacttgagtatttctttatagcagtgtgagtcatctcctattactgtttttttttttttttttttcaaaaagatgggatcttgctgtcacccaggttggagtgcagtggcttgatcatagctcactgcagtcttgaccttccaggctcaagcattctcccacctcaacctcccaagtatctgggacaacaagtgtgtgcaatcatacccgcctaattatttgtttattttttgtagagatgaagtcttgctatgttgcccaggctgttgtagaactcctggactcaagcaattctctcacctcagcctcccaaagtgctgggattataggcatgagccactgcgctggccacaatctcctattactctcatctatagaaggaaatgagactatccctctttgagggttgctgtgaggtttagggaaatgtgctcttggtacccagtagatgctcaataagcattacgctaggtatatagtaggtgctcaataagtgttgtgcttggtatatagttagtaggtgctcaataagtgttggctcctgatttccttcactcccaggagctggtaactctctatttgtgtacgtgggggagaatgaagccaattccaagagactacgatgttctcctagaaaaaggcattgcaccatctttaacatttgtgcagcccaccctctattagctcatctgagcaaatgcttattttcctggtctctggggacaagacttaggctcttttcatttgcctcctcaccctctccccatctccctattctagccagtatcacagaatatgcaacatcttgacaaaccaaaggcactgggcaatgctttaggaaactgtgcaatttagagagatgaacaatgaagaaatatcagctctaggcagcttgtgtgatggaaaataggagaagataagataaatgtgcagcttagaagggagagttctcacaggtaatgagagaaaatcaggagccaacatctatttagaggtattttccttcaagcatctggagcttttgaagaacctggataggagaaatctacattttaggagtgtaggctattttgtaatttccatctttgaaggcttcaactccatctttgctgtctgtgtgctagttatttctttttcaggctcaattttaataatttccttttttttcttttctcccaggaagagggtttaactctgcaacataatcagtgcacagaa

SEQ ID NO: 1180 - DNA, 1758508 bp, Homo sapiens
gatacgcaactatgtcctaggggccgtctttcttctaggtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtaagctctcttgtgcgtttccctacagtgtcctctgttttgtggggacaggacccgccaaactgaagtatattaattattttaggtctggagagaaaatcactgttacaccgtcatctaaagagctgctcttttatcccccttcaatggaagccgttgtcagtggaggtaaatgtcaactcagcgagcgaatgtcacacacacctttgcagttgttcccttgcctgcatttacaagtagatttgtgatgttatagtgaagccatctttgtaagccaccttacatcctctctggcacacagatgttactgttggttggatggatggatggatggatggatggttgggttggatggatggatggatggatggatggatggatggatggatgaatgaatgaatgatttagataaataaaagtaacttttgctgttagaattgagttgatctttttggaaaaggacttggttttctttgacattatcaggtcgacaccagaaggtagatgaagcacaaagctgccagtgatgatctttaatgatctttctgttgttcggcagagcatgatgggagggtctttttttggggaatggatgactgaagtgatcacttgtggagtatttgtcttttgccacttattatttttttcccagcactctggcttcgttaagttgtgggtgttatgtggttcgtgtttggaagcagagggtgttgaagagcgtgacttctagcaggcaggctgtttggggcggtctttctcagtgggtcctccagaggctgagcagcacggcctcctgtctgctgtaaagtgttccctcctgatctgtggcctcctgagaacctaggaagactagtagtaaaaacccagccttcagcgttttttgattctcttgctaaagtccttcacactgagaaaggcctttcagggatggaaagaggcttgggctgtatccgattattgagctccccggggtgttaaataaccgcatttggaactagcttctaagatctgttttagccacttttgtcatgggaaacccccaaccaagaagctcctgtctctgctaccaagccccatccttgtgtttatttcttcccctcttagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacaggtgagcccgggatagagacacatgtgcctgggatcagcgtgggagtcctctgaagaaactggggcccacatttccttgggcttggtaaggcttcctgcagggtgtgaacaaagccgttgctagcattctgctctctcctcttcagtgttggccccctgcacagtgacctggagtacacggtgacctcacagaaggagggctatgttctgactgcggtggaaggaaccatcggagacttcaaggcctatgccctggcaggcgtaagctttgaggtaactaacactgtattttcaaaaggcagttatactgaggtataattaacatataataaactgcacaaaaagggtacagtgtggtagtcttgacctaggaatacacccatgaaaacacctccacaattaaaatagcacatctgtggccctcaaggtttcctcttgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacgggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaagattggtaagaaaaagacaacccgctagaaaaaaaatgaacaaagattatgaaaaggaaattcatgcaagtaacgcaggtgactaataaacacagaaacacaaagcctctgtagttactgaggaaatgtgctaaggaagttacagtcgaaacactgttttgcagggattagatttgctgtaattaagacaatctctattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaaattaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagaactgtacatataacatgccatttttatttcacctcctccacccactcaatgaacttgccagtctgtgaacaataatatgtaatgtttataaaatttgtgtgggcatagaaagagttctgggcggggcacggtggctcatgcctctaatcccagcactttgggaggcccaggcatgtggattgcttgagcccagtagtttgagatcagcctgggcaacgtggcaagacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagcggtggcctgtttcgttccaacctcttgacccaggacaacggcattctgacattctcaaacctggtaacgtgttctgcaatttaccacctgcctgtcttccctgagagagagccaggatgcagcatgcgagacttacgtgttgcttgacaacgtgagaagagaaagccaatgtggagtggtttcagtttcttgggggcccacggtcattagagtattgctcttactcgaacttaatgctgctgattcatgttcccttccacacgcgcttcttgttttctgatcacccacttgtcactaagacagtgtaattaatttccctggccacaacggctgctctcttaggcatcttctcgttttgccacggaatcatgcttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagcgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaaaagaaaagaaaaattaaatatgacttctacctctctgagtcattgcaggcaggtgataccatcagctgccgttgttagagttgtgattgccactacctgactgtgagtggtgattatagagagagggttactatttctggctgccagggaagccatggcgctcccctggtgtaattctggtccatcgtgacattcgcccctcacttttaagccatgcctagatgtggctgctgaggctcagtgtgattatcttggtagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagcctattgagttgctaaaagcttttatttattttttattttttgagacggggtttcattcttcttgcccaggctggagtacaatggcgcagccttggctcactgcaacctctgcctcctgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtctcccaaagtgttgggattacaggcgtgagccaccgcgcctggccacttttattttttaaaagagtttcaaacctgaattaaattattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaataaaaatacaaaataaaaaagatacacatctatagatagagagatgcatacatatatacatgtatacacacagatacacacatatatgtgtattttttgtagacttatacagaatcactttagaggaagagtaattggaaagattgggtttagaaaaatggaccattttctactgaatatatggagtgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttggaagtgggccggccacactgagttgcctgggtcattgaggcacagttatcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgggttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtgtgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggggaagacagagtcagggttgccagatccttgaaattttaaaaagagaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagagctgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctgatcagaagtcctcccgtctcctctggctgtctgcctttcatctgtggcggggggaactttcatcctaattaagggtcctcttagaatagtgtcatcttcacaagcagcatcttatgtgggtttttaatgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagaacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaaggcttttctcttactgagtaactctcattgggaagactagagggcttaggtagggtaagaggggctgcctcttagtggctttatttaggtggcttcattatgcatgaagattgtgagggaggatagaacttttgacctaggaagtggattttcttttctttttctttttttttttttttgagacggagtctcaccctgtcacgcaggatggagtgcagtgccgtgatctcggctcactgcaacctcctccttgtgggttcaagtgattttcccacctcagcctgtagctgggactacaggcacacaccatcacacccggctaatttttgtatttttagtagagacggggtttcaccatgttggccagattggtcttgaactcctgacctcaggtgatctgctcgcttcggcctcccaaagtgctgggattacaggcatgagccaccgcactgggccggaagtggatttccttgacgtctttacggtgttggcattttaaatggctgggatgactgcatctcacaccaaaatgctttgcatgttctcggtgtagtaacttaggccaggatcactagcataatgtggactgtggccgggcaggtatgaaagggaagggggccggccctctgggatctcgcaaactccatgtacagacctcacgcagagggggtgctgtgactctgcccctgctctaacaggcaagagcatccttctccttttttttttaagagaagctggaaaatctggcttcatatatgaaatttcttaatttttaacatgttggcaagtaattcaaacgtagaaaaaaaatactgtgctttcgaaatgaaatgtgtctatgggccagggacatgcccctgctctaacaggcaagagcatccttctccttttttttttaagagaagctggaaaatctggcttcatatatgaaatttcctaatttttaacatgttggcaagtaattcaaacgtagaaaaaaaatactgtgctttcgaaatgaaatgtgtctatgggccagggatagccatcttctgtcagtttgtgaccttggacgtagggtactcaatgacaaacttcgcttccttaatgtaagaagcaaagtttgccatgaagcagctctcaggccatcggacagctggcatagaagttcctccaccagctttctcattactggtattccctctttctctctctaggttgggaataatgacatcgatgatgtaaacatcatagttttccggcagattaatcaatttgatttaagtggaaatgtgatcacttcctctgaataccttcctacattatgggtaagtccagacttttaagctccaagtattgtgttccctttggctttgagacaagtacgaatgggatgtttttgggtttgtgcctgtctcgtgccttaggtgtgacaggtggaggtgctccagagcgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattttaaagaaagcgccttgtaacttaaaattttctctggagtggaggtcgtattaaatgttcttgcattggtttaaagaaatgcctgaggctagataatttataacaaaagaggtttcattggctcctcgttctgtaggttgtacaggaagcatagtggtgtctgcttctggggaggcctcaggaggcttccaatcatggcagaaggtgaagtgggagcaggcatgtcatgtgggagaagctggagcaaaagagagagttggggcatggtgccacacacttttaaatgatcagatctcacaggactcataacgaagacagcaccaagccacgagggatccaccccaaagatccgatcatctcccaccaggccctacctccggcacgggggattacaattcaacatgagatttgggcagggacaaatatccaaacagtatcagaggtggtggacggtgggctggagagcaggtggtctgggctttctcttgtctccagtagtgactcaccttgctgcctgggccagtcacttcatttccacatgcctcgacttcgtcctctgcaaaacctagattttggactcagagacctcttataatcttgttcagctctaacaaaatctccatgttaccattaatgaagaaatgtttataaaataccctgcagaccctctacggatgttagtgatttgctctgggggtacattgttaagatgcacttgtaattttataagcagttaagtatttggcatgggtgagaaagtgtgtgtgcgctttagtccactctgttcagggcttgcaggcgtgtgcttgtagggaccaggcaggtaatgtcagagagtgcagagggttgggtagggtggggggcaaactggggaactcctgccccatccatgagtggcacaggggaggggaagaggcagagaggaggggagggcgccactctcttgctcctgagtgttgctgtgctagaattgaggctcagggttggtgtcacttcccagttttccggagaagctggaaattagaattatttgaaatcacctgatttttaaatatagtcggtgaattcagatttacttaagatgttatagaagaaaaaagaacacataagggatcttcaatgcgacccataaccttcagtctgtgactttcattttaggaaaattccccttgtgtgttatgtagaaaggtgccagtgtgggcccagggaggtggtcctggcattctcttgcggcaggtgcactgtggcatcctcacagcctttgccatcagccagggctgcaccttaaccctgctcatgccccatgccgtgtgggagtgagaacaggcaagaaccccagaaataaagccagaaacaaagtactccagtgcctcctgaagcagcgtggagagccacgtacatgatggaatgcgttttgagtttaacagattggtggagttaaggtgacatcatatgatgaggcagtgcaaggcgggaaggaccctcaggagtcgtcagggggttgagtcccaggctctaccatgtgtaagttgtgtgaccttaggtgactttggctctctgggtctccatagggataataacaatacctgttttgtagtcaggattggcgataatgtagataaaatatctggcgcctgcctggcatattacagatgttcaacacgtgttagaagctatttttaatattactattatattaacttatattactattttgagcaagaacatgggtagtcagaatctgatttgaatcttaatttctgtgcatgatacataactggatggagtctcagatgacagagggatgtgtgatgtctatggagggagctttctttttcaaatatccatgtttccaaagacacccacccagaaagcggctgtcctgaggatgtctgctatgaaatattgattgtgtttcagtttcaaagcatgtctgactttgtttctccctccaggtcaagctttacaaaagcgaaaacctcgacaatccaatccagacagtttcccttggccagtccctgttcttccatttccccccactgctcagagacggcgaggtaatgcctgtggccggattctaccttctgcctttgttttaataattctgctgtttagtttaaggaagcacagttctctccttttctccctaaataccactctgcagaaatacgctctctgaatcaaaagaggttgggttctgtagggattattttttcttcattgtttttctgtttacaaaaagaatacatattcatggcaggagattttgggaaaaagaagacataagcccatcatccagaaatagccactgctaacacggtgattggtatcctttgggtcttttttcaggcacgtgtgcgcatgcatgtataaatataaatagacatttattttaataattcaaaactgacactgttttgtacattgttttgtaatccgtgcttttcaatgaagaatttatcacaaatctgttcctcatcatcaaatctttcttttttttttttttgagacggagtctcgccttgtcgcccaggctggagtgcagtggcgcaatctgggctcactgcaagctccgcctcctgggttcacaccattctcctgcctcagcctccgaagtagctgggactacaggcgtgtgccaccacacccggctaattcttttttttttttatttttagtagagacggggtttcaccatgttagccaggatggtcttgatctcctgacctcgtgatccacctgcctcggcctcccaaagtgctgagattacaggcgtgagcccccgtgcctggccaaatctttcatactatgatttttatggacagtagtccataaactaggaaacgccatgatttatttaaccaaggcctactgttgggcatgatcgactcttgcactttgaacatatcaccccatgctttcctgctaagaagtccacttttaaaaatgccttgtaatttttaaaaattcctctatttaacattctgctattgagtttaaggaaatacagtttcctcatgatgggggatcccttgaatgagatgagttgcttttctcttgctgctttgaacgttctctctgtctttgataatctgattataacgtgtgtcgtgtagaacacttgcagctccaccttttcagtgtcctttgggttccatgaatctggatgtctccctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcaaaataatgaaacaggctgtcacggaattttctcctcctctttctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgatgggtctcatgcaatgtgcatggtgcctggcagctggtcggtgctcagcacacagagctgtggctgcccctggtgccgttccagggatgctgtatttttaggatttgccagcttacgagcctctcaagcatcgtccctttgaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttgtaaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaacccatgggctgggtttggtggctcacgcctgtaatcccagcactttgggaggccaaggctggtggatctcttgagcccaggagtttcagaccagcctaggcaatacggtaaaaccccaactctacaaaaaatacaaaaattaaccgggcgtggtggaacgcacctatagtcccggctactcgggaggctgaggtgggaggatcacttgagcctgggaggttgaggcctcgatgagccatgatcatgcccctgcactccagcttgggtaacagagtgagaccctttctccagaagaaaaaaaacaaaacaaaacaaaaccaaacaatccatggggtggcgaaagaaggcatgtccatacaacctgtgctccagatcgcaggttgcagggcagatatttaaagggctcctggcattgggtcactttctcattctgccttctggattctgggcttccccagattgtttttagcttttctgagcactgatgcctgcgattccctttgaggaggaaactggtaataagagcagtgtaattgtttagatcggtggctcaggaatgattttgggggaggagggacaccactatcgctggtgtggcgtgtgcttctccatgagggagcacatggtacatggccacgcaaacctctagaaccaactgctactttacaggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttgttgcttctaggccttttcagtgggcagaataagaactttattgttttcaaaaaatgtaactgtaagtggaacaatatcctccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgagggcttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatacggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcagtgtacttctaattgcatttctctcttttcatgtggttaagagccatttgtattttctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctatgttaaatgtgttgatttttttcttattgcttctggattttagagtcataggaaggttttcttcattcccagcttttacaggaatttattgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattccgggcttctgtgaagagtgattcatgctcagtgagcctgtaaatatgatcttacctgaacaagagagtttttctcatgacccacgaggaaacacttccttgttactcacagtagagacctggttagaaagtgccggagagggctaggtgtggtggctcacgcctgtaatcccagcattttaggaggctgaggtgggcagatcatttgaggtcaggagttcgagaccagcctgggcaatgtggtgaaagtgaaaccccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtttcaaaaaaaaaaaagaaagtgccagaaagataagcatatacaagaaccacttacctttgcttggggctgcactgtggccccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccaagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataattaaaaaaaaaaaaaaaaaaagctatgcctgctggggcttggattcccgagcagggccaagtgttgaatgaagagagcgcccactctgtgccaccccgtacagggccctcacaggttgatcctcacaacaagccttcgagcaggtgtgccattcctcccattttcacagaagcccagaaagattgagtcacttactgagtgttagcagaaccaggactcaagtgaggcggtttgtctcaagccacatggtttccacctcgttctgccctccgcgtgatgagtggctcagctttgcacgttcacgggggctttgtaagcacattggtttccttctttgttgatgtgactgcccacagcctcgcgactggattttactcagtattccatgccctgctgagcatttcacatactcctttcatcaagtttcacagcatccacccccagtgggtgttgttcatatgatctccatgtcatagttgagtaaactgagtctcaacgtggttgcctgagtttacccagtgaggcctgggacctgagcctagactgaatcactctaattcctgctgaattaaacttttatttatttattcattattatttttttctgagacagagtcttgctttgttgcccctgctggagtgcagtggcacgatcttggcccactgcaacctctgcttcccgggttcaagtgattctcacctcctgagtagctggaattacaggcatgcaccaccacttctggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccaaagatacaggagtaggcagttgttgatggaaatctgttcctgcccttattctttcatttatgaaagggcatcccaggtacagcggcgcccacagtcactctctagcccagcagttctcggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgcgcttgcgaatgaaagagggcggaaaaggcacatcacatcttactattggctgaaaatagctgtggcctcgggaacctctgcgagaggagtcccggtatcctacactgagaacactgctctggctcattaacttgtttttatcattattgggaagttctccttccatttatttgcttcctttatgagagtagagtgggccaatgggatataggttcacttgatgctttagaacccagcatttcaggggctttagcaagatggaaatgtctgtctcatgtcaagtgtccaggagtgaccagtgcagagatagtctggtagctccaaggcgtcaggggacccaggccccttctgtctcattgcgctgttccagtgcattgcttttctccaaaatggggcaattggccaaatgctgtctgcccagcaaaagggagggcacaccacttccctagggtccagccagggtgtggcacttaccgcttctgttcctgtaccattggccaaaatttagttccagggctgcgcctgctgcaggggaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatatatccaaatcactttggttccttcctttggatagaaggaatttggatcatgagggcccctgggtgtcctcaagtggccactttggaaggctgggtgggtggtggctgtggcattgtggatgatggacaatcgtgtggccttggtgaggagtgatggggctctcggtgtttgcagaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttccgggtcgggagggcccgtgaaggcctcaagtccagacttaggtctcctttcaaggctgtaaacttctgtaacatctcctaatccttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctcatcatagatgtatttcttggatgacatgcgcgtaacccccgggggtcttcagttgagccaaatgtagagcaagtcagagtcctgagtgaagctggctggggcaggaaaaacacgagctcagccgacatggtccccagcagcttttggcgtcagtgatagagaaatcggagatagtggaggttgtggcaagttgaagtgtgcccaccacgtctaagggaagcttagggactcagctctggctcacccctgctgtgcagaaatgtgcgttcatttttctagagaagccagaaaaacaaagatttacgtgaaattttcccaattttaaatgttagccacaaatgcagtgtttttttaagaaaaccacacactttggccaaacaaaatgcctacgtcggccgggtgaggcttaaaggttgccggcttgcatcagagatccagaggaagtcacagcattttaacagctaaacttaatcctcacaggaagtcatcaagtgaattaagtgatattgaaggaggggacacatccatccatccgacatttattgagtgccacataggacaggcatgggtatgtgaggatgagtagggtagacaacactctacagcgagctggaagaggccagggaggccccgtctgccttgttcttcgtaccccaatgcttggcacttggtgggcattcagtaaggaatgaatgaacgcacgcacagaggaatgaatagatgggcacacagtgtgtgccctcacagcacatggcccatcactgggtagaaggcaagtcagtaagtagacaggggtaatgcagggagccgagggcctccaggtggaggaacatggaggaccacaggagcacagagcagagttctcatcccactggagagcttagggaactttctggatgtgatgcgtgagcagagtccaaaaggacaaaacggagagagggaaaacaaggtggaagttcttgttaggtgccactgccaccccagggggtcagcttgggggactccctggctcttgggggccaaccgcagagctgccctgttcccacctatcagctagcttggtgttggcaccgtggaaggaaagtgaacagtgttggagatctgggacagatgtgatattaatacagaatccatttcttggagtgttttccaactcttattccaagtggacacccagaaacatcccttttaaatgttaatggggtttttattgacggtataaaggttaagagcttgcgaaagatacaattgtcagtacactccttccagttccggaggccgccagtaagtggcagtctttccctgtcgctggctgcaggtcacccttggcctcggtggaacttgtgtgggtcattctcagtccatttgaaagttgggcctgttcggttgtgtataattttctgttcatcatttttctggcaatctcaggacagaagtcctctgatcctcctgtgagaagtaaacattaatgttattagattcttttttttttttttgagtttcgctcttgtggcccaggctggagtgcagtggcgtgatctcggctcactgcaacctctgcctcccggtttcaagcgatttcctgcctcagcctcccgagtagctgggattacaggtgcccaccaccacgctcgcctaattttttgtatttttagtagatacggggtttcaccatgttgtccaggctggtcttgaactccctacctcaggtgattcatcaaccttggcctcccaaagtgctgggattacaggcgtgagccaccgcacccgggctgttattagacttggaatgggacaaaagtcatatgagacagacttgtttgctgaggtatttaaaaaacaaaatggtctaagatggcagattcttggggaactctgctctgtgcacatttctgcctattaaagtggccgtaaaaacaaccataaatccttgatgaggacacctcaggagctttaggacagtgccattcttttttaattaaaagctttttatttgatttgatttttctgtagagacagggtctcggctatgttgaccaggctggtcttgaactcttggccttaagtgatccttctgcctcaacctcccaaagtgctgagattataggcatgagtcaccacacctggccagggcagtgccattctaaggcaacggcttcacctcggtcttcttttctggggttacaggagatgggaagggccgaaggtagcatgagaatgtgtgtgtgtgtgtgtttgtgtgtgtgtgtgtgtgtgtgtatgtgcatgtgtatgtggaaggactggtgagatggctggaggaagaggcagtccttctgcttaactctaatggcctaaatgtgagaaacaaagattcaggaaataaggaaaaagcaaatgagtgattgcctctctggatcaagcacaccagcaggcacaaccagcctttcttgagctactgtgtgccgggcgctgtgccgtgcccttgcatgcatgtggatgcttcatgagttcatgaagtaggtatgcttccagccccatttttcagagaaagaaactgaggctgaacaatcttgcagctgtcaagtggcagagcaggggtttgaacccaggtccaagagttcttaaccaccatgttttcctgcccttgatgtatgaaatgagatgatgtagtcacatgccagcttgtctagggatgactcagaggtttagagatggatgtcacgtggatgttgtacaggagaggcaggtataagctgtagtaaagttaggaaaggcacagtgacgtggagcactgtgtgcagtggacggggtcatggctgggggtgagaatggtggaggaccttcgattatttcatcagcgttgtttctgtaaccaaagagctgcatgaccaaaccctgagatctagttccttaataggaacaattattcggcacgattccctttacttaaaagcaggggccgtcctaagggaggagttggaaagagtttgggggataaggtttgcttggttgccttctgtttaggctgatgttcagtgggggtcaaaggctgtgtgtccagtccctggcatgtggcgggtgtttgtggtacacagccagcctcaggatggcccccagggatgcacactgcctttgtgtgtggtcccctcccacactgaatcaggctggctctgtgcgaccagtgggaagtggtggaagtgagtgatgatgtgtgacttctcgggctaggtcgtaacaggcattgcactttggctctcgggaagccaactgccttgcgtgagggtgctcaggcagcctcgtggggaggggtgaggcccctggcccccagcatgtacagcttgccaccacgtgagtgagccagcttggaagcgaatttccccgccccggtcaagccttctggtgagtgcagctgcagatgacatctgacttccaccactcaagagaccccaggtcagtgctgcccagctgagctcttcccaggttctttatgtcccccgaaaatgagctgttttaagtttagaaaacttaaaaacacagtgacaatgaagcacagatatgcattacatacagtcccaaatcagtaatgacttcaagctgtgtcctctctttccaagaaagacaaagcagagaacaaagttcaacctacagtgtcttcccaaattcttgacccacgggatctgtgaatatcttatacgactgaattaagcctctaagttttggggtaactcatgcaacattaggtaactggaatagtgctcaataaatgtctgtcacatgaatgggcagtgaccatggatgcatttctagttatgtattagttaaggctctcttggtttcaagtaacagaaatccaactccaactagcttgagcaaaatggggcattcctctggtcaagtaacggagaaatccaagagtctctggcttcatgcatagcgggacccagtctcaatttccacctcctggctctgcttcccttgatgccaactttcaggaatcagctttctgaaagaccactctgctagaaacagacaggcccatcctttcaaccaggtccaggactgtttgctcagtcactgctctcagaggcaggggcagaggcagatgccgggcacacatccacagaagtggagatggcaggaaactgagagtggagtgctggaaagctggcttttgcctatgggttctgcttctgacatcatccggcaatgtcaggctttacattgcccccatctgcagacccagcagaaggacagcttccatcccaccacatcaatatgccagtcctggggcgggggaaggacttatgggcaacctttgcagaatcactggggcctggccgcacatgagccatgcccacgcttatgtgacaggcggcccctgtgcctggggtgctgtattacccagaggaataagtgatcctgggtgggcaaaagcaacagaagagaagtgagctccacttccttccaaaacttgagaaggcctggtcaaaatcaccctccaggcccggtgtggtggctcatgcctgtaatcccagcactttgggaggttgagatgggcagatcatgaggtcaagagatcgagaccatcctggccaatatggtgaaaccccgtctctactaaaaatacaaaaattagctaggcgtggtggtgggcgcctgtagtcccagccactcgataggctgacaggagaatcacttgatccagggagtcggaggttgcagtgagccgagatcacaccattgcactctagcctggcgacagagtgagactaaaaaaaaaaaaaaagaaaaaagaaaaaaatcagcctccatttttggctttctctttcattagaaaaatgaacctgactttatgaccatgacaatgaaatgcctagagaagggagcactcattttccagtgggcctactgtgtgctggggtggcgagactcttcctgccctggaacttggtgaggtcaggagggaagatatgatatgactgccttcctctgtactttttcagtgggggcaggtgtttatgcttgatgatgcaatggtgagatcttggttggaatatgaacttttctttctttttttttttttagatgggttcttgttctgttccccaggctggagtacaatggcaccatcacagctcactgcagccttgatctcccagggtcaagggatcatcgtgcctcagcctgctgagtagctgggactacaggagtgcaccaccacacctggctaatttttttaaaaaaaatctttgtagagatgagctctcactaggttgcccaggctggtcttgaactcctgagctcaagcaatcctcccaccttgggctccctaagtgttgggattacaggcaagagtcaccacgcccagccaggatcacagacgtttaaattacactccttctgctgtgccttacagcagtagaaggggtgaaatttaaacgtctgtgatcctggggttgttgaagatgccacccatctacatattctttcagatgcacaatatttcactgtgtgaatgaaacagcagcccttcttacgtgtgcttttggaatttgaagattttgtaagataagatgaatgcattggaacaagtgatcctcaattctgtgcagtctgtgcctccggagactggcggctgcccctccctgtctagtcttgcaagagaggcagctggcaagaggacagaagccggcagctgctgcgttttcatcctgtttctgctcttggagctgagggggagaggtggctagcagccacccagtgatcaaacttgcagcctgcctctcttgcttccttttcacagactggagtgtgcctgggtatggagaaagaacattttgcttcttgcctctcagagtttcaagaacgcctcacctgagtggcatgcattcacggaatgagtaattattacagtggagaactcctcactgtgaattaattacacagatgatattcaagacttagactgggctagtgcaggggttagcaaactatggcccactgttcttgttttataaataaagtgttatgagcacacagccatgcccattcatttgcagattatggctgcttttgcctgacagtgccagatataagtagttgtggcaaagaccaggtagcctaaaaagcctaaaatacttgctatctgggtctttacagaagacattttgttgttgttgttgtttttgagatggggtctttctctgtcacccaggctggagtgcagtggtgtgatctcagctcactgcaacctccgcctcttgggttcaaatgattatcgtgcctcagcctccctagtagctgagattataggcgcctgccaccaagcctggctaatttttgcatttttagtagaaacagggctttaccatgttggccaggctggtctcaaaccccgacctcagatgatctgcctgcctcagcctcccaaagtgctgggattacaggtgtgagccaccgcgcctggcctataaaatgttttctaatctgttgtctagtgggtgctttgtaaagtttagttttagggggagcatcattaattcattcaacaagtattaactgagcatctcccctgtgctgggtgctgcttggcatactgggggtttagtggtgtgagagagaccgagcctcagctcttaggagcacagtgctgatggaggacgaaaggtaaacacacacattagaagttattggataatgccaggcgttacgaagaaaagaagcagaacaaggcaatgtgacagaggatgattggtatcatggaaggtctctctgaggaggcagcatctgagctgagacctgaggaggggaagggccagtttatgcaaagatctgggggaagagctgcccaggcagaggggaccataattgcaaaggcccccaggaggaaatgagctccctgagtttcaggaatagcaaagaggccagggtggccagagtcaagtgattgagaggaagagatgagaacgatggcagggaccgggtcatgtgggtgccctggaaaggagtttagattttattctaatggcaacagaaggcattggagggtttaagtagggaaaggggagtgatctgatgtatgtttttaaacaattgcttctttaaattttgaggagattggattattgggaagcaagaatgaatttagggagagaagcaaagaggacgttgtgttggtttaggcaaaagacagcaatggcttggattggggtgatggaagtaacagtggcaggaagtggtgagcttggggctatgcttcagagatagagcagaaaggtcttgctgatgtatttaatacaggaggtgagggaagggaggaatcaacgataagtgaatcgtttgtttctagctgaaccactgaaatgtgtaggtaaattgagacttctgttttggccatcatgagtttgagatgcttatcagacacccgagtctgcagcctgggtgagaaatcacggctggagatgagacgtggtgagctgggagtgtttttggatgacagatgaggccacgggattgaataataggtatccttatgaagactgagaaaaggagagggctgggggccaagccctgggacagtgcaaccttcagaggatgggggaggagggccctgcccaagagacagagaggaagtggccagtgaggtagggggaagtccaggagaggacagtgtggtgaatacctaatgctttactcattcactggtgaatgaatggatggatggatggatggatggatggatgaatgcatgaatattccttaataatatggttggccatggtccatccatatgactcctacggacaccatgttaccatttcacactcgtcttctatttaggagaaatcagacgaaactgccatcttatatataggtcaaaaatggtttccataaccacccacctcacatgcttactgaaattcattaagtaatagatggggtggggggcgggaggtttacaggtcggcaaaggaggcaaggctagagtgatccatgtggcagtggattagagtggcaggcatcagtatgaacacatgtttagctcaatatagatacagatggctacatagagaaatatttatggatatgtgcatatacacaaattagtaagacacacgttactaatcctggctgtcagcgaagagagcctagaagcaaggataccccagtagcaacaaacctctggtgcccaggtctctgttctccaataaacaccattctccagtaaaaggaaccaggcttcttgaacaaatgtcgatcctaggaccgagggaggaaatagataagaagaacctgaagcatcttgtagggtcacagggtgaggaggcgcgaaatgaaacaaaatgaaactgctgcagtgatggggcatctcagagggacacaggagccaatggaaaagctcccaggggtcaaagccagaacaatttgagccccaaaaaagtactattggattagaattcaaagaataaatacccatgattccatactgctataaatgatcagataagagagaagagacaaatctcccaggcagaagaattccagattatttatttatttatttttatttaatttttttttttacacagggtcttgctctgttgcccaggttggagtgcagtgatgtaatcttggcttactgcaacctccacctcccaggttcaagcgattcttgtgcctcagcctcccgagtagctgggatcacaggcatgcgctgccacactcggctaattttttgtatttttagtagaggcggggtttcaccatgttgaccaggttggtctcaaactcctgacctcaagtgatcaccctcctcggcctcccattcaagtgctgggatgacaggtgtgagccaccgtgcccggccccaggtaaattatatagctattccatcgtcaaggaggtggagcggacttcccacatcctaagtgtgggctgtgcatagtgactctcttccaaagagtacagtgtgaaaagagaggagagagtaactttacagtggagaacacggacagacactacctcagccaggtgatcaaagtcaacttcaatagcggcaagtcatcttgagagaatgcgtgcctgatacagagtgctgagaatgattcttaagctctgtggtcctcctcctcaaaacacacacaagccaagactaaggatgagaagcatctgccaaatcccagttgaggaacattctacaaaatacctggccagcactcctcaaaatgctccatgtggtatcctggaacagaaaaaggacattaagcaaaaactaaggcaatcagaatcaactatggactttaggtggccaggcacggtggctcgcgcctgtaaccctagcactttgtgaggccgaggccggcggatgggttgagcccaggagttcaagaccagcctgggcgacatggcgaaaccccatctctacaaaaaatacaaaaaattagccaggcttgtggtgtgcacctgtagtcctagctactcgggaggctgagatgggaggatcacttgagtccgggaagtcaaggctgcaagtgacccgtgattgtgccactgtataccagcatgggcaatgagagtgagaccctgtctcaacaaacaaacaacaaacaaacaaacaaaaacaaattctctggggatggtagcaggcacctgtatttccagctacttgggaggctgagatggaggatcgcttgagccaggggaggtggagggttgaggctgccatgaactatgatcacaccaccacactccagcctaggtgacgagcaagaccctgtccccacccccctaaaaaaagtatggactttagttcataatgcatcaagctatggggtacatggaaactctctgtactgctttcaccatttttctaaaactgttctaaaataaaaaatttacttaaacatttatttaaaaaaaaaaacaaaccatttgagtaccaacagtgtcatatgctcaacttagcacatctttttcctggtttggtttgtgggcgtgaatgtgtactgagccatctaaaccttggttgcccgaccttcaccgtagccactgacccaggttaacagacaaaaggcccaggttaaggttatgcccagtggccataaaatagcccagcatccagactgcactccttgatgtacccaaaaaagccaaggaataggacggatgggcggggagtggggggcaaactactgcccattgcccaactctggccagctgtctgttttataaataaagttttattggaacacagtcacacccattcatttattatcatctatggctacatttgcatgacaatggcagtgttgagtagttgcaccagagatcgtgtggcccacaaaatatttattatctagcactttacagaaaaagcttgtcaacctccaggacagtggccacaagttctgccatcatctcatcccttagcaagaagggaaaggaatgcccattaaggcacaaattgttttctgttgttgtttgtttgtttgtttgtttttgagacggagtttcagtcttgtcgcccaggctggagtgcaatggcgtgatcttggctcactgcaacctccgcctcccaggttcaagcgattctcctgcctcaacctcccgagtagctaggattacaggcgccagccaccacatccagcaaatttttgtatttttagtagcgacggggtttcactatgttgaccaggctggtctcgaactcctgaccgcaggtgatccacctgctttggcctcccaaagcgctgggattacaggtgtgagccaccgtgcctggccacaaggtggtcttttaacaacagagcacacagctggacaaagcccaacgctctcttctttggggccgaggtgggtcattaatattgaacatttacaatgtacttgctccaggtgattcagtttaatttctgccgtctcttgtaacagggctcccacgtgcacgggttggggccgtgtgtctgcctctgctttctgaggccccacagcgtattgattctgcgaaacgtacgtttctttgaaaacagcgtctcttgacatgacaggagatcacacatcgcttgttttctgtccctttcattgccctctgaacatgataaaatcatgacctagtgtcaccgagggacctcagcatctcttggaaagaaggacttgccttcttttttatctttgtcaagccagtgaggccaagtagaaaatttttagcagctttggagccagacagatcggagtgcgagttctgcccgttattgactggaccgtgtgaccctgggagagccgcctagtgtctatgagacggaggctgttgggcaagaaaatggggatggtcccagcattatggggcggttgtgagaattcagtgcaatgatgcagtgctcccagaacagctggtctagggcttggctcatgggactgtcccttcgcagaggcagcgtggacattccgctggtatccactggtgtggctgtgcctgtttggtcaccgtgtctgttctgattggtcggtgctcctgcatgtcaagagttcaatgttatgaaaatcatccctgcctagagatgaattcccccttcccctgaggtctagactggtatagctgcttttggagcctcacctgctgagagctcacagctgtccttctctagagaatcaccctcagatgggagccacattgcctgggatgggatgccatgcccagtaatggcccagtgactaactgatacagcaacgtgaatggctggtccctgccccacggtggggacgatcctgtggcgtgctctctgctgctcgtgggataggtcaaggcgggactttaagggaccacattctcactctgctctgtccccttctgcatcctgtagtcctcacctcccttctcctgaaagcccctttcaaaacaaaaacaaaaaccacatccacccaagtccctgtctccagctctgcctccaggaaagccggcggaaggccgccagtctcagctgtgacagatacagatatttctgcatttccaggactgaggtcaatccctggggacccagtgaggcggtatctgaagggccatggagctggcttgatggggtctacaggtaggcagggacctggtggggatgtgactcaaggatttttatcaaatatctttatcccctgacagatgcaaaaaaaaaaaaatgagatcagactccagggtttcctccatgccacactgtggccccattgtttgttgtgctatcagcagaagttgattttgcaaggaatgtacacgtgtatgtgatgtttgaatgcacctatctgtgtgtgcgtgcatttgtgtgtgtgtgtgtgcattcgcttgtgtgtgtgtgtgtgtgtgtgtgtgtgtgtgtgtgtgtgtgtgtgctgaggatgtgagccccacttccggcccagtgcccctgcccaggctggctctgccctcctgctgctctgggcccctcaggcagtgactacctggtacatagggaaggcatcagcatcccttattcatggggactgtatactgtctccaccatattgggccttttggcctcttggacatgacttggcctctgctggctttaagggactgccagagatgccatcttctctgggaaatgttctcagcctgggcacagcccactaaccactgcctgcttgtctgagacttctctgtccaggaaaacagcccagcctgaccagagatgggcatagagccatattttgggaaagactggttgggggtcaacttggtttctggaaccagttctgatttcagttgcaggggacagtgagccagttactgcccactggctgcatcctaagccttcctagaggagagctagcctcctcctagggttgcccaggctggaccacttctgcctgggtgatgggttgggagaaagacgttaatatttggagcagtgttatattagtcagccctcccatttgcaaacattagaaaaccagctcaaattagtgataaaagaaaatctcagctgaattaaatttaaagtagtttaattgagcaatgaatgattcgcgaattgggcagaccccagaatcacagcagattcatagagactccagcgcagccacgtggtggaagaagatttatggacaaaagaagggaaatgatgtacagaaatcagaagtgaagtacagaatggctggattgttacaagttggcgtttgccttatttgagtacagtttgaacactcagcagcgtatgagcggttgaactacggcctctgggattggccaagactcagctattgttacaggcgcatactcctaagttaggttttcaatcttgtctacctattaagctaggttgcaatttgtccacaaggactcaactatagaagtacgaagtcccactcaggccatatttagttcactttaacactagcttcggcaactgtctctcagagcccagggcagggcagggatgcaactgggcttcaggaaacttgaattcattgactgtctcttccccatcttagatgcagtgctaagggctttttagtaattttctcatttgactctcaaaacaaactgatgaggaaacggtctgagagtagttaggcagcttttcaaggtcacacagatagtaaatgtcatcactgggacttgaactcaggtctttctgactctcatgtctgtgcaacatgtcatctcagccactgttgacactgtatatgtggattagggttggctaaactgctgtaacaaatagacccaactcgaatggtgcatgtatgtacaataggggtttatttcttatgatatagttcacggtggtcccaggtgaataaggatgggtaggtctgcatttttcataatcatctgggtttctgctcaggctcctagagtctctgccaccttccccatgtggcttccaaggccaccttggagacagagcttggtggagcacatgtggtaggattttttttgtttttttgagacggagtctcactgtattgcccagtctggagtgcagtggtgcaatctcggctcactgcaacctctgcctcccaggttcaagctattctcctgtctcagcctccctagtagctgggactacaggcacctgccaccacgcctggctaatttttgtatttttagtagaaatgggatttcaccttgttggtcaggttggtctcaaactcctgacctcaggtgatccacccacctcggcctcccaaagtgctgggattacaggcatgagccaccactcccagccagttctttttttcttttttccattttttttttttcgagacagggtcttactctgttgcccaggctggagtgcagtggcacaatcacggctcagcgcagccactgcctcctgggctcacacgctcctccggcctcagcctctcgagtacctgggactacaagtgtgagccagtttggctaattttggctaatttttgtagaaacggggtctcgccatgttggccaggctggtctccaactcctgggctcaagggatccaccttcctccccctctcaaagttctgggattaccggagtgacccactgtgccctgctggcaaatttcttaaactgtgcctcagtgacctcatttaataaagggaataattgtagcacactttttctagagctgtgaagattcaatggaataaataaggcaataaatgaatggatggggaatgaaggatgtgggtttcctccctcttgtctttcaataagctctcaccatcaacctcccattgcctgttctctctcttccccctctctccctctgtctctctcttagccaggaaacctggggtagggaggcttggagccagcgggtgcgtcgggaggctgcgggtactgactggggacgcgcacggagattgcgggagaaggatccacgccgcgggagaaggatccatgccgcgggagaaggatcagagtggagcctgtggctgctgcaggaggaggaagccgccgcctggcccacaccacaggagaagggcggagccagatggcaccctgcccaccgcttcccgcccacgcactttagcctgcagaggggcggagcgtgaaaaatacctcgtgcgcctcggccgactctacagtgcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcagcacagcggccctgctaaataaggaacgcctggagccgcggttggcacggccccggggagccgaaaaaccccgggtctggagacagacgtcccacccgggggctgtgcagacgccagcgggggcggggcgcggaggccgcgctcagctgggaggacaaacagtcgctaattggagaggaattgggatgcggcctggggctgcggggtacccggagaggtggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggcttgctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggagcccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcatgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaatgatgctgccgagaggtggtggcttttggaaaagatggcgtactgcaaaacgtgctgctctgcgtggctcgaagcttcgtggggagacgtgggcagagccgtggctgactcacagaccccccaccccagagcctgccctgccctccctgccccgacccttcccctcctgacccatgtgttttttttttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaatactgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagcgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatactttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtgtatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtctcgatctcttgatctcatgatccacccaccttggcctcccaaagttctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttgtccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggcaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctccttcgcctgcctgtccctctgctccggccccctgccgcctcctgcccccacctgtaggagccccaccctcctccagcacgtcttccctgcctccccaggggccgccctggtggggccccacggacccctggcctccggccagctagcagccttccacatcgctgccccgctccctgtcactgccacatgctgggactttggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctgaagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgctctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagctgagcactgcgtccggctcgggcccaccgggtggtgtaacaccgacctgtgctcagcgccgcacagctacgtctgcgagctgcggcctggaggtgtgcggggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcagtacggcctctcagccccgcacgagcccctggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagggcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgggaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggcttgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcggtgccaccatgctgggtacatgggggacagggctgttccatcttgcgggtacctgccccttcaccaggggccttgggaggggccatgagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccacgtgggactctccagcccgacgggaggtgtgtccaggaggcgacaggctaagggcagagtcctccacagagcccaggctgacaccagtccccccgcagaggtacagccccgtggtggaggccggctcggacatggtcttctggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccatacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggcgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagtgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgtcagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgctctcaccaccaaggtgcacttcgaatgcatgggtgagtgcaggcctgcgtagggggagcagcgggatcccccgactctgtgaggtcacggagccctcccgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctctccccctcccctctcccctcccccttctctcccctctcccctctcccctcccccttctctcccctccccccttctctcccctcccctctcctctcccccttctctcccctcccctctcctctcccccttctctcctctcccctctcctctccccccttctctcccctcccctctcctctcccccttccctctcctctcccccttccctctcctctcccccttccctctcctctcccccttctctccccttccctctcctctccccttccctctcctctccccccttttctccactcccctctcctctctcccctctcccctcctcctcctctcatgtgaagaggtgccttgtgtggtcggtgggctgcatcacgtggtccccaagtggaggccgtgggtcatgcagagccacagaaaatgcttagtgaggagactgggggggtccagtcaagtgggctctccagctgcagggctggaggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatccgccttatccccttcccctcccttccccctgctcctcttcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcctcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggacttcgacatccaacctggcggagcctgggctcacgtccactgccccttcccttcccaggaccagagacccagtggggagttaccgtctgaacctctccagtcacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggaatgagtctcgtcgcaggcgtcagaacaaggcagtttttgcagtactgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcaggcggaggtgccagcaccctccccgtggctgtttcttcaatacctccattttcctttattggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggcgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggcgtggacaggtgtgcagtgcgggtcactggttgtggtgtggactgaggcgtgtgcagccatgtttgcatgtcacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcccggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctatttcactcacatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgatggccgggtgtggtggctcacacctgtactcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactcctgcctgggtgacagagcgagactccatctaaaaaaaaaaaaaatgaaatttaaaactctgttccttagctgcaccagtctgctgtcaagtgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtgccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttagccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgagctttgtttcttgaaatgcacagattccttggacatccctgagaggccagtcatgaaagtcagcttggttttctccccctcatttgggttcagaatttaaagtccacacacacgggcagtaagataatatagataaggacatcatcactcggtttcggatgttaaaatgtctaggtgggttaggggtgatttgagatcacgcaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatccggcccggtccccgtccccttccctcccccctgccctaagccacctccacctctgtcctggccacctccgggtgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggccgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcataggttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttttacttatgctgagctttaaatgacaaagattcatataatccaagagagaagtattatttagagggattcttttaccatgtgatatataataaatgcatccaatgttatacatcaatttaaaaaacaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagagtcacttgaacctgagaggcagaggttgcagtgagccgagagcacaccactgcactccagcctgggtgacagagtgagaccccatctcaaaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagagggtcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggagagagatccgtatgtcaaaagtctgtacttggtaagaatttggctgctaagttgtggcataatttgtcttttgagccttttttcctttgggtaagttgagctctacattttgtcttgccattcatgacagtaaaaatgtggttgtgtgggggctgaacctccttctgaacaatgatccaagataaaagtactaataccacaatgctttttgatattcaagggaagaggaagtatgtttcagttttaccgcctagataattacacgtcatttggcactgcctttcaagatatgtggaaaacagaaaatatatgagttatgaagatatctaggcacatttaacattctctatgccacttagtcctgaacagagaatttttggtataaattggaggaagctttttttttttttttttcttttctcacccccaaaaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacaattccatttaggaaagttcagttgagctgttggacttggacaactttgtacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttttatcctatgtgcagaaatcaggaaaaaacaaattctacaaagaatttgaaagatattatttcaggccaggtgtggtggctcatgcctgtaatcccagcactttgggaggctgaggcaggtggatcacttgaggtcaggagttcaagaccagatgggccaacatagtgaaatcccatctctactaaaaagacaaaaattagccaggcatggtagcaggcacctgtaatcccagctacttgggaggccgaggcacaagaatcgcttgaatctgggaggtggaggttgccgtgagccaaggtagcgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcattaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctccggagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatttttttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggtgatccgcctgcctcggcctcccaaagtgctgggattacaggagtgagccaccatgccagcctcatgtcattcttgtgtggtgtgtgtgtgtgtgtgtgtgtgtgtgtgtgtgtgtgtgtgagacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggcgtgagccaccacacccaggctttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaactcaatgcttgggtcacctccagattcattttcacagtctttcatgttttggtcatactacattgtattttgctgccatatgactgatctttttttgttaaatgtgagatacttgttaaaaaatatttaacaatgaattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatctgagatcagaagcttcagatgcacttatgtcaactcaagagtagaatgcttccttagcctccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcacccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggagaagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcaggcagtaagcaagaggaggaatcaatatagcaacagtttggatcagactgtacagtttttttgtttttgtttttgtttttgtttttctgagatggagtcttgctgtgtcacccaggctggagtgcaatgacgtgatcttggctcactgcaacctctgcctcccaggttcaagtgattcccctgcctcagcctcccgagtagctgggattacaggcgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattgcacgcgatgggacttgtacacttgaaatgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgtttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaaactctctcctggccctcctctcttgccagcactatgggtgactgaagacccccagggaggcacagcatcctcttatctaagatttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcctggctggttttttaatttgtatttcctttgagacagcgtatctctctgttgctcaggctggagtgcaatggctcaatcagctcactttagccttgaactcccgggctcaagtgatactgccacctcaacctcccaagtctgctactacaggaacacaaactccttttttaaattttttgtggatatggggtctcactatgttgcctaggctggtctcgaactcccaggctcaagcagtcctcctacctcagcctccacaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtctcgagctcctgtgacacatgactcctctctcttcctagtgatccaagccctgccacttcctgactttgcccacactgtaccctctgcctggggcaacttcatgtctgcccattgacccttaggcctcagcccaggcacaagcccctgcctccggaggtcatccaggcctcaccaggctacaccctctcgtaaaattggattccctcccttcagggcagctttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagctcaccaggccaggcccagtggctcatgcctgtaatcccaacactttgagaggccgaggcaggtggatcacgaggtcaggagttcaagagcagcctgaccaacatggcgaaaccctgtctctactaaggagaatcgcttgaacccaggaggtggaggttgcggtgagccaagatcacgccattgcagtccagcctgagcaacagagcaagactctgtctcgagacaataaaaacacataaaaaattaactcgccatgatggcacatgcctgtagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattcccctgcctcagcctcttgagtacctgggactacaggcatgtgccaccacgcctgggtaatttttgtatttttagtagagacagggtttagtagagaccatggtgaaaccccatctctattaaacaaatctctactgaagatttgctgtactgaagggatagcaaaactcagttaccaaaatggcaatgtgtttgaactgtttacaggccaagaattcacatttgcaacccacgcaatacactactgattgtgtgacttcctctagagagaatgtcaaaagttacaatgtgatggcttttatgaatgtgagatgaggcccagtgtgccttctcctcttcggtttgtgcctcaatgatcatcacctcccaaaacatatgctgagctcccagcttccaggcactgtcccaaaagtggggtgtcagtgggaacccaagcaacagacaatatagagtctcgcacctcatagaactcattttctccttgcttctttttctcaccttttttttttttttttttttttttgagatagggtcttaccctgtttcccaggctggagtgcagtggcacaatcatagctcactgcaacctcaaatgcctgggctcaacgtagcttcctgcctcagcctcctgagtagctgggactacaggcacccgccaccatgtccggctaatttttctttctttcttttttttttttgtatttttagtagagatggggtttcatcatgttagccaagatggtctcgatctcctgaccttgtgatccacacaccttggcctcccaaagtgctgggattacaggcatgatccaccgcacctggccctgattttaacttctcttttttctttttttttttttttttttttgagacagactcctgttgcccaggctctggagtacagtggtgcgatcttggctcactgcaacttctccctcccaagttcaagcgattctcctggctcagcctctccagtagctgggaataaaggcatgcgctaccatgcctggatcattttggtatttttagtacagacggggtttcgccatgtgggccaggctcgtctccaactcttgtcctcaggtgatccgccggcctcggcctcccaaagtgctgggattatagccatgagccaccgtgcctggccttgatttttagcttttaactttgaaataactacagactttgaaagaagttgcaaaaatagtacaaagagttaccacatactcttcatccaagcttcctgaaatattgatatcttacatgaccatagtacaatgatcaaaacaaggaaataagcacggaaatcatacacgtacctaatctacagatcttattcaaatgatcaccgatcgtcaccctaaggttctttgttcccagtctggcctccaatcccagattgcttcacattgtgttgaactgtcaaatggccttagtctccaagtgagatcactaaccggctattctgtaggctgtccctcagtttatcaacccagttgttatgggctaaatgatgccctccaaaattcatatattggagccctaatttccagtacctcagaaggcgactgtgtttgaagataaggcctttaaaatggcaattaagttaaagtgagacctttaggatgggctctaatccaatctgtctggtgtccttataagaagaggaaatttgggggcatggttggtggctcacacctgtaatcccagcactttaggaggctaaagtaggaggatcacttgaggtacgaagatcacttgagaccagcctggccaacatggtgaaaccccatctctactaaaaattagctgggtgtggtggcacatgtctgtaatcccaactacttgggaggctgaggcaggagaatcgcttgaacctgggagagggaggttgcagtgagaggagatcgagccactgcactacagcctgggtgacagagcaagattccgtctttaaaaataaaataaaataaaaaaaaaatttggacacacaaacaggcaccaggggccgggcatggtggctcatgcctgtaatcccagccctttaggaggccaaggcaggaggattgcctgagctcaggagttcaaaaccagcctgggcaacgtagtgagaccctgtcactctctctctctttttttttatttaaaaaataaataaataaaacgaggcaccagggatgttttcacaccaaggaaagaccatgtgaagacacagcaagaaggcagccgtgtgaaactaacccagcaggcaccctggtcttggacttcttgcctccagaagggtgagcaaataagtttctattgtctaagccacgctgtgtgcgctattttgttatggcagccccagcaaactaatatatccattctcttcagttcttggaaatctgcccatttctatgttctctgaccctttttatctgcccgtttattgatttatagccttctccggctccttatccttgttactggtccggagtaaacttctgttagatttctcccagctgggcaggcttccagctcaccaaaacatctccttctttgctttttacttatatcccccttgtatcatttttccatggctgaggtaacaaattaccacgaatttaatggcttaaaagaacacaaacttcttgtcttagaatttggggtgtcagagtctaaaatgggtctgcaggactgcattcctcctggaggtcctaaaggagagttcattttcttgcctcttccaagcttctagatgctccctgcactccttggctccccatccaacatcttcaaagtcagcagcataaatcttcccatctccctttctctctcttttttttagacaaagtcttactctgtcacctaggctggaacgcagtggtacagtcatagctcactgcagcctcaaaccccgaggctgaagtgatcctcccgcctcagcctcacgagtagctgggaccacaggcatgcaccaccatgcctggctgatttttaattttttatagagacaggctcttgctatgtcaccagggctgtcttgaatttgggagcccgcgatcagaagccagcatggtcggcagctccctacaccacgtccgggcttcccgggcctccagctgccccctgcgccgccgccgcctcccgcacctgcacgtggccactccagatgctccggagggattgagcaccccgcgcacacccagctcacaccatccaatccggaggccatgggccgacatgggggctgagcgtttgaaatgagcccggaccaccagatgcatgggtccgttcacacgaaatacccagaacaggcaaagccacagaggcagaaagtatggggttatttattttaattaattaattaattgttttgagacgtagtctcctctgtcgcccaggctagagtgccgatccctatgttagcttgatgtggtggctcatatctgtaatcacagcactttggtaagctgaggcgggaggatcgcttgtcaggccaagagttcaagaccagtctgggcaaaatagtgagacccccctgctatggtttggatttgggtccctgcccaaatctcatgccgaattataatccccagtgttaggggagggacctggtgggaggtgattggatcatggggggagagtgcctccttgctgttctcctgatagtgagtgagttcttatgagatctggttggtttaaaagcatgtagcgcttcccccttctctcccttcctcctgctccagctatgtaagatgtgcgtgcttcccctttgccttccgccatgattcaaagtttcctgaggcctcccagccatgcctcctgcacagcctgtggaactgtgagtcaattaaacctcttttctttataaattacccagtctcagggagttctttatagcaatgcaagaacggactgatacaacctccatatctacaaaaaaaaaaaaaaattgttttaattacctgagcatggtggtgcacacctgtagtcccagctactctggaggccaaggcaggaggatcactccagcctgggcaacaagagcgaaattccgtctcagaaaaaaaaaaaaaaattaaaaaatttaaaaaacgtaaagaaaaaaattattttgctaaatctggcaaagccaaagggatgaaactgacatttactgggcaccttctgcacaagtcagttctcctaggaacccagagaggcaagggattggtagcaatctctagaggcaaatatcctctaatatccatggtgttctttgtggagcagctcaatggatttacttaatgggaaatgaaagaaggaaaaatgaagacttagaaggcttcgatgatttccaatgcattactgtatacttatctcttcttagaagcaatagaaaaaaaaatcaggaattaaagacaatctattactcaagcaaatgctaaaggcctcccatggtcttcaaacaagaagagatgctctaagataaattacttcattacgttgatgcttcatcatccgtggaagctgtgactcagagccctgcagcaataattaggcagtgcgttcatgtcccgttaatgtccccaaacagtgggagatgaatggagaacatagggctgtgttcgaatgaaaaaagggttttgttcggcgctctttcagcagggaataagtactgatgtgggaactgagcttctgtttacaactaaggatcacattaaaaatatattaagatgactacagtaaagcttattgtagctattattatttcatttaaatgaatcccagtttcataagaaccaccaagggggctaccatgtctaaaatgtaacttctctgcgaatcctgaaatttctactgacaaaagactacgatgcacaattaattaattaattaattaattaatttgagatggagtcccactctgtcacccaggctggagtgcagtggcacgatctcagcttgctgcaacctttgcctcccgggttcaagcgattctcttgcctcagcctcctgagtagctgggattacaggcatgcgccaccacgcctggctaaattttttcgtatttttagtagagatggggtttcgccatgttggccaggctggtctagaactcctaacctcaggagatctgcctgcctcggcctctcaaagtgctgggattacaggcgtgagccaccatgcccggccaacacgcaacatgtttaagaccaaaaggactgttttgcaatgaagcagatgaatcaaccagtaaggccaacccctcaaaaaatgtagcactgaagtttcttcaacatctgcctctgagacttgttcatatgtgcagacacagagcaggaaactaaagcaactgccttcctctttgtcacctgaaatgagaatggagagaggctggcaaggaaatgatatgtaatcttccctccttcctgattttcttttctatccttttttttttgagttggagtctcgctctgtcacccaggctggagtgcagtggcacaatcccagcactttgggaggctgacgggggtagattacttgaggccaggagtttgataccagcctggccaacatggtgaaaccccatctctactaaaaatacaaaaaattagccaggcgtggtggcatgtgcctgtaatcccagctacttgggaggctgagcatgagaactgcttgagcccgggaggtggagattgcggtgatctgagatcgtgtcactgcattccagcctgggcgacagagtgagactacatctcaaaaaaagagaaaaaaaagaaaagaaacatttacaatctattcactctgaaatttacagtctatttactctgaagcctgctacctgaatgcttcatctatgagataaaactttagtctctgcaacctcttattgtaacccatatatccctttctattaataataactctttcaaccaattgcccatcagaaatctttttttcttttttttctttttttttgtttttttttgttttttgagacggaacctcgctctgtcgcccaggctggagtgcagtggtgcgatcttggctcactgcatgctctgcctcctgggttcacgccactctcctgcctcaggctcctgagtagctgggactacaggcgcccgccaccacacaccactaatattttgtatctttagtagagatgaggtttcaccgtgttagccaggatggtctcgatctcctgaccttgtgatccgcctgcctcggcctcccaaagtgctgggattaccggcatgagccaccgcgcccagcccagaaaatttttaatctatctataacccagaccaaaccaatgtaaatctttaaatgtatttgactaatgtttcatgcttccctaaaatgtataaaatcaagctgcgcccggaccaccttggggatgtgctctcttgctgctacgctttctgcaaattttccatacaatttttctttttcttttttttttttcacacagagtctcactccattgcccaggctggagtggagtggcacgatcttggctcactgcgacctctgcttcccaggctcaagtgattctcccacctccgcctccaaagtagctgggactacacgcccagctaatttttgtgttttttgtagacagggtttcgccatgttgcccagactagtcttaaactcctggactcaagcaatctgccctcctcagcctcccaaagtgctgggattacaggcaggagccactgcacccagctagaagagggaaagtttaatatagttgattctcattattcaagatagttacattcaaaaaagtcaccaaggacactgaattggtgaatattgaatcatttgctctaaaggaaatgcaggattgggtgtctccaagcctctggtcgcaacatttttataaagcaatcaatacataatcttcttttatgtgtgtgtgttaaaggacgccttatctaatacatattgttgattcattgacattgaactcacggccaacagcattgtaactcatgcctgaacaaagcttatctaacaaatgtaccttctccattaggtacttcacagccttcttgcactcagagacactggatagcacttcaggaggacacttaggggccttctgttgttgttgatgttgagatgaagtctcgctctattccccagtctggagtgcagtggcgtgatctcggctcactacaacctccacctccaagattcaatcgattctcctgcctcagcctctggagtagctgggattccaggtatgcgccaccatgcccggctaatttttttaatttttagtagagacagggtttcactatgttggccaggctggtctccaactcctgacctcaggtgatccaccagccgtggctttccaaagtgctgggattacaggtgagagccaccgcacctggctgggggccattttaagcagcaaaatcacaaaaagcacagaactgtgaaagatgtgacactgaatacactgcagagaggacacttgtttgcagtctgaaagctgagacaagaaggcagagtgtggccaggtgcagtggctcatgcttgtgaccctagcattttgggagactgaggcaggacgatcacttgaggtcaggagttcaagaccagcctggccaacatggtgaagccctgtctctactaaaaatacagaaattggccgggcgtggtggctcacgcgtgtaatcccagcactttgggagaccaaggcgggtggatcaagaggtcaagagatcgagaccatcctggccgacatggtgaaaccccatctctactaaaaatacaaaaattagccaggcatggtggcacccgcctgtagtcccagctactcaggaggctgaggcaggagaatcgcttgaacctggaaggcagaggttgcactgagctgagattgcgccactgcactccagtctgaagacagagcaagactctgtctcaataaataaataaataaaaataaaaatacagaaattagccgggcatggtggcacgtgtgtggccccagctactcgttgaggcaggagaattgcttgaacctcagaggtggaggctgcagtgaaccaagatcatgccactgcactccagtctgggcgacagagcaagactctgtcttaaaaaaaaaaaaaaaaaaaaaaaaaaaaaaagaaggcagagtgtcaccttgttggacctcagctgggaatgggtgcatcatgtgacttaaatattttgctgctctctgcatgtacatgtcttcagataatagcaaaagcaccagaggtattgatttggggtccaaatacattttagaaaggtagacacatttataaatatggaacccatgaataatgaggatggactgtatgaagaattgttaataggagactggaataatgagggtttgagtagtaagaagggaactctgaagagtatacaggcagatgcagggggctcatgtctgtaatcccagctctttgggaggctgaggcaggtgattagcttgagctcaggatttggagaccagcctgggtaatacagcaagactccatttctaaaaaaaaaaaaaattttttttttaattagctaggcatgggggctcatgtccgtagtcccagctactcgggaggctaaggtgggaggattgcttgagccagggaagcagaggttgcagtcagccgagattgtaccactgcactccagtctgggcaacagagtgagaccctgtctcaaaaaaaaaccaaaaagtatacaagtagtagatacaaggaacagctactacccctaggactgagatatgacacttacggaaacaatcacccctggagggctgagatcttgaccaggtagagagggtacagccctgggtcactgaatagcaaagaagacagttgacgtgatgccctgctggttggtggaacttgctggaaatctaccctcagggtaaacttttcatggcaaggtgtctcactgaaggtactctgctgcaagaccaccagaggggagtgccaggggaagctgcctgccaatgagtggtataggagctgggcactggagaagccatcagcaggaaccaataagcaaaaccctttcctcctgcagtgtctctccagcaccctgtactgacaaaacttaaaataacattgtgcctcctggcaaaggaaagctatttaaagggcccagatccatttttacccagaaggcaaaaaggatggatttggagctggaaggcaatagatcaaaaactgactgttttgatgttttttattttctttttttagagatgggatcttgctgtgttgcccaggctggcctcaaactcttgggttcaagtgatcctcccaactcgatctcctgagtagctgggaccatgggctcctggcattgtgcctggctgtttagtggttttaaaaaataattctacaagtatgaaaaacaaaaaagtgtaattaagaaaattaacatcttggctgggcgcggtggctcacacctgtaatctcagcactttgagaggccaaggcggatcacctgaggccaggagttcgagaccagcctggccaacatggcacaaccccatctctactaaaaatacaaaattagccaggagtgatggtgggtgcctgtaatcccagctatttgggaggctaaggcaggagaatcctttgtgcctgggaggtgtaggctgcaatgagccgaaattgtaccactgcactccagcctgggcaacagagacagactccatctccaaaaaaaaaaaaaacaaaattaacatctctagtgttaaccactcttttcattttttatgaattttttatagtcttttctatgcatgtagtttttcatttaaaaaaaaattaggttcatattacacatgctgtgttcttaccagcccttttgagttaacagtgtcaactttccatattaacaactgtgtacctgcatcacttttttttttttttttttgagaaggagtctcactctgtctcccaggctagagagcagtggcgtgatgtcagctcactgcaacctgtgcctcccaggttccagtgattctcctgcctcagcctcccaagtagctgggattccaggtgtccaccaccatgtccggctaatttttttgtacttttattagagacggggtttcaccatgtcagccaggctggtctcaaacttctgaccttaagtgatcctcccacatcggcatcccaaagtgctaggattacaggcgagagccaccgcacctggcactttttttttttacagcttgtgtcttaaccagttttatggaagtaccactatttagccaattccctgttattttgttgtatatatagtttgttttcaattttgtttcattataagcagcgctactgtggacggtcttatagttaaacctctaacatatttatgtatttagtttacactttgggagtagaattttaagtacaaaacctaggtatattttaagtgtttttgttactgaatgcccagttccattcagttcaacacaaatgaaatacgtcaaaggttttataacaatctgaaattctaccagcaatccataagaatacttattttcttctatttttttttgagacggagtttcgctcttattgcccaggctggagtgcaatggtactgtctcggctcaccacaacctctgcctcctgggttcaagcgattctcctgcctcagcctcccaagtagctgggattacaggcatgcaccaccacgcctggctaattttgtacttttactagagacaggaatttctccacgttgctcaggctggtctcaaacttccaacctcaggtgatcgacccgcctgtgcctcccatagtgctgggattacaggcgtgagtcaccgggcccggccgagaatacttatttccgtctacactaacacgggatgttattttattttattttttgagacaaagtctcgctctgtcgcccaggccggagttcattggcacgatctccactcactgcaacctccgcctcctggtttcaagcaattctcctgcctcagcctcctgaatagctgggactacaaggcatgcgtcaccacacccggccaattttttatttttagtagagatggggtttcactatgttggtcaggctggtctcgaactcctgacctcacgtgatccgcctgcctcggcttcccaatgtgctgggagtacaggtgtgagccaccatgcccagccggatgttattattttttaaaaaaactttgctaattataggcaaaaatgctatttgatccatttctgcaattttggtcactagtaatgttgaactttttgtcatgttgactatttgcatgtttttcctttttatattgtcggttaatgtctttgcccatttgccttctgggcacacagttttagagaagcctgttcactttcatgaaatgtaaataaatctgaaacaaattaaacatcaattatagtttaaaatgctaataaaaattcttattttcagccaggtgtggtggcttatgcctgtaatcccagcactttgggaggccaaggtgaatggatgcttgagctcaggagtttgagaccagcctggacaacatggtgaaaccccatctctaccaaaaatacaaaaattagccagcggtggttgtgtcctagccactgtggaggctgaggtgggaggatggcttgagcccatgaggcagaggttgcagtgagctgaaacaccactgcactccagcgtgagagacaggagtgagagcctagctcaaaaaaacaaaaacaaaaacaaaaacaaaaaggtcctttgagtaccagaaaaattgtcaatgggaatactttcctcaaggtcttgaaaattaataataaatcaacaaatcattgatggtagtggctggtgttgctttcttctatatctagctagttatcactgaacaaacattttctaaaacattttcgatgtttcagagcagagatttcaaattgacagccaagggacggattcatgcataatttactctcttttattttgctttatttttcttatggtatttacaagtaattaacatacattatatagctacttatctctctgttacaataggatataagatccacaaaaatagccagacacaatggcttatgcctgtaatcccagcactttgggaggccagggcaggaggatcacttgaacccaggtgctcaaagaccagccagagcaacatagggagatcccacctcttcaaaaattaaaaaattagctgggcgtggtggtgcatgcctgtagtcccagcagtttgggaggctgaggtagaaggatcacttgaacccaggaggttgaggctgcagtgagccaggatcatgccactgcattccagcctgagggacaaagtgagacctacctacctcaagttaaaaaaaaaaaatccgcaaaaggcaaagacttaatcccttttaatgattattgtatctccaatttctaaaatactgtgtggtatataatgcaccttcagaaaatatttgttgaattcacgcatttagtaattatttattgaactcccactgcatcctaggcactggattagctagacttgggaggtaaatgcctctgcctccatgtagtgtctttaaaatatgattctcggccgggcatggtggctcacacctgtaatcccagagctttcagaggctgaggcgggcagatcacctgaggtcacaagatcgagaccagcctggccaacatggtcaaacccggtctctaataaaactccaaaaattagccaggcatggtggtgggcacctgtaatcccagctactcaggacgctgaggcaggagaattgctcaaacccaggaggcagaggttgcagtgagctgaaatcaagccactgcactccagcctgggtgacagaacaagactctgtctcaaaaaataaataaataaaataaagtatgatgctcattaaaaccagattgaaaacaatggaaatgttttggaaataaaatatacacactgtgccagtatgtggattcattactcattaattctatgactattttttgagagcctatttgcagtcacttggggacacaataatattaaagacagattctgtccctgcggatatggcattgataatctatcaagggaggtagacattaagcaactaattaatcgtgattgtgccaagtacataaaggagaaagacaggtgcctataagcactcatgagatttccctgagaaaatgatacttacacttctaccaaagggattagaagttacacaagacaaaagggaagggaaaaaaagaacagtctcatcgaagaaaacagcttgtcaggaaagatcttgctgtacagaaagaccaaggggggcactgtggctcgcgcctgtaatcccagcactttgggaggccgaggcaggtggatcatttgcgctcaggagttggagaccagcctaggcaacatggtgaaacccacaaaaatacaaaaaaattagccaggcatgatggtgtacacctgtggtcccagctactcgggaggctgaggtgggaggatcacttgagcctgggaagtggaggttgcagtgagctgtgttcacaccactgcactccagcctgggtaaccaagtgagaccctgtctcaaaacaaaaacaaaaagaaacaacaacaacaacaaaaagaccaagagaataatcaagggaataatgacagccagagaccaaagaggtaggcaggggccatattctatactcatgggccaagtgaaggatgctcgctttattccatggacagctgaaggtttgtaagcagatgatctgatttctacattaaatagatgactctggtttctgtattgagaatggtttggctacacagactgcttagatatggcagtagtcaaggcggtagcaacggaaatagagatgcagacagctttgagagatatttaggaggtggaagtggcaacactgattggaaggggttagggaagggaaagtgtgagagagaggaagacaccctggttcctggcgtgaacagctgggtggatgatggggagcttttatgggatgtggagtgcgagaatccgtggtttagggtagaagacgagttcagtgcaatcaaggcacagctataaatgtgtacaactgaggcagaagtttcagaagcaatgagtacccttactaccatagaagatgctctgattttttttcttttttctttttttttaagaaatttttggctaggcatggtggctcacacctgtaatcccagcactctgggaggctgagttggatcatttgaggtcaggagctcgagaccagtctggccaacatggtgaaaccctgtctctactaaaaatacaaaaattagttggacatggtggctcacacctgtagtcccagctacttgggaggctgaggcataagaatcgcttgaacctgggaggcagacattgcagtgagctgagatcacaccactgcactccagcctgggcaacagagtgagactcggtctcaaaaaaaaaaagaaaagaatttttttacccaatagtaaaataaccaaccaatgcgctgatattttttaatcaactttgttgaagtatgttttacataatagattttcatatgttttacataatataataaaattcacccatattacatgtacagttcaacaggttttgacaaatgtatatacctgtgtaaccaccacgattaaaatacagagctcttctgtcatttccaaaaactccccagcaccccttggcagtcaattccccctccatctcagccccaggctttctgtcattatagtttgcattttctagaattccatataaatgaaaccatagagcatatatacagtatacatatgaaataggtattcacttgtatctggcttttttatttccttggagacagggtcttgctgtgtcacccaggctagagtgcagtggtgcaatcacagctcactgcagcctcaacctcccaggcttgagaaatcctccattcccagctaattttgtttttttttttttggtagagactgggtctctctttgttgcctaggctggcctcagattcctgggctcaagcaaacctcacacctcggcctcccaaagtactgggattacaggctccaggccatgtatctggcttctttcactcagcataatgtttttaagattcatctatgacagggaccagcaaactagggcctgtgggccaaatctggcccagtacctgattatgcaaaggcctaagagctcagcatgactttatatttttaagagattgaaaaaaaactcaaagaagaatattttgtgacacatgtaaattaaatgaaatccaaaattcaatgtctataaataaagctttattggaacacagcaacgctcacttgtttacatactgtctgtggctgtttccatgctacagaatcaaatacttgagaccgagatcgcaagaacctaaactacagcttgcaaagcctgaaatatttacaaccaggccctttacagaaaaagtctgccaactcctaatctgtggtgtcccatggatcaataatgtactccctttacttgcagtacagtactccattccattgtagggataggccacaagttgtttacctgtttgtctgttgatggacatttgggttactgcccaattatccttaatccacgtgatatgctctgatgttttgcatcctatttcattttttaaaaaattgctactcatgacccaatggttgatatcacaacccactgatgaactactctcagtttgatatagatgttaattgaaataatggaggatgaaattatgtagaagaagaaatcaaaaggactttccaggctgggcacagtggctcacgcctgtaatcccagcactttgggaggctgaggtgggtagatcacctaaggtcaggagtttcagaccagcctgaccaatatgatgaaaccccgtttctactaaaaataaaaaattagctgggcatggtggcacgtgcctgtaatcccagctactcaggagtctgaggcaggaaaatcgcttgaacctgggaggtggaggttgcagtgagtcagcgagactctgtctcaaaaaaaaaaaaaaaaaaaaaaaggcttgccagctgagtgctgaggaaatccaacaatgaaacattgggtggaggaggaggaaactccaaaagacattgagaaggaacaggcagaaagggaaggtgacgatccggagaatttgatattgtgggaagcatggaaagtcagtttcaagaagaaagtgatcatctggttctagggctgctgagaggtcaggtgtgatggactgagatggttttagtgacactggtttgggtggagggaacaaggccgaagctagattcagatgagttggtggtgcttgtgtgatgagaaaattgagaccattaggtgtaaccagaaggggatgtggatgaagataaggagtttttatttgcttgttttttgagcataagaatgtttaacaaacactaaaaggcaagcataaccagaattttacagatgaggaaactaatataccaagaggttaagtaacttgcccaagtagttttcacttatacagcttaaaaaaaaaaaaaaaaaagaatccagttctacttgtagccacagtctgaactctaaccaatgggctataccatcgacaagggaaaaaactggcccagacataatccaatttttgtacctttgagttaaaagtctacagttgaggctgggcctggtgtctcacgcctgtaatcccagcactttgggaggccgaggtgggtggaccacctgagatcaggagttggagactagcctgtccaactagtgaaaccccgtctctactaaaaatacaaaaattagccaggcttggtggcacgcacctgtaatcccagctactcaggaggctgaggcaggagaattgcttgaacccgggaggcggagcttgcagtgagcagagatggtgccactgcactccagcctggcgacagaacgagactccatctcaaaaaaaaggaaaaaagagaagtgtttgaggccaggctcggtggctcaggcctgtaatccaaacactttgggaggccgaggcaggaggatcacttgaggttgggagtttgagaccagcctggccaacatggtaagaccctgtctctactaaaaatacagtgtgtgcgatggcgcacgcctccagtcgaagctactccgggaggctgaggcagcagaatcacttgaaccggggaggcagaggttgcagtgagccaagactgcgccgttacacttcagcctggacaacagagtgagactcgtctggaaaaagaaaaagaaagaaaaagacaggtctgttagcagcacataaagccatatgtcagtagagattaaacctccccacaactgatggcttcatgctccaaactgtacaatattctgcttatctctcttcactagtccatagaatgttgcattataatgtatcagttttcctatctgtgcatccacaagccaaatggtttcaacttttttttttttttttcggggatgggggaatcacagacttgagtatataatgaagacaatggatgttttccccagaaaaatgcactcactcacacacaaaatgttgagtatagtttcagagacctccatctgcatcccaaagtaaaaacttctacccaaaatagtgtttttcttcagggcagagagcttgtctttgttttgtgtgtgtgtgtgtgtgtgtgtgtgtgtgtgtgtgtgtgtgtgtgtgtagacggagtcttgctcttgtcgtccaggctggaatgcagtggtgcaatcttggctcactgcaacctccgcctcccaggttgaagcgattctgctgcctcagcctcccgagtagctgggattacaggcgcacaccaccacacccactaatttttctatttttagtacagacgagggtttcaccatgttggccacgctgttctccaactcctgacctcaggtgatccgcccacctcggcctctcaaagtgctgggattacaggcatgagccaccgcgcccagccttttttaaatttttaaattttttattatattttgtttttgagacagagtctcgctttgtcgcccaggctggagtgcagtggtgcgatctctgctcactgcaagctccgcctcccgggttcacgccattctcctgcctcagcctccagaatagctgggactacaggcgcccgccaccatgcccggctaatttctttttgtatttttggtagacacggggtttcaccgtgttagccaggatggtctcgatctcctgacctcgtgatccgcccgcctcggcctcccaaagtgctgggattacaggcgtgagccaccgcgcccggcccagcctcttatttgtatttttattgttttttgagatggagtctcgtcttattgcccaggctggagcgcagtggcacaatctcggctcactgcaacctctgcccccggggttcaagtgattcccctgcctcagcctcccaggtagctgggattacaggtgtttgccaccacgcccagctaattttttgtatttttagtagagacggagtttcactctgttggccaggctgctcttgaaccagcctcttattcttttacatactatttccagcacaactgtccaagatggcagtcaataaatgtttggctaaatataataaataatacggttgattatttccactttttcatgttgggttttcaaagtctacttttaaaacagtaaagttaacttttctctctagtatttgttttgtagaatctattatactttgtaatgtaatccacagaaacttggaggtgactttagtaaaatttactagttttgaatgatacccatgctgaggtgctcagaggtgaaatgtactaacatatatcgatggatggatatatggatgcatatgtgattaaagcaaatatagggaaaattaactgtagaatctaggtagtgggtatatggttgttcactgtacaactgtttaaacttttctacgtttgaaaaatttcataacacgttggaaaagtgacttgttttgctcaagcaggggtacattcaatcttcaattcttgaaagacataaatctatctttccttctgtttggaaagctctttagagagtcagaataatccccacagtacagtctaaaccagcacacaagggttttttggtagaaaataattttattaacataaccaggcaatttaccaaatacaacgtagatagctcaaaacatggagttactgcgctgaaaatgtgaccctgtttacacagatttcgggacgaagagtataaaacaggagagaaaaggagtaagattgtggttgtagcgtcatcgcagaggtgaagtgttccattgattgccactgtggtagtctatatcagtttcccacattaaggtgggaggaatctactaagcaaatgtacgccctccccattcgttcgaaacacattgcagtaaaattgcaaaagtggccgggcgtggtagctcatgcctgtaatcccagcacttggggaagctgagacgggaagatcgcctgaggccaggagtttgaagccagcttgggtaacatagtgagacacccctaccttctctattaaaatgagattttaattttttttctcttcagttcatcggttaacaagataaaaaaattaataaaaaattaactttttaaaacatttaaagtaaagtaggagtggaagcagtatgtggactcatggggcttgggtctgaatcctacctagatcggcactgcgaaatggggataatgatctcctagagctgctgaaataggaaaatggaagaacagcagctgatgtattaatattatcattattactactacccattacctgacaagtgataattgtgacatgaaagaggctggaccggttgttacaacaattttttccgtctagaattcggcggtaaggtctgagacaacacctcagcttagatcagtgccttctctgaacagcgttcactaagcagcccccaaccccaaaacccccaagtccccgggcgccgaggacgctgcgagtcctgcgcatgcgcaaggttgcccactcgctcaccgcctccttggcgaatggcctgttccattctcgagggatgccggcgggaggtgaggcgggagacttggaagcctgggcccggaagtgaggtgcgtcactagtatttccagcctttcactccatgaatagtactttgtgattattatacttctaccttgatgattgcaacaggctgctggaaagagtttggtgaacaatccaccgggcatcctccccccttcacctgcgcacgttagggagggccggcgtggcgcccaggtacggaatcccagagggctccgcccagcgctacggggccccgccccgccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaaggtccgtgccgggagggggcgatggggacggtgctgcggcccggggctcccgcttccgaggcaactgtttcccagtcgcgagctgccattgtgacccggacagggggacgcgggctgacaggccctgcctgaggaggcctcgccgggagggcggctggggcccgggcgcgtcacggggccgggtgtctcttgggtccccgtgggccgaagaggctgggcggggttcggtgggggccgcgacgggcccggagcccaggactgggaccgcggggccgaccttgggccctgccgaggttccgcgagtggccggcctgagctcggctggccctttcggaggaccgggagctctccgttggcggccccagatgctcccggaaagaagccgcagttatttcagagccagctgcaaacctgtaggtttttcttggtctccgagttaggaatgaaaattgccaaagcagtggttttccaacttcagcctgagtgggaatcacctggggcctttggtaaaatgcggaggttcagtcccggggtcagaacctctgggggcgggaccgggaactgcgtgtttaaccgccaccgccccgctcccactccgccccacgcaggtgattctgatgctgagcctgcgatcaccgggcgagaacctctgagttccagaaaggggtgggtgttgcgtagattgcgaattgagttttggggatcgcagctgctccacaacttcctggctcccccattccagtggcgaggagggatccccgagtcaactcgaaatccactggtaacagagcctacctctggtttccccttgggggaacggcagcgtggtgtaccaggctgactgctctaccatgtgaaacggattctcattgtcccagtgttagggcttgtaaatggaaaccagtttgggtttcttcacggattcctgctttcggtacctgacattctgccctccctcaaagcccttctgtctgttccagcttgggagtctgcttgtccaatccagtgcatacccggtttttcatgcatgtggcattcaggagcaatgctcgtgttttaagacggctacattttaattttgagctggtaggaataatatattttgtcttttttcaaggcagcagctgctgtagattttgttcacttgtcactggagagttgaaggcaataattgtaaaggttgggccagatgtcttcatgtgctcacagtggtatagcctactcctgggttgcttagcataaattgggtggaagacaagaaaaagataatatggttttcttgtgccatctctggggtgaatgttacgtgttttcctggctgggaataaagtctttccggtcgtctgattagcagggtgtctaccttttggtactttgagtttgtccagatgagtggttcttaaagcagggggcaatttatttccccaggagacatttggctatctctggacatagttttgattgtcacaatgggggcagggaggtgctgccggtacctagtgggtagaggccagggacgcctctaaacatcctacgttgcacaggacagccccccacgctggagaattctctggcccaaaatgtcagcagtgttgaggctgagaaatcctggtcaagatcatgtttataacaccagcagttgagtacaaaacgatgcaaagtggtgttatcaatttcctaagaaggtgggtgggcttcatgtgattgtaattggaatcctgaagaactggggtgatctttcctccaggaataattagcctttataggaaaatctgcagggtgggtcagaatcctgctttaaatattacttttctggcatttgatcagtaggttacagtagttgctccctaagtgttaattgatgataaaagatcttaaactctctcaatgaggatcgcaagagggactgaaattccagtgtgtttaatattggagcattcacaaaaattgtagtgatcttttaggaattcagaacgtgtgggctggaggtttctgccttaggtcaatgtgaaaattctgagtgtaagtttttcagaactatgggacttacttttttttttttttttttttttttttttgagagggagtctcggtctcttgcccaggctggagtgcagtgaggcgatctcggatccctgcaacctccgcctcccggattcaagtgattctcctgcctcagcctcccgagcagctgtgactacaggcgtgtgacaccacacccgactaatttttgtattcccagtagagatggggtttcaccacgttggtcaggatggtctcaaacgcctgaccttgtgatccttcagcctcagcctcccacggtgctgggattacaggcgtaagccactgcacctggccgggacttagatttatattccctgaagtaatacagggccttagatggaataaacgatttatattggtgctaattgggcagaaaagaaaaagcattgctgtaatatgaatgttgatgactttatgttctgaaaaatagtctgggtcaaagtgaaacatttaattgtgttcattattcctgtttctttgaggaatagactatcctgcgttaaattctacattgttaatataaactcaagagctatgtgagcagttgtaaatgatcccatttaaactgattgttgcataatttatactgattacagaaaccacaatgttatttgatgctcaccctctaaaatttaaaataatatctctcactttaaaatgtatgtgaaaaaacaaaaacaaaatgtagtatgcgatcatcatttagtagaatcactcagtgatttggatttggtccaaatatagttctgtcccttgctttttctgttatgtaaacgtgcagacctgtgataacagagccattttctcgtcacgatttgcttttcttccacaacagtatcagttttcttgtatctgagatcagtgatgtcccaataaatcagatgggttaattgaggaggcaaaggaaattcaaacttaggagagtaggagtaggggctttgcccctgccccccactgtatgtccaaggcataaggaacaaggccctgtagcagagtctcacagtgtgtacttatgttaatattcaataaggaaaatgccacaggaagtaatcactataatgatgaagattttaagttattaaacacaccttccagtaaaaacctgttatattattattatttttgagacaggatctctctctgtcacccaggctggagagccgtggtacaatctcggctcactgcaacgtccgtctccagggctcaagtgatcctcgcgcctcagcctcctgagtagctgggactacaggcactcacccccacactgagctaattaaaacaatttttttgttctcgagacaaggtctcactatattgcccaggctggtcccaacctcctgggctgaagccatcctcttgccttagcctcccaaagtgctgggattataagcgtgagccaccgtgccaggccaaaacctgctactctaaacttgtagaatagcccagacctttttctgttggttaaaagatctcattcttcctgggtattatgtttaggcaaggtatactgcagtttgtttgcatttactttaattctgtccttgagcaaacttaaagcagtttctcagcgtcagcactagtgatattttgggtcagataatttgctgttatgggggctggcctgtgcatggcagcatgcttagcagtgtcccagacctctgctcagtagatgctagtcgcactccctacacccagttgtaacaataagaaatgtctcaagatgggggcagttgtcccccaaggggtagagggaattgcctgtcattgaaagtccctaatttagggaatctagagctacagttccggtttggtcaccactagccatatttggcagtttacattgagattaaaattaaacacaatttaaaattcatttcctcagtcatgctagccacatttcaagtgctcagcagccacatgtggctgatgtctgctacactgggcagcacagatgtggaacatttccatcgcaaagaaggttccactggacagtgctaagagctggcaattcgtgttttttttttgagatggagtctccctctgacgcccaggctagagtgcagtggcacagtctctgctcactgcaacctctgctttccgggttcaagcgattctcctgcctcagcctctcaagtagctgggattacaggcacccaccaccacacctggctaatttttgtatttttagtagggatgggatttcaccatattgaccaggctggtctcaagctcctgacctcaagtgatccacccgcctcggcctcccaaagtgctggggttacaggcatgagctactgtgcccagccaattacttgttatatctaattctcatctctgaaagaggcaactttgaccctgtttctgacctaaatcagcacaactcagcccatttttggttcttgaactcatcctgagctaagtgtttctttcctgctatttgggactgattttagaaaattctttgtcaccttgctgttatgctagaggtttatagcagcatcaatggaacattcctgatcattacttactgataaggactccgagaatttctattcctgctccttccttaaaaagcatgagaaaagaacccctgttaggcaaggttgaaatgaccagtttccgtgtatggctttgtagatcccactcttttatatagaatgagaggagatgagaggctgtaattgtagctttcatataaagccaattccaatgttacaatgtgagggttttgcatacagatgcatggtggctatggctgtaaatgattatctaatactggctgtcagggaaaactgatgggactcggccatagtacaaagttcctgatcctagatatttatggctttgttcattcttgatttattcaattttgcaggggaagtcagtggcagagctattgatggtcccatttccgtctttgctccactatatctaggattatatgagttataggtagaagttggttgagcttgatttcatctgttgtcacctaaagcagaaacctgttttgatttataattttttttttttgagacggaatcttgctctgtcacccaggctggagtgcagtggtgcgatctcagctctatgcgacctctgccccactgcaacctctgccccctgggttcaagcaattctcctgcctcagcttcccgagtagatgggattatttttgtgccacgcccggctaatttttgttttttttattttttatttttttgagatggagtctcgccctgtggcctaggctggagtgcagtggcacagtctcggctcactgcaagctccacctcccaggttcacgccattcttctgcctcagctgggactacaggcgcccaccaccacacccagctaattttttgtatttttagtagagatgtggtttcaccaagtgttagccaggatggtctcgatctcctgacctccacctcagcctcccaaagttctgggattacaggcatgagccaccgcgcctggccaatttttgtatttttaatagagacggggtttcgccatgttggccaggctggtctccaactcctgacctcaagtaatctgcccaccttggcctcccaaagtgctgggattacagatgtaagccactgcacccggccttgatttataatttttattaatcgaaggtgagctgtggtcaaagcccaatgctgagtgctgacagagacacaaggtgagtaagatgtggcccctgcaggaggttgcgttctggtaagggagtatacttttttttggacaaatccttgtatagaaagggataaaaagcataggaattaagaaacaaattgtgagtgcaaggagcaagtgaccaggaaggattatgtgaaagagattctttaggcagaatatttagctcagaattatgcttttctagagtttaattgtaaatataatgcaaacctttactttacgagtgtgcctcatattattgctggtagataaaaatcaagaaacaggaaaagcatttcatctttacctttccgatttgatcgctccctaacaatccctgaacaaggtaaatcctgaatggtgataatcattcaaccttcatctctgctaaaagcatttcttttcctcccaggcaaaaacaaacagtgcctgctgtctagcactagttaaactagttaaacactgcctataaagcttatcttaaggaagagttataacagtatctgcttctgtttagcagttttctttttgttccagaataaaggtgtgattccaggtaaacagtaaagtttttagaaatagagcttccctattgtatgctatttttccatcagtgtcattatctggaagtgtttactcgtgttataagatctgtgtgaactgacactgcagtagtggtctctgggaacacaggtttttggaacacggagttggatctctagcatctccaacgtatatctgagtcaagtgattagaggctttttccctccttcacatactgctctctgactgagatgtgatctgtgcagttaactttgctgcctcctttccactgttgggtatttttgtccttttcttttgtttcttttttttttttgagatggagttttgctcttgttgcccaggctggactgcagtggtgcgatcttggttcactgtaacctctgcctctgggttcaagcaattctcctgtcttagcctcctgagtagctgggattacaggcgcccaccaccgcgcccagctaattttttgtatttttagtagagacagggtttcatcatgttggccaggctggtcttgaactctgtacctcaggtgggccactgcacccggcctatttttgcccttttctttcctattttctgcctatcttcttgaggaatttgtaaggttaaatacttatagttacaccttatacagtacttggctaacccttttcaactaggaagattatgatgcttaatcttaatgagccagtaattacagtatgtcttcatattctcacagacacactcaagcgtagagaccatgatggttaaaaataagactttcaaatgacaatatccagttcttagaagatgagaggagacggctgagcatggtggctcatgcctgtactcccagcactttgggaggccgaggtgggtggatcacctgaggtcaggagttcgagaccagcctggcccacgtggtgaaaccccatctctactaaaaatacaaaaattagccaggtgtggtggctcacgcctgtagtcccagctactcaggagattgtgccactgcaacagagtgagactccatctcaaaaaaaaaagaagatgggaggagacaaaagttctggttcttaaatactgtactgttgaatcaggcaaaaatacttacaaatgtagaaactgagactccaataagataaaccaggtttacaagtcactgtatcagcttggaggattcctgtcctcttctctcatccttggcccataaggaacattatgttcttgctgtggcttctcagtggtatgtattataatagacgtgtgtggtgtttggggaacttgtttaactagtgctagacagcaggcactgtttgttttcgcctgggaggaaaagaaatgctttttgcagagatgaaggttgaatgatgatcactattcaggatttaccttgttcagaaagctgtgggaggcaagagtagttaagttaggaacagctgtctggagctttacctcttgctttttatctcagccgaaggtaggtagtgattttttttatgtctaatgcatatggtataaactagcatctcataactccaaggtcttctaatatgagcagctggtttctctttagttagccctaagaggcctctgaaataagtcctaaaagtcccccaaataagaacattcctctcctgaaaaaaaaactttgttgaaacgaaagtattatatacttctagcattgatgaatgttacaattaatatacttttaaaaataaattttagactttctttgttatagaggctgcttctcttaaaagccttctcttggccgggtatggtggctcatgcctgtaatctcatcactttgggaggccgaggcgggcagatcatgaggtcaggagatcgaggccatcatggctaacatggtgaaaccccgtctctactaaaaatacaaaaaaactagccgggtgtcgtggcatgtgcctgtggtcccagctaattgggaggctgaggcaggagaatcgcttgaacccgggaggcggaggttgcagtgagccgagatcatgccactgtactccagcctaggcgacagagcaagactccgtctcaaaaaaaaaaaaaaaaaaaaaaaaaaagccttctctttgaaggcttagctctgtatgtcttaaacagcagttattcatgtcagttattcatgtaccatctgtgaatttggccacatcactgtaccacctatactattatttgcttagtattttcttttaaatctactttacatcaatttactccccctttatgaaaaattgaggaaccgtttacttacaacaaatagacccattttaattatatagtttgtgttttggaagttgtatatagtgatattaccaccagcatgatcaagatacaaagcattgacctggtgcagtggctcacacctgtaatttcaacactttgggaggccaaggaaggaggatctcttgagcccaggagtttgagggcagccagggcaacacagtgagactcctatctctataaaaaataaaaacttagccaggcttggtggcatgcacctgtagtcccagctacttgggaggctgaggtgagaggatcgcttgagcccaggagggtgaggctgcagggagccacgatagtgccgctgcacttggcctgggtgacagagtgagaccctgtctcagaaaataagtcccctacccacccaccccaaaaaaggtacagagcatttctgtctccctgaaaatgtccctatgtccctttgcagtggatccctgccctgctttctgtcactctagacctctttacccacccatcccatccctgcacccccgcctttttttttttttttttttttaacttagatttgtcctcaactgtaatgtctctaaattctgggatttgaggtgtgtgtttgtgtgggtttttttttttttttccaaatcacataaaagtgagagagagagagagagagagtgtgtgtgtgtgtgtgtatacatatatatatatatatatattttttttttttttttttctgagacggactctcaccctgtcgcccaggctggagtgcaatggcgccatctcggttcactgcaacctccgcctcccgggttcaaacgattctcctgcctcagcctcctgagtagctggggttacaggcacaccaccacgcccaggtaattttttgtatctttagtagagacgagatttcaccatgttggacaggctggtctcaaactcctatcgtgatccgcccgcctctgcctcccaaagtgccagaattacaggcatgagccaccgctgccagccaaatgtataattttttaaattcacactttggtgaactggtttaactgaggaaaagtgttgattcgtgtgttttcaaaagatgaaatttttttttttcccctgaaacagagtcttgctctgtcacctaggctggagtgcagtggtgcattcttggctcactgcaacctctacctcctgggttcaagcgattctcctgcctcagcttcctgagtagctgggattacaggtgcccgccattgcacacgactagtttttgtatttttagtagagatggatggggttttaccatcttggccaggctggtctcgaactcctgacttcgtgatctgcccaccccggcctcccaaagtgctgggattacaggtgtgagccactgcctaagatgaaaaaatttttaaagtgactagttcattaattcccaaatcttaggctctaaagacaccttttatttctattgtagttaccagttttggaagatatgataaacaacttttttttttttttttttttttttgagacggagtcttggtctgtcgcccaggctggagtgcagtggcacaatctcggcttactgcaagctccgcctcccgggttcacgccattctcctgcctcagcctccctagtagctgggactacaggcgcccgccagcacacctggctaattttttgtatttctagtagagacggggtttctactgtgttagccaggatggtctccatctgacctcgtgatccacctgcctcggcctcccaaagtgctgggattacaggtgtgagccaccgcgcctggccttgccaatttataattttccgttagcttttttgaaaagttgagagttgctccttgacctcctttaccatcttaccttgcatttgattcttgacttttcctccaacatttaaattgtcagaacttttaagcaattttaacattacatatgtaatatttcttctggtagtgagggagtattttaatatcccatactgtctgataaaaatcgcctagcataaaaacgattcttggccaggcactgtggcccacatttctaatctcagcactttgggaggccaaggcaggaggattgctcgtgaagccaggagtttgagatcagcctgggtgacatagtaggaccatgtctctccaaaaaatttttaaaaattagctaagtgtggtggcatgtgcctgtagccatgtctgctcagggggctgaggttagaggatcacttgagcccaggaactcaaggctgcagccagctatgatcacgccactgtgacagcctggacaatagagcgaggtcatgtctcaaaaaaaaaaaaagtttgtaaaaaatgctcacgaaggtatgaatagtagggcttgttttataaaatgagctaactattaaagtctcagttctggctgggtgcagaggctcacgcctgtaatcccagcactttgggaggccaaggcaggcagattatctgagggcaggagtttgacccggccaacatggtaagatcccgtctctactaaaaatacaaaaaaattagctgggcgtgatggcgggcacctggaatcccagctactcaggaggctgaggcagcagaatcacttgaacccgggaggcggaggttgcagtgagccgagatcaagccactgcactccagcctgggagacagaatgagactgcatctcgaaaaaagtctcagttctgtgacagtgagcatgcaattgaatggctcttcttaggaaaggagaattaaatcatacctatcatgcaactgtgttagataaaattgtagcaaaaatattgaacccacgtcatttatacaacagaattaactgtacttgaaatataatttatgaatttgtagagaggtaaaactgtgtctaaattctcagcaattagtatctatcagaaaatgtgcatgtagatatacccactctgtaaatgctttgttgcactttttttggttttgggatttttgtttgagacagagtcttgctctgctgcccaggctagagtgcagtggcgcgttcttggctaactgcaagctccgcctcccaggttcgagtgattcttgtgcctcagcctcctgagtagctgggactacaggcgcacaccgccacgtccagctaatatttgtatttttagtagagacggggtttcaccatgttggccaggctggtctcaaactcttgacattgggtgatctgccctgctttggcctcccaaagtgctggttttacaggtgtgagccaccatgcgtggccatgctttcactcttaaaaatgcttgggtttaagagttggtggaaaaaggaaaaaaaaaaaatgccctgatctggatgatgagtttacggccatctggttgagactgttgtaaagtagaaattttccctgtaaagtgtcactttcttcccaggtgaaaacattaatcaagcaaggataatctttaaaattaaaccttagttctaaatatgatttttgagtacaagcttttttaaagtgttgagttgcttcatttacttacttgataaaattgagaagcagtattgcccagtggttaagagcactggtcctagaattttacttagttttaaattctggctctaaaatgtactatgatttggggcttgtgaggaagtaatgtgtgtagaggcgttaattattagcacaatgcctggaatatagtaagcaacccagtaagtattagtaattataaggatcataaatctgattgaatatttactctgtgtctgaccctgcactcagtgctaagggattcagaaattatttgacattcttccgaggaacttgacatagaatactgtttttcctttgtttttttgttttttgagatggaattttgctgtcgcctaggctggagtgcagtggcaccatctctgctcactgcagcctccgcctcccaggttcaagcagttctcctgcctcagtctcccgaatagctgggattacaggcaccccccaccacgcctggctaatttctgtatttttagtagagacggggttttgctatgttggccaggctggtctcaagcacctggcctcaggtgatccaccaaccttggtctcccaaagtgctgggattacaggtgtgagccactgcgcctggcctgttttttttttctgccaacattatcaaacattttcctatgtactaactaatagacatctttatacatctttatacaattctttttttttttttttttttgccatacaggttcattttattgagtggaaagcttacaaaaggtccactggccccttccctccccacgtgacactcattccttccaatgcaaactctggtgtatccacactcgcttctgcgtcactggtttcccccaacaaggcacaaagggcgggtgcttccaaaggatcccttgctcctggcagtgggactttcagtgctgggtgtcttgtgcaaatggtggctgaaagcaggactgttagttcactcagacactgggatcttccttactcctgcagaggggcttggctccaggcccacagtactcgttgtagatgagcttgaagaggaagaggtggaagagggtgatgagggaggccaagctgaaccagaagaggaagggcagcccggggtcctgctgagccatgtgctcatcatgggccaggatggccttgaggtgcagcgtgtgccgcaggtcctgcaggtgtgtgaggtcggtggagatgtagagcagtggcgtgatgggctgtgtcaccatgaccgagaaggtgtggcccgtgggcgccgaggtcagctccactggctcgtccaggcagcctgccttgcaggcatagatcttgacaggctggccacgggactccacggactcgtgtaggtagggcttgccctcggcatccgccagcacggccaggttgatatggtcgttcttgtagcggatgccatgcaatgcatagctgttctgcagcacgtcggggtcggcctggaactggaggtggttctctgtgaactgcagccccccgaagctgagcaccatgccctgcaggatgcctggggcacccaccttcaccagccccttgcagccactcttctggagggtcagcctccacaggtcagagagctgcaggatctgctggacggaggacagcagccccggccacaggttctcggcgtgcatggtggcgtgcccgctgaagcggtgatcttcatagttgagcgtcgactccatctggtctcgctccctgtggctcagggaggggctgagcagcggggctggcgagcaggagagcatgtaatagagcgtcaggttcacggtgaggccagacggcctgtgggtgtcagtgatcttcatttccactcctgggctgaagagctgagcccagaggagctggtggtcttgaagcagctccgccgctggcatctccaagagctccagcatttccttccgtgccaagtcctgcagcgccttgagctccttggctgctttgcttttgggcacctgggggataatggggccagagacgtgcaccacccacagcaccgtctcatccagctgcgtcttgggagccacttggaggcggttcaccagcttcttggcggccaccaccaccaggtgcaccaacccagtgggcgtaggcggggaccggcctgagtagaggaggaactgatggtctccgaccttctccagggtactggtgaaggccttgggggctgggccggcagtgggccccacagtctgcagcgcggtcacgcgctccgtggggttgttgagctggatgcgctgcaggtagacgtggggtcggcccctgtgcgccagaaagccctcttgcagcagcacgcagtcgcggccggaccccgcggcaaggccagagacggaggcgggcccggggccggcggccacggggccaggacctggggaccccagctgcaggcaacgcacgcggcgcagcagcccctcccgcagcagcagcaccgcctctccagcttcagccagcgcgctcagcgggcgcagctgcacgaagggcacaaagtccggcgccacggcgggctcccgctccccgggagtcacccacagccgattggcagccacgtccagggccaggaagccgttggccaccagggccggcactccagggcccagcggtaccgcctcgccgcgctcccgcaggccgcgccaggcgcgggtggccgcctccaggcaggcagacggctcggtggcgcccggctcaccccaggaccagggaagcaggtgcaggccgcccgccgcccgctgcgcgccggaccccccaaaccacagaagcagcagtaggaggccaagcaggcagaggaggcggcgggcccagctgctcgacagcagtcccggcagccccttgagcccctgctgtagccacatcgggccgccaggcgcgggcaagggcgcgagggcggccgccgggcccgccgcccagcccaccggcccggccgcccgtgcctcactgcccggcccagaccgcggcgcccaccccggcccccgccgcaaccgccgcagcagccgccatcgctgcttcctcctccttctcctacaatttaattcttcatttaggtttgtgtctggctgttgccctggtgttgtttattaatgttgatcatacagctattttggcattgcccacagctattgaggataagaaatgtgatgaagaaagtggtagctgcccccagtagaagcttatgaagacgctgtttttagttttaagggatcagttaatctacaacttttcatagagcattcattggtttagatcttaatattatcctgaaactggataatactttatattttgaattatccaattaatgcaacaaacacgtgagggtctatggcattggagtcattgttcacatttattcacccaaacttaactatcagtgctgcttttcctacccacccactcccccctgggcttactccctgaagagcaagaatgatttatttatttttatttaattttttgagacaatcttggtctggcgccaaggctgaagtgcagtgtcgcaatttcagctcgctgcagcctccgcctcctgggttcaagcgattctcctgcctcagccttccgagtacctaggactacaggcatacgtgaccatgcccagctaatttttgtatttttagtagagacgggattttgccgtgttagccaagctggtctcgaactcctgggcctcaggtgatccgtcaacctcggcctcccaacgtgctgggattatagtcgtgagccactgcgcccggccagcaagaacaatttaaacataagccagtttacgtttacgtaaactgcatgtacactccagagtcagagattcacctggggattgtgaatctgcatttccctcctgcctttcagtttaagcatcttgtcattacacgggattttagtgtttataaatgcatgttcacacaatgtggcttctaaactattttgtgtgtatatatatgtattatatatgtatatagatatgtgtgtgtgtgtgtgtgtgtgtgtgtgtgtgtgtgtgtatttgttgttgtcgagacaggttctctgttgaccaggctggagtgcagtggtgtgatcatggctcaccaccagagcctcaacctcccaggctcaagtgatcatcccacctaaacctcccaagtagttgggactacaggcgtgcaccaccacacctggctgatttttgtactttttgcagatatggggttttgtcatattgcctaagctgtattttgtctatttttttttttttttttggtgacaggttgttgctctgtcacccaggcagtggcacaatcttgtctcactgtagccttgacctcctgggctcaagcaatcctcttgcctcagcctcctgagtagctgagaccagaggcatgcactaccatgcccggcttactttttttgtattttttgtagagacgaggttttgccatgttgcccaggctcatctcaaactcccggactcaactgatcctccttccttgacctctcaaaagtgctgggattacaggcatgagccaccacacctggcgtattttatctattcttaacagaaatattcattataattctattgaaagaaatagctgtgttgcatttagagaacagtatgttgatatccactctggcatgccttcctaagggattttcaggttaatatgacaattggagaattgagccaactttagacccgtggtctaaagagaagtcaaaattagtaggagtctgaatccttgccttcaagaagcttgtaatctaattggagagcacatttatactggaaagcacatctataaaacaattcacagtaaagggtgtaaggaatcatgaggataaatggcagccgcaacaactgcaagcattctgtcccattgtccccataaatacaaccaacattgtcaagcaacaagtctagatttttggtttaggaaaaaaggcatcagtatcattagaggggatgggaaagagcaaaagtggctttatctgtaaaggcttcctggaattattgacttgtaattgaataggtgctaggagagagatagataaaagtcatgaggatatttcagacactatggtcgttgggagcatgaaggtgtgaatcaagccaaactgtttatcatttggctaggtggtaggggacacacgggagtgtcacagcagtgaggatcgtcaggagcatcaccagctgactcaggggtgaagataaattctcttgaccatcatattcctcattctcttcactgtctgcactgaggcctttttcgagtgctttctgagccttctcatagttaaagtggtgaattttattgaaaacacttgttttaaaatttgtctattttatctaaaaatttggtcatggctaaatgattaccttgtaagcccttgtgggagccagtgtgatataatagaggtcagaaacaggagtcagggaccctaggttttggcacctcattgtcgtttattagctctatggccataggcaagtcgcttaacctctctgcatcttagtttcctcacctccaaaatgttagaccagaatcagacgtttttatgctatacttttttttttttttctttttttgagacagggttttactctgttccaggctggagcgcagtgacacaatcatagcttactgtagcctcaaactcccaggctcaagcgatcctcctacctctgcctcccaagtagctaggtctacaggtgtgcaccaccacacccagctaatttatttctcactatgttgcccaagctgatctgaaactcctggcctcaagtgattcttctgccttggcctcccaaagaattttttttttcttttcaatgacactttaaaaaaaaattttttttttaattttttaaaattatactttaatttttagggtacgtgtgcacaacatgcaggtttgttacatatgtatacatgtgccatgttggtgtgccgcacccattaactcttcatttaacattagttatatctcctaatgctatccctcctccctccccccaccccacaacaagcagcagtgtatgatgttccccttcctgtgtccatgtattctcattgttcatttcccacctatgagtgagaacacgcggtgtttggtgttttgtccttgagatagtttgctgagaatgatggtttcaaacttcatccatgtccctacaaaggacatgaactcaccattttttatggctgcatagtattccatggtgtatatgtgccacattttcttaatccagtctatcattgatggacatttgggttggttccaagtctttgctattgtgaatagtgccacaataaacatacgtgtgcatgtgtctttatagcggcatgatttataatcctttgggtatatacccagtaatgggatggctggatcaaatggtatttgtagttctagatccctgaggaatcgccacactgacttccacaatggttgaactagtttagagtcccgccaacagtgtaaaagtgttcctatttctccacatcctctccagcacctgttgtttcctgactttttaatgattgccattctaactggtgtgagatggtatctcattgtggttttgatttgcatttctctgatggccagtggtgatgagcattttttcatgtgtcttttggctgcataaatgtcttcttttgagaagtgtctgttcatatccttcgcccactttttgatggggttgtttttttcttgtaaatttgtttgagttcattgtagattctggatattagccctttgtcaggtgagtagactgcaaaaattttctcccattctgtagattgcctgttcactctgatggtagtttcttttgctttgcagaagctctttagtttaattagatcccatttgtcagttttggcttttgttgccattgcttttggtggtttatacatgaagtccttgcccatgcctgtgtcctgaatggtattgcctaggttttcttctagggtttttatggttttaggtctaacatttaagtctttaatccatcttgaattaatttttgtataagatgtaaggaagggatccagtttcagctttctacatatggctggccagttttcccagcaccatttattaacaagggaatcctttccccatttcttgtttttgtcaggtttgccaaagatcagatagttgtagatatgcggcattatttctgagggctctattgtgttccattggtctatatctctgtattggtaccagtaccatgctgttttggttactgtagccttgtagtatagtttgaagtcaggtagcatgatgcctccggctttgtttttctggcttaggagtgacttggcaatgtgggctcttttttggttccatatgaactttaaagtagttttttccaattctgtgaagaaagtcattggtaggttgatggggatggcattgaatctataaattaccttgggcagtgtggccgttttcacgatattgattcttcctacccatgagtgtggaatgttcttccatttgtttgtatcctcttttatttcattgagcagtggtttgtagttttccttgaagaggtcgttcacatcccttgtaagttggattcctaggtattttattctctttgaagcaattgtgaatgggagttcactcatgatttggctctctgtttgtctgttattggtgtataagaatgcttgtgatttttgcacattgattctgtatcctgagactttgctgaagttgcctatcagtttaaggagattttgggctgagacgatggggttttctagatatacaatcatgtcatctgcaaacagggacaatttgacttcctcttttcctaattgaataccctttatttccttctcctgcctcattgccctggccagaacttcccacaccgtgttgaataggagtggtgagaagagggcatccctgtcttgtgccagttttcaaagggaatgcttccagtttttgcccattcagtatgatattggctgtgggtttgtcatagatagctcttattattttgagatatggtccgtcaatacccagtttattgagagtttttagcatgaagggttgttgaattttgtcaaaggccgttctgcatgtattgagataatcgtatggtttttgttgttggttctgtttatatgctggattacatttattgatttgcgtatgttgaaccagccttgcatcccagggatgaagcccacttgatcatgctggataagctttttcatgtgctgctggattcagtttgccagtgttttattgaggatttttgcatcgatgttcatcagggatattggtctaaaattctctttttttgttgtgtctctgccaggctttggtatcagaataatgttggcctcataaaatgagttagggaggatttcctctttttctattgattggaatagtttcagaaggaatggtaccagctcctccttttacctctggtagaatttggctgtgaatccctctggtcccggaccttttttggttggtaagctcttaattattgccacaatttcagagcctgttattggtctattcagagattcaacttcttcctggtttagtcttgggagggtgtatgtgttgaggaatgtatccatttcttctagattttctagtgtatttgcgtagaggtgtttatagtattctgtgatggtagtttgtatttctgtgggattggtggtgatatcccctttatcattcaatgaaactttttacaaataaaaactttactactttactcaaaaccctgttatacaaaacagagctgatctgctagggagttagaagccccaactgcttacctaacccttccttctcagagtcctcccagggaccttaaagctcaggagaacacagctggaaaatccctggactagatcccttaggtcccttctagaatgtaacaatttctgaatcttatattgataaatggagtggaatttcttaaaaacaattttgaggaggcaatgcagttttaaatacgtacgtattgtatgccatgctgtaacatattgctagatacagtgagcaataggaaaaggtaaacacagctcttcctttaagcagcacacttagaagagtaagaggggaacaaaagagctataacttatatatgatattatatgtattatatgtaatataatatataatatataatttattgttataacacaactcatactacatagagattgaagtcaacaagaattttctccctaaacataactacagagattaagaatagagaaaggaaaaggaaaggaatgcgtatgttttaattctgcaaaaagttcgggcacagtggctcagcctgtaatcccagcagaaggataacttgagctcaggagtttgagatcagcctgtgcagcataatgagaccttgtatctacaaaaaaattttgaaaattagccaggcatggtggcgagcacttgtattcccaggtactcaggaggctgaggtgggaggatcacttgatccctggaggtcaaggctgcagtgagccacgatcaaaccactgtaccccagcctgtgtaacagagcgactgcctcaaaaataatatttgtcaaaatagcttgtctttgtatcactgccacattgcttgtttgaaacgaagctgactcactttgttatcataagtgatcttaccaaagaccaagttgtccagttgccttggagtgtaggtcatgcgttgccggtaccctggggctgtgtacaatggccaggctgaggggaccttgtggttacccccatgggacttgtaacttgtcaagtgggaaggtggtaccaagtgaagaagggtagggtccttggttttggcctcacctggttcttcccagaatgaatggtgaaaaaattataattctgcagaaaaatttaaattctattttgtttactttttggatgggagataggtgtacacatggcactaaaattcaaaaggaacttaaggaggccaggcacggtggctcacacctgcaatcccagcactttgggaagccaaggcgggcagatcacttgaggtcaagagttcgagactagcatggccaacatggtgaaacccccccgtctctactaaaaatacaaaaattagctgggcatggtggtgtgtgcctgtaatcccagctacttgggaggctgaggcaagagaatcacttgaacccaggaggcagaggttgcagtgagcaaggtcatgccattgcactctagtctgggcaacagagtaagactccaactcaaaaaataaaaataaaaacagcggcttcctctaggaagtggggctggaagatttttactttttctgttatacttttgtactattgcaagttttaaaatcatgtatttcacagtaaatccagaagaaattatgcacttaatttttctgggtgaattgtgttatagaggtaatagaggattattaaaatttctttctttttttttttgtttcccagatagcagaccccacgttagctgaaatgggaaaaaacttgaaggaggcagtgaagatgctggaggacagtcagaggtgagtaggacagaggtgaccctgttcaacgagttcagcctgctgtgaagccagtggctctgggtcctttctgttaaaggtgcctcttggcttcacagtgtcacacacagctttggctgacttgaaaattggtatttgtcttgggtaaaaggtgccttgtaattaaaggattttgaaattgagaggaaagacttatactatttaattctgtctattaagagtttcatttacttaatatattgatttgactctataaatacttattatatattcaggtcatatagagcaccaagtaaacaagaagtgggtggaacttttttgttgcatattcttgtcttttccagaaattcaaacgatacctgaaactggaggcagggagatgtgataaatgtgtttgaaatcctgcctcagtcactgggaggttataggcaacatggtcatgtttgcatattcaggagttagaaatttggtatgatgaaacaaatgaacagctttttcttttctttaaattagaagaacagaagaggaaaatggaaagaagctcatatccggagatattccaggcccactccagggcaggtaggtggcactgaggatccatacctttagttaaggtgtaaatttttgtttgtttctgagatggagtcgtgctctgttgcccaggatggtgtgcagtggcacaatctgggctcgctgcaacctccgcctcccgggttcaagcagttctttcttgtgcctcagcctcccgagtagctgggattacaggcgtgcaccaccatatctggctaatttttgtattttcagtagagatgggattttgccatgttggccaggctggtttctaactcctgaccttcacctcaggtgatctgcccacctcagcctcccaaagtgctgggattacaggtgtgagccactgtgcccggcctacatttttcttaaaccagtgtcttatcatcattgatttatggttttagttttaatgaacacatagcaaatttaaatagacttatgtgcagtataacattagaaaactgaagtgtcgttggctggttggtgatattgctgcacctgctggcttctctccctctcccatttggaatttaatagatgctaagtacagtgggtcacatctgtaatcccagcactttgggaggccaaggacagaggatcacttgagcccaggagttcaaggttacagcgatctgtgattgtaccactgcactccagcctgagtgatagagacactctctaattttgagacagagtctcgctctgtcgccaggctgaagtgcagtggtgtgatctcggctcactgcaacctctgcctcccaggttcaagtgattctcctgcctcagcctcccgagtggctgggattataggcacccaccaccacgcccagctaatttttgtatttttagtagagacggggtttcaccatgttggccaggacggtctccatctcctgacctcaggtgatccgcctgccttagcctctcaaagtgctgggactacaggcataagccaccgcacctggccaaaaattttttagaaaaccaacaatttaatacaacctcatgagtcaaaagtgatacatggagctaggcaccgtggtgcacacttgtagtcccagctgcttgggagcctgaggcaggaggatggcttgagtcaaggagttcgaggccaccctgaacaacatggcgagaccctatcaaataaaataaaagtgatatacaaattcatcattataactggtgtgtcatacttagttcactcttgaaacctgtcatctatttggtagactgagttttattctaagaggtattttaatttgataagatttattgttttcataatgtaaatgaaaggaaaatgtcaaattacttattttttggcaactgaagcaaatctgtcatgtttgagtaggaggaaaaatagcaaaaaagtaagtagctgactaaaattttcacaagacattagcagttaatctgggattagtatcccagcccagcttccctgagacaaacttttttttttttcctgttataaccaggaaactgcacataagtaaacagtacaactcccttaaatatcctttgacttgaatataaattgaaccaggttgcaaaagaaaagtatggaggaaggatcacagtgtgccaataacacgctgagatactaatactttaaaagtcactcctattcgtagcatgaataatgctgatgtgaagctaggtgtgaagtgcattctcagctcagaacaggaggcaggccctataaaatctcctcattccaggcctactgatggaaaccaaaggttttaaggtttagtctcctaattccacggaagttttcccaggggagatactcccagcagcatctgtaattctcagccttaagccactgactaggaggattcacacttaggagtgctaccacccagcattcaagactagtaacatgccaggcacagctaagtgccataccttcactgtctgaagcctcccaaatccataacgtccggcttggcaagttggaatagcttgctcgaggtcatgtggcaggcagccagtgtgcctcaagggcccctgcctgctctgatctctacagtgtccaaggcccagagcccctctcacttgaagggcagcaccttggggacaattggtttggggacactgttttgatggcgcttcctttgttgaaagaggaaacctctttttagtctattctcattaacagacgaatagccctgcgttattcctgttgcaagttgccttgccattgcttgctacttcagccgttcgaattcttttcgtaactttccatctcctcatgtaatgagcatttcatagcaacacatcttggatagaagtaaaatgtttttatactctaagcagatctcaaggttcccagcttggggaagagctggtaataaatgaagcttgcattgttagaggctgttagtccaaacggacaagatccctatggaggaaaattagatataccagtggcattggagtgttctgtgactgtctagcattatactatactaaggatgattatatattatattttatataatatattttatattttatataatgtatagtatataatacacttatatattataagtacatattataaggcctttttgctcttattacatgcttattaaatattctctgtcttgtactccaagattcaaatgaaatgtatagaaatgttgctagagcaagactggtggctgggcaaggtggctcaggcctgtaatcccagcactattggaggctgaggcaggaggattgcttgagcttggtggtttgagaccaggctgggcaacatggcaaaaccctgtttctaccaaaaataaaaaaacggctgggcgtggtggctcatgcctgtaatcccagcactttgggaggccgaggagggtggatcacttgaagccaggagttgaagaccagtctggccaacatggtgaaaccccatctctactaaaaatacaaaaattagccgagcgtggtggcgcaagcttgtaatctcagctactcaggaggctgaggcaggaggatcgcttaaacccgggaggcagaggttgcagtgagcccagattatgccacttccctccagcttgggtgacaaagtgagaccctgtctcaaaataaataaataaaaataaaaagactggtgacatttattaaaatgaaactcataattaggtagaagatttatttaaccacaagtaaatttatatcggaattcagtttataatttgagctttgttttttaaaaagcataaactatataccacgttctttctcttatagttgcttaagaaagaaaaaaaaaacttgaagcaacgctagttgaatgagggaagtagcgggagagtggcgggggatgtgtgctgttcccatcagcccatcaactctttttattctgcagtgggcaagatatggtgagcatcctccagttagttcagaatctcatgcatggagatgaagatgaggagccccagagccccaggtaatgaacctggcagcttctcttttcaagtgtatgtgttcttgatttcagtagtgattgcgctctgacaagttgctcaaataagaagctatatttcattgagttacatatgatattaaaataatcctttttattttcagaaagacatttatattaatatatattttgtgaaatgaaggcatttattgaaattagatcccatagtttttatggtatcatgccttagagaggcgctggcagaaggactgaagagtgagtgtcggatgtctttctgctgctgtgcttctgcttcctaagaattgctgtagttgtattcattaggtatttagttagttttctcttcaattattttaaatttaatgttttgaaataagtaaaattattctcttggttcaaaattcagacaatgaaaaatgatatacaaagggaattttccttcctacctctatctccctaccatgttttcttctctagagacagacattaccagtttcttgtgtattcttccagagagattttatatgtattatacaccagcaaaatgtctatgcccaccctctctaatacataattactatgcatatgctgtgcatcttgcattttttcacttatgtcttggagttcactgcatattaatgcacaggaactttctcctttgtcagagctatgtgttttactttgaacagatgaaccatattttattttattggtcccctgtcatgttgcactgttacaaacattgctgcagcaaacaactttcgacatgtgtcacttctcatagaagcaggtgtctggaggacaaagtcctgaaagtggagttgctgtctcagacagtgtgtgcttttgtaattttgatagatcctgccaaatttccctccatggagttgcggcatttagcagtcccaccagcaatgtatgagagtactttatttccacacttttcacctgcaaaggcgttatcagactgaaggatcattgataagtgatattctgatgagaaatctgataagtgagaaatggtgtttcagcataattcgaatttgcaggttttttaaattatgaaccaagtgacgtgtctttttgtatgttttaagacccatttatatttctaggaactgtctgttgcccatgatcctattaggtgatttgtctttttcttattattcacagttaacaattgtaaactttttccttcttttttacagttattctttataaggaaaattagttttaattctatataaaacattttatataatcaattttaattatatataaaataatacctagtcccccatgaatttgctgtattattgcaataaataattcttatttgatgcatagacctgagatttaattcttttttttttttttttttgagatggagtcttactctattgcccaggctggagtgcagtggtgccatttcggctcacttcaagctctgcctcccgggttcactccattctcctgcctcagcctcctgagtagctgggattacaggtgcccaccaccaggcccggctaattttttgtatttttagtagagatggggtttcaccatgttagccaggatggtctcaatctcctgacctcgtgatccgcccgccttggcctcccaaagtgctgggattacaggcatgagccactgcgcctggccaggatttagttctttaaaaaatgctttcagctcattttaccttagctctaccctccacaattcttaaggctggtatttaatttttaaaatactttaataggaaattattttaaaacagtttgtaggtactcaatttaaaaagggctatttatctcctggaactcaaattataaaaatatttttctggccaggagtagtggctcatgcctgtaatcccagcactttgggaggccgaggcaggtgaatcacctgaagtcaggagttcaagagcagcctggccaacatggtgaaaccccgtctctactaaaaatacaaaaaattagccgggcttggtggtgcgcgcctgtaattccagctactcgggaggctgagacaggagaatcacgtgaacccaggaggtggaggttgtagtgagctgagatcgcaccactgcaccccagcttgggcatcaagagggagactccatctcagaaaaaaaaatatatttttttctccatctcaaaaaatagaaaaaattctcaccaaactatcactactgtttatgcattgatttgccttctgggccattaagtagatttcgagtctgacagatatttctgtggaattctgtgtctctaagttctatgtccttttttatggtttgactctaatactttaattttgcttaacagaatccaaaatattggagaacaaggtcatatggctttgttgggacatagtctgggagcttatatttcaactctggacaaagagaagctgagaaaacttacaactaggatactttcagataccaccttatggctatgcagaattttcaggtaaagacatgatgagtttccagtgaagacttttatgagtcgggtgtagactgaaagatcttttttctggagctgtactacttgggttcagatttccttctccttgaaaggggtgtttaacctctcaatgcctgtttcatcatctgttagatggggatagtattaatacctatttcatagaagcgttgtgaggattaaatgagctaatggactaatacatgtgaagggtggagaatagaagcacatatgtgtttgatagggtcagcagttatttatttgtggggtatctaattggcacatgtcggtagaagatagagcaatgatctggattcaaatacagttgtcccttatccttgggtgtccttgggggattggttcttgacctcccatcctcaccctatggataaaaaaattcatggatgctcaaatcccttatataaaatagcacagtattttcatgtaactgaggcacatcttcccatatactttaatctcttgattacatataatacctaatacgatgtaaatgctgtgtaaatagttgttacactgtattgtttagggaataatgacaaggaaaaaaagtctgtagatattcagtacagaggcacccatctttttaaatttctgaagattttttactcatgcttggttgaatccacagatgcagaacccataggttcagagggccagctgtgctttgaaaatattagcttgtgtttttattagaaagaaaactctgaggccaggcacggtggctcacgcctgtaatcccagcactttgggaggctgaggtgggcggatcacaaggtgaggagatcgagaccattctggctaacatggtgaaaccctgtctctactaaaaatacaaaaaaattagccgggcgtggtagtgagcacctgtagtcccagctcctctggacgctgaggcactgcactccagcctgggcgacagagtgagactctgtctcaaaaaaaaaaaaaaaagaaaactctgtcataaggaagatgaaaatgtgctatgaaactgaaatttgttttattctgtgataatcctggcagtactaaggaattacaacaggtgaaggattcagtaggagacataggactagtggcattgggtttatgctgttacttttatggagaaggaatgtttgcctaacttgagacatttatcttgagagaccctgactttcagtgttgggaaagaacttggccaagcaggagtataagtttgcccaactttattaaaggagcagtgttctgttgttctagtaaaaatctactgcctgtaattgaaattgtccatcctcctctaggagatggagcctcagcagattatagtaaaaccaaaagctagcctgactagcttttttatttttttgagatggagtcttactctgtcacccaggctggagtgcagtggcacaatctcggctcactgcaccctccacctcctgggttcaagcgattctcctgcctcagtctcctgagtagctgggactacaggcactcaccaccacacctcgcaattagtagagacagttgtttcaccatgttagctaggctagtctcaaaactcctggtcaggtgatccacccgccttggcctcccaaagtgctgagattacaggcgtgagccaccacacccagcctctaactagcatttttgacagttttatttactttggatgttttagggctgaaactctgctatgaactatgcctgtgttatccagtgctggccttagttcataataagccagaaccatgatcttcaggctttttatatctgagaattcctggtctctacttgttttcatagtttctgctctttatggaattgggtatggatggagggttattgtctcgctgcttggtaacctcagctgtaatgaggtgtcagccatctatgatgaggatgtttcacattcctgtcctctctgcctgataaaagtgacaattcctagcttgagaaaagaattgtctccatgattataaggttgacttatacaatccttaactagaaataagagcatattaatatgtatctcttaacagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggtaatgtggtatcaggtggctattttaaagaaataatgtcttattttgttctgaaagttttaaagttgacccgtttgtctagttgctgttcttgctgagtgaaaagaaagatggtcttatatgcttttgtcatatttgtaaaaattactgaatttagaaataaggaatatgggatagattacccaggggcatccacagtcaacattttctcttttttcccagactttaatcgaagggggtgtgtttgtgtttatatggttgtatctggctcttttcacttattgttaaaacaggaatatatcattttaataataatttttcaaagtatagtttatttttaatgtcttcatggtattccttcaagtgaatatatagtaattaactgttgcccttttggacaactaagagtgtttgcattctcttgctttctgtgaccattttcaggtaatgttctttgtgtagtgctgttaaggacttctctgtgcataaagctcttcctgtattttatttagggttatggtcctcagatggattttcagagtcagtctagaattgctggatcaaagagcatgactttttttttttttttttttttttttttttttgagacagagtcttgctctgtcgcccaggccggagtgcagtggcgtgatctcggctcactgcaagctccgcctcccggattcatgccattctcctgcctcagcctcccaagtagctgggactacaggtgcccgccaccacgcccagataatttttttgtattttttttagtagagatggggtttcaccgtgttagccaggatggtgtcgatctcctggcctcgtgatctgcccacctcagcctcccaaagtgctgggattacaggtgtgagccactgcgcccagccgagcatgactatttttaaagttcatggtgcttctagcccaactgggaggactacatcgagataagacattgttaaccgtctttgccaagaacgtttgaaagcaaaaccatagggttggagggttcctcttttgtaagctgtaggagtcccagggggatgtatgggagacacttagtgacttttaaattgattctgagctgtgatcactggtgttaagaaattatgtcctcttcttgaggggtgtacaaaatggggagtttaataataatcctctgaaacgtgaaatgaattacttagtgtctactgcaagccaggctcttgcagacacaaggctgtttggggacaacagtctaaccttcaaaagatgtgtaagagtgttctgttgggaatggcagctggcagagcagcatatataagatggttatgttcacgttttttaaagtgtgtgtatcctttatacctatgtttttgtacctagaaaaatacgtaaatttatacctagaaaatatctgaaaggttatgtattaaactgttaacggggtggattggtggcttatagggtagggggctaggcattttcacttttaatacctgtattttttttgaggatttgttttacttgggtgtcacattcataatttttaatcctttaaggagaaaaatgtgcttattaaatttttggtctctgaatgctaccaagtcttagtcatacagaacaatatgctgcaactgtttacaattcctaaaactgtaaactcctcaaggacttggaggctaaacatgaagaatataaaattaagttgacaatcactgtctcctgcataacactgacttcacttctcttgagaaatgtgcatctgctaatccatatttattactttttaggggtgggtgaacccataaataagatactgttctttgaatgcctttagctggtgttatttaccagtaatgcttggagaaagaatccaaaattacccccactaaaatgctcacgacccagttgtttctgtgtttgtcaaagtgtttctggtatattctagaatataccaaagataattacttgaatcatttagaaaattttacattatatcctcttataaggcacttggaaattcacccttttttttttttcggcttggctttctaaatgtactttaacatcaatttataatattaagagttcctaaggagagagatttcttagaagaataatcgtgtcttgtcttagagccacagcctttcacaatctgaagtgaatggtgcagagagctttcttgtcaagtcatatgtttcttcctgcagctcggcttgcccttcccctgcttgtgccgtgtaccctgtaacactgtgtttggatcccagcatcagatggtgagttctacttttggtttgtaaaatcatgtgggattgtgttttgaaactgcctttcaaatgaagttctttttgctggcctccagataattagtaacttactcatgtattgcttggatccttacattgtgtaatatatgcttctgttaatatgtgaatgtccatgaaggttggttggtatataggtcaggagcacctggcttttaaggagtcttgtaattactgtatcacctgctttaagtagaaacatggcagctcaattaagcaccagaaatttcttctgaagctcctacttttaatgagttagcactgttgcctggatttatgaatgggcagattttgaaaatgaggttcttcattgtcatcatggaattgagttctgcttattttcagacatgcaggtgataaatctctccttaatgattccagaaggaaaaggaagggatggattttagagttttttatttcttttgtcaaggtagttttattttctagttcaggtacatcagtgagtaatagtagagatacattcttggctgttttaggagagttaagagaacatttcatttaaatgtaaatgtttaaaatcaaagaaatgttcctgcatatgtacagtttttacctttaattttgtttaactgatttttctagtcttcaaggaaaactatttgattttcacatctatgatgagagaaaacagaaaaattgtcaagagtaagaattgatttgacattacttttgagagttatctgcttcttttgtaagtcataatttttcattttatagcttttatactgggcacctcattttttaatgatttgttttggttccaggatgttgccttcctggagaaactgattaaagatgatatagagcgaggaagactgcccctgttgcttgtcgcaaatgcaggtaggtagcatgatgctgaatctaccattttgaatatataggagcgaggctacgtcctcagcctataaaagataaagtcttaagaaatgtgtgtgtaccacatgtttaagatagtccatatccacattgtagcaaaaactgtaatagtaaggttggctcgttagatttttctttaatcgttggtttgttttggaagttattttatgtgtgtgtatactttttcatttagatggtaaatgcttctctatcttctccttcatgtacttcttttccctgttctaaactgaattttattttatttttttgagatagagtctcactctgttgcccaggctggagtgcagtagcacaatctcacctcactgcaatctctgcctcccgggttcaagtgtttctcctgcctcaacctcctgaattgctgggattacaggtgcatgccaccacatctggctaatttcttgtatttttagtagagacagggtttcactatgttggccaggctggtctcgaactcctgacctcaggtgatccgcctgcctcagcctcccaaattgctgggattacaggcatgagccactgtgcctggcctgaatttttaaatgacacatttaagccaggtgtggtggcacatgcctatagtccctctactcaggagacaagcaagatgttggcttaagctcagaagttcaataccagtctgggtaacatagcaagaccccatctcaataaataaataaaaataattgtactgacgttgtaagattgttgtaaaaattaaacaagaaaattcataagatgtcacacttaaatatctaccttataggcggcagagcaactaccacttgctgctccatttatctcattcagcatcatacttgaaatctaagacagtgcaataaggcaaaaaaaataactgacagattagaaaggaagaaataaaactttgtttgcaggcatgattgtatagatagaaaactaaagaaaagctactggaactaatgatcaaatctaaaccattttctggatttttacatactagcaaagaagaattggaaattgaattttaaatgtcatttataataggatcaaaaaagatgaaaaatttatggataaatttaacaaaatatatgcaagatctgtacattgagaactaagaatgttactgagagaaattcaagaagacccaagaacgatatgccatacacacgggttggaagactaagtattaagtcagttcttcccaaactaatctgtagattcaacttgatccatcttaaaatctcagcaggctacaatttcttaatagaacttgatgagctaattctaaagtttatatagaaatacaagggatctaggaacagcccaagggattttgaaaaagaacaaaattggaagacttaccttgtcatacttcaagacttctgtaaagtagcaagtaagactgtgtgagattaaccaaagaaaatagagaattcagaaatagactcatgtgaagtatatggacacttcaggtttttacagatgcctgagtaattcgagggagaaaggaccatctttttccatcagtggtcttagagcttggatatccatatggaaaaaaactgaatcttaacccttatcttattctctgtatatataaatattaactataaatggttcatcaacctaagcatagatctaagacaataaaatgtctcaaagaaaatacaggagatctttgtgaccttaggttacatttcttaggatacaaaatatgtgaaccataaattgtactttatcaaaaattaaaagcattagctgtttgaaagcccctattaagaagatgaaaggcaagttacagactgggagaaatatttgcaaaacatttttttctttttttttttttttttttgtctttttctatttttattttttatgtttttgagatggagttttgctgtgctgcccaggctggagtgcagtggtgcgaccttggctcactgcaacctccgcctcccaggttcaagcgattcgcctgcctcagcctcccgagtagctgggattacaggcgcacgccaccgtgccgggctaatttttgtatttttagtagagacgagatttcgccatgttggccaggctggtctcaaactcctgacctcaggtggtccacctgccttggcctcccaaagtgatgggattacaggcgtgagccgccacactcagccagccactgtcccagtcctgtcttcttttaaaatttctttttcattcttttccccagaagctacaaaacatttgtttgacaaagaacttgtatctaaaatatataaagaactgttacaactcaataaggacacaagcaatacaattttttttttttttggagatggagtctcattctgttgcccagactagagtgcagtggtgcgatcttggctcactgcaacctctgcctcccgggttccagtgattcttctgccttagcctcccgagtacctgggattacaggcatgtgccaccacacctagctagttttttgtatttttagtggagatggagtttcaccgtgttggccaggctggtcttgaactcctgaccttaggtgatctgcctgccttggcctcccaaagtgctgggattacaggtgtgagccactgtgcccggcccacaatacaattttttaaatgaacaacagatttgagcagatacttcatcaaagaaaatgaaaatgtatagcacttgaaaagatgtttaacatcattagtcattagtgaaatgcaaattaagatcaccatgagacattactacatgtctgttagaatggagaaattacaggtggctcacacttgtaatcccaacacttgggaaggctgagactgcgagatcaattgccctcaggtgttcgagaccagcctgggcaacatggcgaaacccctaggaaatctctacaaaaaatactaaacattagccaggtgtggtggtgtgtacctgtagtcccagctactccagaggctttggtgggaggttggcttgaacccaggagagagaggttgcagtgagccaagattgtgctaccataccccagcctgggtgacagagccagatcctttcttaaaaaaaaaaaaaaaaaattctttaaaatataatgtcaggccaggcacagtgactcaagcctgtaatcccagcactttgggaggccgaggcgggcagattacgaggtcaggagatcaagacatcctggctaacatggtgaaaccccgtttccactaaaaatacaaaaaaatagctgggtgtggtggtgggcacctgtagtcctagctacttgggaggccgaggcaggagaatggcatgaactcgggaggcagaggttgcagtgaggtgagatcgcaccactgcactccagccttggtgacagagtgagactctgtttctgtaaaaaataaataagtaaataaataaaacttgccaggtgtggtggtgggcacctgtagtcccagctacttgagaggctgaggcaggagaatggcttgaacccgggaggcggagcttgcaatgagccgagattgtgctactgcacttcagcctgggcgacagagtgagaccctatctcaaaaaaaaaagaaaaaaaaaaaaaaaggcaaaaaactacagtgacagaagcagatcaggattttccagggccagtgaggagtcagggaaagggtaattatattggggttgatgggatttgggggttgatggaagtattctgaatcttgattgtgttgatggttacatgctctatatatttgtcaaaactcattggaccgtatacttacatgagtgagttttgttgcatgtaaatcatactacaataggccgagcatgagagctcatgcctgtagtcccagcactttgggaggctgaggcaggcagatcacaaggtcaggagttcaagaccagcctgaccaatgtggtaaaaccccatctctactaaaaatgcaaaaattagccaggtgtggtggtgtgcacctgtagtcccagctacttgggaggctgaggcaggaaaatcgcttgaacctgggaggtggaggttgcagtgagccaagatcgcaccaccgcactgtagcctgggcgacagaaagggtctctgtctcaaaaaaaaaaaaaaaaaaaaaaatcatactacaataaaactgcttatttaggccgggtgcggtggctcatgcatgtaattccagcactttgagaggccaaggcgggaagatcacctgaggtcaggagttcaagaccagcctggccaaaatggcgaaaccctgtctctactaaaaatataaaaattagctggttgtggtggcaggcacctgtaatcccagctacttaggaggccgaggcaggagaatagcttgaacccaggaggctgagattgcagtgagccgagattgcgctgctgcactccggcctgggcaacagggtgagactctgtctcaaaaaaaaaaaaaaaagacaaaatagaaaaaccacataaatattcactttattgccaacaggaaaaccatcacttcctgccttattgtttaaaaacacaaattcacccatattcaatcacatgataaactggaggggctgcagtttgcatgtgactgagtgacttgccagtgtgattatgttgcagatgtcagcagacacatgtcaagggttagtcaccagacattgccaagaaatacgaaaagagaatctgcatgcgatccaggcactaacacagcagtacgcttttattttgctggaagagcctgtggcacagcccatgcattgacatttgatcttgtttcagctaaactaaatgtgtctgttaagattttttttttttaatttgaggtagatttaggtatgaggggaaaaagttttcagcccttttcctggcatagaccttacaaaagaactactttctttagctgtgtttgttgaggccgttggtgagtgtttgaaatctttttagttggcttactgctaactggaaatttaggacggttgggggaatgcctgactcaacgttttaactaagctctctctgaaaagggatctccccagcaaaatctgtagtgcaatcaattaccaagggagcggctgaaagtgcttaatatgcttaagctggcttcagaatgcatgttctgtattacaaggaacctgggtggaaacaaaacaaattcatctatatgttttgtttgtttgttttttgagctggagtcttgctttgttgcccaggctggagtgcagtggcacgatctcggctcactacaagctctgcctcccaggttcacgccattctcccgcctcggccccgcgagtacctgggactataggcgcccaccactacacccggctaattttgtttttgtatttttagtagagacgggatttcaccgtgttagccaggatggtctccatctcctgaccttgtgatccacccgcctgggcctcccagagtgctgggattacagatgtgagccactgtgcccagcccacctatatgatttttataaagggcatatctaaatcaaaataatccaggaagtgacaataaaataaaaaggtggaaaagtttatcttggacaaatgctgacaaaatgaaagtaccatagccatattagtgtgggataaaatagacttcatattgatgaaagatgtaatctcctaaaagaaataacagttatacctgctgggcacggtggctcatgcttataatcccagcactttggaaggccgaggcaggtggatcacgaggtcaggagttcgagaccagcctggccaacgtagtgaaaccccgtctctactaaaaatacaaaaaaattagccgggcgtggtggccaccgcctgtaatcccacctacttgggaggctgaggcaaggagaattgcttgaacctgggaggtggaggttgcagagttgagatcatgccactgcactctagcctgggcgacagtgtgagactccgtctcaaaaaaaaaaaaaaacagttatgaatgcttgtgaacataactttaaaatatataaaggaaagctaaaggaaaagtctgatgtaacacaagtatatattgacaaaccacaatcttggtgggagatttgaatatatttctcatgagtcagcagatcaagtagatagaaaataagtatataaaagaattcaatgacacaattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtgtttaaggtataaagccttagaaaacatttgttccttttaatgccctgatgtgttttatcctaggaacggcagcagtaggacacacagacaagattgggagattgaaagaactctgtgagcagtatggcatatggcttcatgtggaggggtaagccggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaagaatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaagtcactcagtccctcatggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttggtaagtttccactcactggggagggagtgggtgtggctaatacacattattggctttgggggcaaaatccagaaaaatacaggaaaaagtgaaaaatacccataatttcacttctatttcatttttttaaagagaaacttgtgagactttttttaatgacattttatgattgtataatattctgtcacaatttaattattctccatttatgaacttataggatgttttcagagttttgttactgaaataatgaagcagtgaacgtctttctgtgtttctaattatttccttagaataggttcccagatgtggaatgactgagtgggggagttttaagcctcctgatccacattgcccaataggttttaactttttttttttttttttgatatggagtctcgctctgtcacccaggctggagtgcaatggtgagatgatcttggctcactgcaacctccacctcctgggttcaagtgattctcttgcctcagcctcccaagtagctgggattacaggcatgcgccaccacgcccggcttattttgtatttttagtagaggcagtgtttcaccaagttggtcatgttgaactcgcgatctcaggtgatctgcctgcctcggcctcccaaagtgctgggattacaggcatgagccatcacacctggccacatttttttttttttttaatcgtagttgtgggccaggcatggtggctcatgcctgtaatcccagcactttggaaggttgaggcaggcagatcgcttgagcctaggagtttgagaccagcctgggcaacatggtgaaacctcatctctataagaaaaaacaacaacaaagaattagctgggcatggtggtgtgagcctgtagtcccagctactcatgaggctaatgtgggagggctgattgagccctggagatcaaggctgcagtgagctatgatcacaccactgcactgcagcctgggcgacagaatgaaaacgaaacctgtcacaaaaaataataataataatgtggttcttgataatataggtcagcgtgcaaaataaggtttaagtgatttctgctaaaacactgctgtcttgctcagctaataatggccaggtgtttgaggatgctcagagctaccttcgaagtggggagtctcctaggttctgggatgtgacccatctgggttttccactggcttttcctggctttgccactcctgagctgtgaacccttggacaaaccgaggtctctgagtgaagttacctagaatacttagctcacagagttgttggaagatcacatggataatgcaagcctagtgactagtatggcatctagcccacactaagtgggtagcaaatggtagctggttagttctattatgagattgcaatggctttgattaataaacctcttttggcttttttagactttagttgctggtcttacatcaaataagcccacagacaaactccgtgccctgcctctgtggttatctttacaatacttgggacttgatgggtttgtggagaggatcaagcatgcctgtcaactggtgagtagaagcctgacatttaaatgaaagactccttggccacagcagagacagaaaaacatctcatttctgtaccttccatccagagtggtgttgtctggattgactgtctcgtgagccagagactaatcgccctgcatgtaaatatttcttgttcaaagttctgggagaaagtgctgggttgtctgtcccagcatttgtgtgcagatgaaatcagatgaaaaggaacaccactgtcagcatgggatcagaaaagaagtcacagatgacttccaaggagtggagaagggtgcaaaaggtggaggggtggggagcgagtgttccccttgattgactgactacggtgagggaataggaaggttacaaggtggttatggagggcatggatattttataaaccagctggcttgggtttccaaattgcagggctcttggggacaattctaattctctctccattttaggtgtgttctaattgtgaaaaatatataattatgctatatttcagtgttttagagcattcaggcttctataacaaaataccttagagtgggtaatttataaacaacagacatttattgcttacagttctggacgtgagaagtctcagatcaaggtgccaggagattccatgtcgggcccgttcctcatagatagtgccttgcatgtggcctcacatggcagaaggggtgagcacagtcccttgagcctctttcagaaggtcactagtcctgtttgtgagggttccatcctcatgccctaatgacctcccaaaggcctcaactcatttgcgattaggtttccacataggaattttgtggggacataaatattcagatcatagcatttagaaagcaaaaaaacaggctgggcatggtggctcacgcctgtaattccagcactttgggaggctgaagcgggtggatcacaaggtcatgagatcaagaccatcctggctaacacggtgaaaccccgtctctactaaaaatacaaaaaattagctgggcgtggtggcgggcgcctgtagtcccagctgctcaggaggctgaggccggagaatggtgtgaacccgggaggcagagcttgcagtgagccgagatcgcgccactgcactccagcctgggtgacagagcgaggctccgtctcaaaaaaaaaaaaaaaaaaaaaaaaaaaagccaaaaaacagggtcatgtttactcagggttagagctgagccctccctaagctcagaagtgcgtcacctccattttcttacctgtgaaatataaattatatgacaaggattgccaggatggctcgaggaacgaatacaggtagagctcttgcagtagtgtctgttcatatagtaagttatgcacgtgggttgaaatctttgttttaaatatattcttggggagttagcacttcctcaagtatcatttctatatttaagaaacataggtggccgggtgcagtggctcacgcctgtaatcccagcactttgggaggccgaggtgggcagatcatgaggtcaggagatcaagaccatcctggctaacacggtgaaaccctgtctctaataaaaatacaaaaattagccaggcatggtggcgggtgcctgtagtcccagctacttgggaggctgaggcaggagaatggcgtgaacccagaaggcggagcttgcagtgagccgagattgcgccactgcactccagccagagcgaaactcagtcttttaaaaaaagaaagaaaaataggccgggcgtggtggctcatgcctgtaatcccagcactttgggaggccgaggcgggtggatcacctgaggtcaggagtttgagaccggcctggccaacatggtgagactccgtctctattaaatatacaaaaattagccaggtatggtggcaggcgcctgtagtcccagctactcaggaggctgaggcagggagaattgcttgaacttgggaggcagaggttgcagtaagccaagatcgtgccactgcactccagcctgggtggcaccatctaaacacacacacacacacacacacacacacacacacacgaaaagtatttgcgtagtgctctagcagtagtcccttcgttcatcatatgttaggatagttcaacagttttaagtatgctctgggctgggtgcagtggctcatgcctataatcccagcactttgggaggccaaggcaggtggatcacttaaacctcagagttcaacaccagcctgggcaatgtggtcaaaccctgtctctacaaaaaatacaaaaattagccaggtgtagtggcacacacctgtgatcccagctactcaggaggctgaggtgggaagatcacttgagcccaggaggtcaaggttgccgtgagcccaaatagcactactgcactactccactccagcctgggcgacagagtaggaccctgtctcaaaaaaaaaaaagaaaaaaagattgatgctcattatgtttacaaaagcactgcattttttgaaaagtgtctcactgtgctattagctcacttcttgagatgtggttcttaggaaagagaagccttagtaacttagtttagagacgacttgggcactcgggagattttttcaatatcccgtggctatggagtgcgggagaatgatgccattaactaccagacccttgaggtcagcacagctctggcatcttcctgcaggcagaaccgtatactcctgaggatttgaatgctgtcctgctgctgactcacaggctaataaatgcatgtgttaaattacttggacatttagcagacatggtgatctgtatatagccatgccttatagtccacagtggagcatacatttcctgagagcgtaaatcagcattcgcctcctcatcctcctcttccttctcttctccctctcttctttctcgtcttcagtagttattgagcattcacctcagtgtcaggcaccatgaagtactttcatgcatcatctcatttgatccctgcaacttcactagaatgtcagttccactgatgacagtgtattcagaattaattttctttaagaaaacaaaaaggaatttcttgaggggctttctactgtccagtactcagtgaatatctgttgaattaatatactccaatcccatgagttagatatgattagtgatgagggacctgggattgagacattagtctaatgacactacattctagaccctgtttctaagcacttcctgtattgcatatcaactcatttaatcctcacagcaatgtgagatacatactatcctccccattttataattgagggaactgaagcatagacaggttacatagctggtgactggcagatgaattgacttatccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttacattgcaaatacaacagatttccatgtcttattagaaactgcttttcttgaattactacatgtaacttgaaggattggtgaatatttacagttgttgaaatacaaaaacaggtggctgaacttagaaaccaccaagtggcaggtgactttgcctgacatccgtgttcacagacctccacagcccctggtgaaaaccacttcttcatgtcccacgtccatctaattacatgtgttattttttgtcatttgcagagtcaacggttgcaggaaagtttgaagaaagtgaattacatcaaaatcttggtatagtatataagttcatctgttttcaaaatataactttttttgaacctcagcaactttgaatgattttagaactttagaatgattttctccacatttcagtggaattgtggcagctccagtaaaaaaacaaaacaaaaaaacgaaacaaaaaacaaaaacaaaaaaacctgcttatatttatacagtgagtctgaagcgaagaaatttgaaccatacaatgtttaattcctatggtgcttttcatgtacttcatttattgtgttaaagttcagaattgcacaaagataaacaccattgacttcagctgcccaaggccttgggcacactcttcttcccaaaatgaaaagtcactttgtgcctcagaatgctttggggttctctttctgcaaccttctgccatcagttttcatttgcatgaagtgggagaaagagaaaagcaaatggccctgctcttgtcttctgatatcttcctgaagtgaatccaacagattgttccctaggcataactagacaaggaaataaggacttaggagagaatggggatcagttcaggtttgaaagtttttgtgttttgcttcatggtattttagaacttcaggaaatatatgtcaaattctgatttaaataggttcattgagtgtttctttgacaattctgcaaggtatgcttaagtttaacatttgagtgtatttggggttcaagtcagtaggtttatttttcttttagaacatggtttggtttaaatacaaaaagtagccgcgcatggtggcacacgcctgtagtcccagctactggggaggctgaagtgaaagaattgcttgaacccgggaggcggaggttgcagtgagccgagattgcgcctctgcactccagcctgggtgacagagaccctgtctcaaggaagaaaaaaaaatgcatggtttggttgaagggggtgtggctactctgccttctgagtgggagtctggagccagttgacccgagttctagctcagtgggagttctatccttggacgaggaagtggaccactggagaagcagaagggatgaatctaagttcagaggcctgggctctgctctgagcagtgccacagggtggccctgtgacattgagtcattttctttccaagcttgactgtcaaatgaaagtatgccggttggtctcctctgattgcaaacagagaagcaaattatggcctagattgagcaagctgttaagaatccaggcggtgctgggcccatctgctttcctgcccctgccatgttgagcgcacttggcttttcctcagtcatcgctgctcccttattctcaaattgggggacccagtggtgctagttaatcaccagttgttttggagcatctctgtaggccacactggcccaggcagaaagcctgctctgtcccttcttccaatggctgttttttcagtagaggatacaataattggctaataccatgaggcattatggcctgtgagtcctcatcatcaccatcaccatcaccaccattccagctgctgcttgtgaaattcatgtgtggtactaagtaccttacatgaattatttcatttaaccctcccaacagtctcctttgtatgtgctgttctctctgcctggaaacactgtttcccaccccccgtccccaattcttctgtttatttttttttgagacagagtctcactatgtagcccagactggagtgcagtggtgcgatcttggctcactctaacctccgcctcctgggtccctgttcaagcagttctcctgcctcagcctcccgagtagctggggttacaggcgcatgccaccatgtccagctaatttctgtatttttagtagagatggggtttcaccatgttggccaggctggtcttgaactcttgacctcgtgatccacccgcctcagcctcccaaagtgctgggattacaggcatgagccaaagcgcccagcctccccagtcccaattcttctcatgactggtttcttatctttcagatcttaattcaaatctcacctcttcagaaaggcctttcctggccaccctaagatcatctcccaccgtcagacatcactccatccccctgggtcgtcttcatcactcttactactatctgaaatcaaatctgtttgttttttcctatagaaggtttgtaaaggccttatacagactcaccactgtgcctcacctgggcattaacacccaagaccctagccctgaaagcccagtgccaggccccagacatgctcccatcccctgccactcagcttacagtcctctttctgtttcctcttctttgtggattcacctttttttgggtgtgagcccagccatggtttaacctttttttggttcttggttatatttaatccagtatttcagatattcagaattgacaacttcagtgttcactcagtctatcacgttactagaaccagaagtgtctccaaccctgtatactatttcttacacacattgacatttgagaccactgagttcaaagaaagaaaagatgatcataatattcatagcagtcttggcactcacctcattctgccatctcctagctgaggatgggagaatgggcggattattttgttgcctttttgttcctccttgcttattgggcgtgcgcccctatttaaatattaagcaccgcccccctgccgcccgccgccgtacctttaaaagtatcacgttttatttgtctctgtgaaagttaaagatgatagatgtgaaggcacttagcacaggactggccccctaaataattggcagatttgaattcacatcctgcttggtatgaatactgtccacacggtcctttgaaaagttagtagaaaagatcttgggccactgcttcttgtctttccaagttagcatttcctgttgcggccctaccagtgagtcatcacactcagagccttggaacataagttttattactagagctatagtactgggattgttggatgcttagagatcttccccctccagggccacccacactcccctacagtaccacagagcctgccaaggacatggatgcttacggtaccctgaccccatggcttgaccaagtcagggtatactgtttgatgcaaaacaggaactcgctgctggattatcataatacataatgcagtggatgttttcaactgttaggaaacccactaatgaagttagtcgtcttcggcctgtctttaataataattaaatatattagaaaatacacagatccagttctcagctgtgcttgtctacatcaccagcaggacttgcatcttgttctgaaagttttgcaaaggggaggaaagtacttgttgccccctctttttttctatgagtatgaaaaattctagttggccaggcacggtgtctcacgtctgtaatcccaacacttggaaagccaaagtaggaggattaattgaggccaagagttcaaggccagcctggacaacatagcaagaccccatctctaaaaaaaccgtttaagtttcaataaatcctgcataatttctgggattcttgaaagcatgggctctctccgcactgagtctagtttcactgcttcttactggttttaatctttaatgttagacctatgtttatcccttattaaaatttccccctgctttaatttcaatgtaccagggtcaaacatcttataattcacagtgtactctcaaggctggctcatagttattttttaaaattttactaaacatttgatttttctctagcaactgaaattaacctctgaactttttagtgtgtttatttacaaatagagcatttctaagcgagtttttgaactcagcatttcattttgaaggcgtctggagtttaatgttacttggtgatatgagacttccattcttccaggtggaagatgagctcagctccccagtggtggtgttcagatttttccaggaattaccaggctcaggtcggtgaattttaaaagagggttattttcatatctgtgttaaaggctttgaatttgataccatttcaagttaaatagttcaaaatatttttattgctgacaatcttcagtcagcatttcagaaaaatgtaataattttcatgaaaactacagtccgaaacgccttagcaatttgctgatagtttgcggtgattaaaccaggggttcccaaatgccagtccctggaccagtgctggaatggctaagaaagagttgcttgaacataaagatttgtgggtcttacttcccacatattttgagtcaataggttgtgcccaggaatctgtatcttaaagaatgacccaagtgccaccagtctagtccagggcaccactctttttttacctggttggccattgtcccctgtcaactgacctctgactttcatacattctacacagcccattccagaccattctccacctggcagagagggttataagtggaagtcacatggtgttgaaaccggaaaggttcccttgtccccctcgcagggcatgtgatgggggtgtggctcgcttcttcagtgccccgctgctgctcagacctctaggagagcatacagacgggcaggctgtggggctccgaccccatggcagcatctgggggtgaatgttttacagctcctaaggctccagcgggcatgtgttacagtgtgctcttttaatttagccgtctgtaggcagcttgttttagctcacttagacccccttccttatcacaaggacagagggattaatgtatcccaggttcttgtcttggtgtaccggaagaatgggatcacatgtgggcttggagaatgagtgcaaggttttattgaatgaaagtagctctccgctgatgggggagccagaagggagacagatttcccttggagttgggccgctcagcggccctggccaaactccgcctcgtccccgtggttgatggcctgctggcttgccggggcctgtcggggtgctcttctgccggcctgctctccatgaccagccgcttgtgtctttttccaccaatgtgttcctctggccatccagccacttctgtctgcccactagggtctcaggtttttataggcccaggatggtggtgtggtgggccagcgtggtcttgggaaatgcaacatttgggggaaggcaggagtgcttgtcctcacctaggtccgtgggggtagagtcctagccagggacccgcctttctctccccagcacttcccttccccgcttctgtgtcatttaaagggaccacgctcttcccttcccagcactcccgtatcagtgtcacttccctgcccagagcccctgggtatcttaccatttcggtcgaacaaaggccaggctctcccatgccccatgaggcctgcacactctgccccgaattcgcttctgccttccccccttccactctccctcttgttcgttgtgcctcagtcagaccagtcttctccgcgctccagaacactctgccctttcctaccgcaagggcttaacactcggcgttccctctgtcttacacacatttctctcttctggtgccagctcctcctcaccatttcggtctccactaagtatccacatcctcagccttccctgcctatcgtgcctgaggggactccatcattttctatcagagcccccagcttcacttgtgacactaacaaccacatggagtgattttctttctttatggtctgtttcctcaactaaaatgtaagctccaagatgacagaaaccttacctgccttctgtcccaagtgtcgggctctgtgcctggcacgggttggcacccactgtgaggcctagttagatgatcgtggcactcacagacctcgcacggtgcttggtaaactagttagtaacttaaaacaattgctgtttccccttgaaatcccttgaaagcaaaccttttcaaaaatgaaattaataattctgtcttatgtgaatgtattcaagtgttacatagatcacgaggaaaaagaaatgtagcccttctgtcagataatacatgagaattcagtaatacgagtcagtgccctggggctaatattgggatgggaatgatgtggggtttggagggtgttttttttggtcagccgtgtttctgggagtgactccctttctgtgttttggtgtcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgcgttaccacctcacgagctgggtcacctctggcaagtccttctggcattgctccctcactttccttgctgctgtataaggctgtgagacaacaggcaaaaggtgggctgcagggcagctgcggtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcagttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaagctgctctaagtaatcagacagtcaaaagagcaggaatcagctctccaggaggctctttggtctggggccgaggggatgagggtgggtcctgaagacgtctgagtcccttgttacaggagggtgttcattgtgtcctcctcacagctgggagaacagctgaagcagctggtgcctgcaagcggcctcacagtcatggatctggaagctgagggcacgtgtttgcggttcagccctttgatgaccgcagcaggtaaaccaggcttggtggacatcccttgcttttgttctggggctgctgggtagattagcttgcccttatgatactccattctcctagagttattagcagctctttttggaggggcattttcttttcttttgggctaaatttaggtagattagcattcccatgtaacttaccagaatcagaatgagaattcagaagtcacctgaattggccgggcatggtggctcacacctgtaatcccagcaccttgggaggccaaggcaggcagatcatctgaggtcaggagttcgagaccagcctggccaacatagtgaaatcccgcccctactaagaatacaaaaaattagccaggcatggtggtacacacctgcagtcccagctacttgggaggctgaggcaggagaatcacttgaacctgggaggccgaggttgcagtgagctgagattacaccactgcactccagcctgggggacagaggagactccatctcaaaaaaaaaaaaaaaaaaaaaaaaagtcatcacatgaattccttttttgttgttgttgagacagggtcttgctctgtcacccaggctggagtgcagtggtgcgatcatggctcactgcagccttgacctcctgggctcaagtgatcttcccacctcagcccccgaggagttgggaccacaggcatgagccaccacactggactaatttttgcattttttgtagaaatggggttttgccacgttggccaggctggaattcctatattttgatgtcttgtgactctcgattttccactacaagggttctcactccccactgcacattagagtcatccgggagctttacacacaaccagtggccgcccacccccagagattctagaatggagcctggggatctgtgttttggtttttattttttttttagaaacagggtctcatttgtcaccctggctggaatgcagtgtcttcaccatagctcattgcaacctcgacctcctgggctcaagcaatcccctgcctcagcctcccaaggagctgggactacaggcgagcaccaccacatctatttttttttttttttttttttttccatagagacgtggtctcactctgtcacccaggctgctcttgaactcctggccttaagtgatcctcctggctcagattcccaaagcactggccactataaggattgcctggccacagctctagatacttagtctctaaaactgcaaaagtaagccagtgagccctgaggcccggcgctgtcaccatctccctgtccttcctgtgtggggacagcagcccaccacagtacttccctttctctcagtcataggaatgtacagaatctgtggttgcctttttgtgctgaacctatggtgtgatgtctccagcctgcctgaagtaggcttgctgtgggaagagtgatttctaacactggagtatgtcattgtgggccacatctgtgagagaaacactccacacctgctacagccagctgtgtctgtttctaaccctaattcttccatatctgtgttgagggcctttttttgtttaaatctccatggctcccggtaactggagtacctcgagcttttgaccttcccagtagtggaagagggagccctgccctcttgtcattggccatctcgtgagcatttctctgacattgtgaacatcttcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtaaagtcttggcctgccgcttgatgttggagacttttctgtataaagaacatgagtgggtcattttctgaaccaccttagaaatccaagatgaacgtgtagtcacaatatgcttaacgaaaatgcaactcggttttctgggcatttacaaaagcacagtgcaagcaggcaatttggccagcgtggcgctcagggaggggagttgctgaatgttctgtctgtaggtgccgactctcagctacctaggagaagatgccaacaggtatatatcactcactgagaatggttactatccagggcatatagagaattgcaaatcagtaagaaaaagaacccagctctcggggagagaactgggtgcagtcctatggctgctttctcgccttcagaggtgaggcaaacctctttttgtattgcccatgagacttccagaccttgtatggaactaaagacttaggctttcagctgggcacggtggctcatgcctgtaatcccagcactttgggaggccaacaggagcatagatgacttgaggccaggagcttgagtccagcctggacaacatggcgaaaccccatctctagaaaaaatacaaaaattagccagaggtggtggtgcacacctgtagtcccagctactcgggaagcttagatggaaggatcaactgagcccaggaggtggaggttgcagtgagccaagatcatgccactgcaccccagcctgggccaccaagtgagaccctgctttaaaaaaaaaaaaaaaaggctttcctgtgactttctctttactcctggcacacttccagaaagtttgtggtctggagacactcgcagtagctcttttgcccactggttccactgcattgtcttgctaatatttagaggtttctaatcctgtatcagaagagacatttgatcttttaagctgaaatgctgtggtttgatgttgttttaggtatgaacatgctaatgatgataagagcagtttgaaatcagatcccgaaggggaaaacatccatgctggactcctgaagaagttaaatgaactggaatctgacctaacctttaaaataggtaactgcttactttgtaagtcagctgtggggtttggaaggacacttggtaaccggctttgaagacgacggctcatcccttagcgggctagcgcctctcgggctgggttccaggcgaagatgcggttctgagacctccctccccttctgcagccttgccaggcctttctctccgcccttagaatctccatggaggagacccctttgtgtgtggtcaggaccctgaacaggagagtaggtccacgtctcacccatgacagaggactgagaaactcaagtttgtctcgttacctttgcaggccctgagtataagagcatgaagagctgcctttatgtcggcatggcgagcgacaacgtcgatgctgctgagctcgtggagaccattgcggccacagcccgggagatagaggagaactcgagggtccgtagcacccatcagtgttcattcctcttctgagttttgtcccaccaaacagcaggggccacgaggaaagcagctgcccttgggatgtctgttcgttgtctctcaaagtctgtcaatgtttcctgtaagctgggccttgtgccaggtgtcagagatgccaagtaggtttgacacagcccatgccccagtgatctcacaagctcagggggaaagatccacatagccacgctgtgtagtaaccctgccttagagaagagggcgggtagctggacactcaggcagacacattcacccctgccaccaaggtcagggaggacttctgctctggagctgtgtcctgagggtgaatgaaatgggctgttgtatgtgtggttccccctacaccccttccctatagcacttcccaccaggaatagacctactgctgtgggtcccttagcatggaggaccaggatacaaggctgataaggtatcctccaaacagatgattacttccctaaaaatcactcaaaaggagagaagagggaccaaggtaagactgctctgaaaggagagagacacgagccattggacatgcggccgagaagccagcttcattcctttctgggtggactccttaaggtttctttccagcctgactttatgacttctctgttttcaagaatacgtagcaaatgaggctggtcaccaaggtgtgtctgcctaggcctctatgagcatgttatctgcttgtctttgagtttctgttcgttttacgccggcttttcaatgcaggatttcattgacctgcttttgaaaaattccctcagtgctgtgttactagctcttctgggccccaggtgagaaccttaaacaagtaatgtctttcttggtcttgccacagcttctggaaaacatgacagaagtggttcggaaaggcattcaggaagctcaagtggagctgcagaaggcaagtgaagaacggcttctggaagaggtgaggcccccgatgggcagcaggctgggggagccgccgtgaggccaggtggccctgaactctggtcctgtcttgcagggggtgttgcggcagatccctgtagtgggctccgtgctgaattggttttctccggtccaggctttacagaagggaagaacttttaacttgacagcaggtaggacggcatagcctcttcccaggtcttgctgaccttgggaggtttcaccaaatgcccttgggtcccaacacttcccactgagaatcccgccctggttcccgttcttcatcactgggtgtgggccggacatctgaggagacaagttctggtgtgccctgtcctcctccccaccgcaccctggcggctgaaacagcaaggaagcagctacccactctccacagctgtcaccaccgcaaggccatgaggacacgcccactcagccgtgcagactctcagggtgctgtgtcttgggcattttggttcagggttaatacttcttgtcttcatgtgtgttctgccccagcagaggacagcttttgcaagtggcaatgcagagactgaagcatggagtgctggcacggtttattttgaaccaggcagccagcaagcgtttcagccgctggaatgtggggagggtgttaacagtccgtgactcctttcctgttctaccaaggaaataatttcctacactcgagccccttccttcattctttcccaggaaacgatgactccattgtcatgaaagcaaaagataatctgatttctaatctgccaagccttagccttcagcaaaaaggcacccacttcttgtggctacagtacgtttccctgttgggcctggctccctgggtgtgcttacgccatactgctggcggatgctggcggtactggccctgtgaggtggctttctctagctcacggcacattcataagtgcccttctctccaccagtctgtggcaggctcagtggctggaaggaggttattggggagcaaggctgtgtgagggcaggtggtgtcttcaagggcagcctgtgcctgtagcttctacccagccctctcctctcccgcaggctctctggagtccacagaacccatatatgtctacaaagcacaaggtgcaggagtcacgctgcctccaacgccctcgggcagtcgcaccaagcagaggcttccaggtaagtgacgcctctgcaccgagttcaggtaacaggtttcccctgttgactgttacttgcgtttgttttctgggttcttgaactccagaggtctatttctcttaagaccaactactaccatctctttaaccatcttggtagccgtgggattcagccttgaagaaatcccacggtagtgcgctaaggggaagttggggtcttgaaagatgacattgtcactgtggtgtttaccctcctgggcgtttcctaatgaagatgaccttagagttccccggcctggggagcatgttggtgtcaagctagcagctctcggttttctcatctcctaaaacacctcagagccagtaaaggtttctgctgaagctgtgttgtgaaataaagcaattatctgttgcagagacagcctgtgttgcagaagtatcctcactgagtttcagcgcagtctgtctgccctttctgtaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaactggacatcaattttttagtaaaccaaaaaataagtctcaacaaatgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttactgtcccctgctgtgataaagatgtcaaagtatctttgttcttggacacaaatatatataataaaatacgttaagaaatgaggtggcctgaattagtaagaaaaaagttgattgcttactgctttacccacacacatttccatctaggacttgacatatccccatttgatatacaagttaaatggggtctgtcaatggcatccaaaaagttactacccgccaaagggaaagcagctatgacctggtctaaaccctttttttcttacagatggggaaaccagggtgcagagatttaagacttacccagcctgtaaactctcacctctagtatttgcttgtcatcttggtgcaaccagaaatccacatgtggaaatggtgtccaggagtacggtcctatacgaagttgttctgtctctgcatcataaatgctaatcatctaaaaaagaacgtgtcaaggatagaatttcaggaatgtcacccacttttcaaaccctcccagtaacgcaagctccagtgtagtcctttcatgcatttatctgcctaagcttcttaaaacctgtctcaaataacaaaagctgccagctactgaacacgtccagtgtgtctgcttctgcacactgtggggcacgcacgactgctgagcgccaacagcagtcccacaggacgagggtgttttttcccatttggggtgaaaacttgaggctcagagaaacaaggcccatttcccaggttacgtgtccagtaagcctcagagctggacctcaaacccaggcgcttctgactaaagtctgtgttcccattgcctcattatttataccccaaacaactgatcaccttgcaatttaaaagcatacagtgcctgctgccccatcaaaagaagaagctaatttgccaaatgatccagtccctgaattcccaaatttgccaatggcagcctcagcttacctagcaatattcactttggtaactgacactgaaatatgttctgaatatcaactaaactaggcctgttacactccttgagaagtcctaaaaatgttaaaagggttggctccgaatccaaacacatttcccagtgaaaacatcagcatttcataaatgagaagatttctttggggtggcctgaatgtgatttccgttttttcacactttgagcatttttaaagaattctttcacccattcctcaaatggcatataaaccttgggttttcagttttctaacttttaaaattacagtgtaatttaattaagcaccctaagggaatcagactttaaattaatttgatcattattttgggttaattaaattgttccagcaaattgctcttcagtgacccggtccaaaagaatgcatagtcctgagtgcagaggggagaaacctctctcctgcgtcccagttctcctctctttgtagaactttatagaaaagctcttacaaagtaacagaagtttgttctctttgaattcggatgctggggttcacacttacctcccacaccttttaggcagagaactggagctgatgacctaaagatgttcattactattttgagacagcaagtgtggggaggggtatatgtatgtgctggtccctgataatgtacggctataaagaagctgacagcataaacttttctaagatcccaaaaacttaaggccttgacatttgatgcctttttttttttaaccccttaacaaagatgatttgaaactcactggtcctcctgctaaagttcgcgcagcacgaagctgctcctccggaccccgatcttgaaaggatgctctgtaaatctctgcagtcttaatgttgacagctgtgagggacaacaggatgactctgaattgacaaaagaccaaagcggaaagtctgcacagtcttacatttctaccaccactcctaagagaaagataggaaagtgaacagaatggctcctaagtatctggacttccccctccctggagggggaaaatgcaacctttaccccaagcatctcggtgaaaatcgctgaggctcgagctggactcggtgagattttgttctaaaccaagagctgctttccacatgggaggcagccattccttcagtcggacatgtagcaaaacctctggtcatccctactggtgtacggccaggggtggctgggtgaactgtgatcgttctgtttgaatcttcacaatttagtattttatacatacacgaagttacagagaatagaacagtgaacactgtgtacctaccacccagctaaatcaatcaagtatcaccgctacagcagaagccctcggaaatagagccgattccatgatgccttttccgcgggagtcctggggctgccaagcagggaggatggttctaggttttctctagcctaagagttttacactttggaggatttctgttctcaagcaaaaccttcctcagttcctgatgtataaaaggattccagtgcctgccttcctcccccagagcactggcaggagaaaagcacgccgggcctggggtgctggggggagagggaaacaaaaccaggcactttcccagctcctgggaagggtgggcatggcctgtcctttctatttgctaccacgttgcttcttcaaagtcttaagaagtgaatgttatctcagttttataggtaaagcttagagaagttaagctacttgcccaaggcctcacagcagatgttcggagtagctgggatctgaacccaaagctgtcccatcctgacagcagtggggtcattggtttgctgaattagactttaactgcacatgtgaccaagactccaacccacaaaagatgcacactacttaccaatgccatatattactggaaagtggttttcgttttcttcccggtcatttaattctacaaaataagaatgtttaagatacactttttaaagaaataccaaatgattatttttactttgtataataaaggcgaaggaggagctcctcgatgcagaaagggaggaaaattccagaaaatgaaagggattgtggccctgtttccctaccctgtcccaaggcaggggggtttatactgaacaaactggcagctgcagaatcggtccccactcccaccccaccttctctgtgcaccctgtctgccacacgggtggcagctcctctgagatccagtgccctccttcctggtagacgagggggctgcactggaactgaggctcggcagatggtggacgagggcaaggggaaggggaaggccatcccaccacaggaagagccggaacagatggtggccaagcagtgacagcagtgtgtgccggtgcttgggcccactgcaagactggggacaaaacggtcctgagacccacatctttgctttggggcaaatggcaggacttacctgtcacacataatgtcactaagtgaatgtcatcttcttgcctgtcaaattcacctatgatgagaattttaagaccagaagtcagaaaagttcctctagttaccagaacaaactgctgagcaagccaacgacagggagggacggcagccaactgagtgtgctccgccctacagcccgcgcccacactgccacagcctggcctatggggccagacactagggagctgacaccacagaaccctgaccgccaggagatggccacattctcagcctcaggcccgaaggagcctgggctgagccttcccatttttctcttcattctgagagttttgcggggacccatggatttataagatttttacttttctcctaactaaactgttttcctgattatcagaattacaaaaacaaaaatctggccactgtaacagatctgaaaaatacaagagaacataaggaagtcggtttttaatgtccataatcctaacactgttaataattagtgtattttcttccatatttttctaagctcagcagagctgactataaagacaattttatatcttttttttttttttttttgagatggagtcttgctctgtcacccaggctggagtgcagtggagcgatctctgctcatcgcagtctccacctcccaggttcaagcgattttcctgcctcagcctcccaagtagctgggattacagacttgcgccaccatgcctggctaatttttgtattttcagtagagacagatggggtttcaccatgttggccaggctggtctcgaactcgtgacctaaagtgatccacctgcctcggctgcccaaagttctgggattacaggaatgagccactgcgcccagtcgacaattttatatcctgatttgcttgtgcataggtattttcccatgtaattctcaccctttcatgtgttattttttagcgactacataattattattctgatgacaccagatttcctgttataagtaatgttctaccgctcatcttcaggttcaaatctctatgcacatttcagattattttcttagcatatatttccacaaggggaattactgggtcaaaggatgaactatttatttatttatttatttatttatttattgagacgaagtctcgctctgtcacccaggctggagtgcagtggtgtgatctcagctcactgcaacctccacctcctagattcaagcgattctcctgcctcagcctcctgaatagctgggattacaggcgtgcgccaccatgcccagctaattttttttttttttttttgagatggagtttagctcttgatgcccatgctggagtgcaatggtgtgatctcagctcaccgcaacctatacctcccgggttcaagcggttctcctgcctcagcctcccaagtagctgggattacaggcatgcaccaccatgcctggctaattttgtatttttagtagagacggggtttctccatgttggtcaggctggtcttgaacttctgacctcaagtgatcggcctgccttgaactcccaaagtgctgggattacaggcatgagccaccgcacccggcctaatttttgtaattttagtagagacagagtttcaccatgttgcccaggctggtgtcgaactcctgaccttaggtgatccacctgccttggcctcccaaagtgctgggattacaggcatgagccaccgtgcccggccggatatgaaccttttttaagagttatggcgagaccctgtctccacaaaaaatttaaaaatcagctgggcatggtggcatgcacctagtcacagctacttgggaggctgaggagggaggatcacttgagcccagtaggttgaggctgcagtgagccatgatggcgccactgcactacagcctgagtggcagagtgaggccttcagtcatgatgccaaattgcttcccagacaggctgtaccatcatatgagtaagcttgcttcatggcctggtggttagtcaacacacgacaatgttttctttctttcttttttgaaaatatttgctaatttaggccaggtgtggtgactcacacctgtaatcccagcactttaagaggccgaggcaggtgcatcaccaggtcgggagttcacaaccagcctggccaacatggtgaaaccccatttctaccaaaaatacaaaaattaggtgggtgtggtggcgcacgcctgtgatcccagctactcaggagggtgaggcaagagaattgcttgaacccaggaggcagagcttgcagtgagccgagatcatgctactgcactccaacttgggcaacagagcaagactacatctcaaaaaaagaaaaaaaaagaaaaaatttgctaatagggaaaaaatggtatcatcagtgttttaattttctgcagattaaaatggacatttttgccaggagggagggtggctctgctttcacacaattcagagcacttactattttggaatgtgttcactgctgttttagtagaaaatcttgtccccagccctgctacccctccctacacatgagctccacgcattcagtctttctgtgaaattccaagctgggcagtctgtttctctgtgctgctccaagtgggtgtgcccttcttgggttttgtaccaattgggatttttaacccaagcaaatatgggtacatatttatgtccaatttgggggaaagaaaaaaaaaatgaacttactaagaagttgatgagtgagtttttgtgacaactgcctgtcgtcactgaagcctccaacaaggtgtacttccagcctggcaaagagatgagacgggtcagaggccagaagaagacaccggtgcgtgcgctggtctcactttgaactttcattctcagtttccatgaacacttgctctacagcagagctgcaggtcatcttcgtgccaccgcaaaagaaagtatcggcagcacactgccaaggccagtggcgagcttctggggaccctgcccaggggccctgatgactgaggggatccgtatctgaacacaaatgtgatgccgcctccatgcaccagtggggaactttgctctggaagagcacaggcacaggacaggtgcagtggctcacatctgtaatcctagcactttgggaggctgaggtgggcggatcacttgaggttaggagtcttgagaccagcctggccaacatggtaaaaccccatctctactaaaaatacaaaaattaggccgggcgcagtggctcacgcctgtaatcccagcactttgggaggctgaggcgggcagattgcttgagctcaggagtttgcaaccagcctgggcaacaaggtaaaactccatctctactaaaatacaaaaaaaaattagctggacattatggcatgtgcctgtagtcccagctacttgggaggctaaggcaggagaactgcttgaccctgggaggcagaggttgcagtgagtcaagatcgtgccactgcactccagcttgggctacagagtaagactctatctcaaaaaaaaaaaaaaaaagaaaagaaattagccgggcatggtggcacacctgtaatcccagctactcgggaagctgaggcaggagaattgcttgaacctgggaggcagaggttgcagtgagctgagatcgcgccactgcactccagctctgggcaatcgagcaagactccgtctcagggggaaaaaataaataagtaagttgggcgtggtggtgggcgtctgtaatcccggctactcgggaggctgaggcaggagaatcacttggacccaggaggcagaggttgcagtgagccaagattgcatcactgcatgccagcctgggtgacagagccagactctgtctcaaaaaaaaaaaaaaaaggtttgaggccaggtgtgctggcatatacctctattcccagctacgcgggaggcagaggtggaaggaatgcttcagcccagaagtttgagactagcctgggtgacagggtgaaaccccggctctaaaacaaaaacaaaacaaaacaaaaagactgggcaactgcctgctggaagccctccttaggagtcacactgcgcattgcacagtgaagctcttgagaagtcctgcgactgaaaaatccaactaactttcttgaacccagtgtttcccacactcatctactaacccccttttccacagcccgtcaagtgggcgaattcacgctcggcaaagtgttgccagactttacgctgccttctcagacacaaaatcttcctaagggatgaaccagaagcttggatgtacccaacatagggcacagcctcaaggggcctcataataaactccaagtagtagcagtaaggagagctgcgaccaccatggctttgccactgggccaccaggtttgcctctgactccctgagcgatcacagttctacaacagatcaggaagagctgacaagcacgttctgagaaccacggagcagagtgtgtggcaacataatggcattgattacgtccccctgcgggggccaagatgataggaaaatgaaaataccattttgggcctgcatgggtcacgtgtccatgaagccagcccagccttggcacagaccacagagggagaatttagaatcgaccagtattgactagcaaatctctcccagagaactctctctttcctttttagactcctaggattaagccttcgtatatgatgggagtagttcactcaatggctgccttagacttccagtaaaatgagagcaacacctgccaggtctccacaaagagcaaggagaggggacaggtgtgtgaacagtggtcttgacagcaggcctgtgtcgtcggcctccacctagctcctgtgtgctccagcacatcgagcctcagttgcccgtctctgtcaaatggaggcagcggctactttactgcagtgagagaggatgaggtgctgtgggggcacccaggctagaggccgcttcttatccagcaatccttggggaaactaccaatctgctggaatttaaaactatacccctcagctgggaggatcacttgagcccaagagtttaagaccggcctgggcaacttggcaaaaccctgtctctaccaaaaaaaaaaaaaaaaaaaaaaaaaaagctagctgggtatggtggtgtacacctgtggtcccagctacttgggaggctgaggtcggagaatcacctgagtccacaaagtcaaggctgcagtaagctgagatcacacaactgtgctccagacagggcgacacagcaagaccctatctcaacaacaaaaagagaacaagaaaaaaaactacatgcctcgccccctagcggtccccacatcttcctggcctcgttttctccacagccccgcctcaccacccaacaccccatcttgtgtacagtctctcggcttcggaatacaaacaccttgggccgggctttctgtctactcttcactgctgtgtccctagaaactacaaggtgtaggtgagaggaagcatttaacaagcaactgcgggaggaatgactgcatggagagctaccacacccgggggagagcaaaacgatgtgaaaatcgcaacctcgacgttcctgagacgacatcaagttcaaagtcaagccttccatctcaaatccagcacagactccttgcctgtgcccagcacccactcattcactcaaccactgctgacgcagtgcccacgtcgtgccaggttctgttccaggggaacgaggcagacacggcagtggtggcatcctgtgttcccctaacagcttccacagccacgtcctgtatgcgacggttccaagatctcaattcacctatgagagcagcgtagatctcaccttccacattgagcgtggtcagaaaaggattttatggagttcatgatcaaggggacctcagctttggtgtcggttccgtcacaatgtgtcaagcaggtggccccattacctgaagaacaagggtgaaaggactcaagttattccctgatgcgagtgcagtgcgcaggccgagactccgcctgtccctccggaccgcctcatctttgaatatcctgtaggggaaaaacggacaggtctgtgctccccagccaacccattctgaccaggacaccagggagacaccatgcagaccagaaaaaaggtaagcggagtccgcttccaacaagacaccaggaaactcaacacgagaaattcaatggtcccaaaggttgggtcagtttaagtaatggtttccttcacctctctcatcatacctgtgtgcctcaggaccacaatgtgacaagtagtggcatcatcagaacccagaatggagatggagcctgtttaaaaaagaaataaaataaaatatccaatagccttttgggataacgcccaattcactgcttcctaacctaccatcctttggggaggtcactgcaagctctctttgctgaacatacagaaggccctggggtcccacttgttgaacagactgacctctgagaagtctggctctttcctgtttaattaaaaaaaaaataaaatagtgatgtaaattagtgaggatggaaaaactaaagatgtggagagagccaaagtgggctctgcgtgggcagcacgctagtgtgtggggagtgtgttagtggacagagaggctcaaagaaaaaggcagcagccacggtcattcagaacaatgcagagaaaacgatgcggttctgcgcggtggtttttttaacctatgaaatcggatgtcatagtaacctatgaaatgagatgcaaaaatcctttattatagttttttgtttgtttgtttgttttttaaagacacagggcctcactatgttgcccaggctggtcttgaactcctgggctcaagcaatcttcctgccttggcctcccaaagtgctgggattacaggcatgacccaccacacccagctatcacagttctttactaaagagtgtgagactcttaacaattttaccattgtaaagagaatcagattacacaggaatagtggatggatggctctgaaatcacatcccctcttttttattttttgagacagtctctcactctgtcacccaagctggagtatagtggtacaatttcaactcactgcagcctccacctcccaggctcaagcgatcctaccaccttagcctcccaaatagctgggactacaggcttgcaccaccacacctggctgagttttatactttttgtagcgacggggtctccctatgctccccaggctggtctcaaactcctgggctcaagcaatccacccaccctggcctcctaaagtgctgggagtacaggcacacaccaccacacctggctgatttttatactttttgtagagatgaggcctccctatgctgcccaggctggtctcaaactcctgggctcaagcaatccacccaccctggcctcccaaagtgctgggagtacaggcacacaccgccacacctggctgagttttatactttttgtagcgacggggtctccctatgctccccaggctggtctcaaactcctgggctcaagcaatccacccaccctggcctcccaaagtgctgggagtacaggcacacaccgccacacctggctgatttttatactttttgtagagatggggcctccctatgctgcccaggctggtctcaaactcttggactcaagtgatccacccaccttggcctcctacagtgctgggattacatgcataagccaccatacctggcctccgcttttttaccttagtccctaacctagtaatttcacttctggaaatctgtcctaaggaaataactcaaaatatgttcatccctgtgttatttcttttatcttattttttttttttgagacagagtctcgctctgttgcccaggctggagtgcagtggcgtgatctcagttcactgcaatctccacctcccaggttcaagcgattctcgtgcctcagcctccccagtagctgggattacaggtgtgcgccaccatgcccagcttttcgtatttttagtagaaactgggtttcgccatgttggccacactggtatcaaactcctggcctcaagtgatccacctgccttggcctcccaaggtgctgggattatagcatgagccaccatgcccagccccctgtgtaatttgtaatggcaaaaagctgggagcagcaatggaaaaggtaagtaaattgggcacagaaccaagtcacagccactaactgcacagtcatgagaaatgaaaactatgggaaaaagagttttgaaatgctaattgaaaagcaagatacaaaagtataaaaaatgttttaaagagctataaatgtgccataatacaacaatgattaaatgcttatacccatagagaaaaatactggaaggaaatttcaccagtacaaccatggctgtgccaaaaaagcaaacatgagtgatttcctgttgctgttgtcctctcttctctcaatgttctatcacatagttattgttagaatacaaaaacaaaatggataaggcaaatttacgaaaggtatgttaatactaagtgtcaataatctgagtgtttgtacacacttatttagtaagcttgtaaaaaaaattcagtggttaaaaattcagtggttatttaacaaaaactttttcaaaatattaaattgatacaacactacaatgtatcataatttccttcttacttgcaacaaactcctggatgaacaaaatcttcctcaaatgtctagacaacgtatgtatgtattgcctacacaggaagacagttttgcagtcttagtcttctatcagcttcttgccatttcgcatgactggtgctaatttaggttagcgctcacttaataaaacataagagcagctgggtgtgatggctcccaactgtaattccagcactttgggaggctgaggagggaggactgcttgagcctaagagttcaaaaccagcctgggcaacaaggaagatcctgtctctacaaaaattacaaaaattagctgggtgtggtggcatgtgcctgtagtcccagctactctggaggctcaggtaggaggatcacttgcagccaggaggtggaggctgcagcgagccatgattgcaccactgcactccagcctgggtgacagaccaagaccctgcctcaaaaaaaaaaaaattaagattaaactaaaagaagagatgtaataaacataatgatcagcttgattacttacatggtgttttcttctgtttataaacttccattaactggaagcaaggtatcaatgaaaatgagacaagccccttaatttaagaaacaaactaaagattaaatgaactgcagtgtaaaattagatgggcaagacagccttgcttgctccagaagtcagtgagaaacaggtgtgactgctctaaaactcagaacacctgtacaggtgacagcctctcattttctcattccacttcttgcctcatcttagttcagaataacaggggagaattcagaattccctcttgattactcctgagatacttaccttctgctttgttctttgagggaagggaagagaagggagggcgcaaaggcgaatttttaacactcatgttcacaattgggtcaccactcaaaagcaaagctatttgtgagaaattaattactgctttcacaaagaccaaaaatcatgtctctcttcaacacagctcctacgatttcccaaagaaataaaagcaaaaattatcagaagagagaatgccagaaaactaaaacagtagactgctttgctctattttttaatttctttttttaaacagggtcttactgtctcccaggctggagtgcagcggcgagatcgtggctcactgcagcctctggcctcaagcaatcctcccacctcagcctcccaaggagctgggaactacaggcatgagccgacacacctggctagtttttgtactgtttgtagagatggggtctccctgtgttgcccaggctggtctcgaactcctggcctcaggtgatcctcctgcttcagcctcctttgcagtagctggaaccacaggcgcacgccaccacacttgtgctaggattataggcatgagccactgtgcccagcctctactttatttttaatttttttttttttttttttagagacaaggcctcactctgttgcccaggctgaagtgctgtggccagatcatagctcactgcaacctcaaactcctgggctcaagcaatcctcccacctcagcctcctttgcagtagctggaaccacaggcgcacgccaccacacttggctaatttttgctcttttaagtagtaaaaagagtttagccaaacttcccttctttggaaaaccacacagtcctactttataaattcatatgcaagtagtcccagttttcttaacctctaatatgctctagacactaatatttgcttaaaaaaaaaaaagcttttccctcagtccctcatccctatttcccagttcctattcaatggcagtattctcttaacccagtgaccagcagattttctgaaaaaggccagacagtaaatatttggggttctacaaggccgcagtctctgtcacaattgctcaactctgctgttattatgaagtgaaagcagccatagacaatacagatgtggctgtgttccaataaaactttatttataggtgacaccgaagttttaatttcaataccatttcccatgttacaaaatattattttgatttttctcaacctttgagaaatataaagaccattcttggcctataggctatacataagcagggtccggcccatgagctgtggcttgttgacctgtgtcttagccaatcacctagctgtgacctgggggatgatcatgtgaccctcacccctgctgtcctgtttatcaattcttcctttataaacaggagaggggcatgaaggtgatctgtgaactgtaaagcacaatgctatataagaaattatgaggcccaacacactggctcacgcctgtaatcccagcactttggaggccgaggcgagatgatcgcttgaggtcaggagtttcagaccagcctggccaacatgttgaagccccatctctactaaaaatacaaaaattagccgggcatggtggcagatgtctgatactcaggaggctgtggcaggagaatcacttgaacctgggaggcagaggttgtagtgagccaagatcgtgccattgcactccagcctgggtgacagagcaaggctctgtctctcaaaaaaaaaataaataaataaataataaaagcaggaactaagctacgctgcgagcatcttgtagactctgtggaaccgtattacccaagatgttgcaggactggttaccgagtacccagtgactggttaagagtgactaagggagggctctaaacagctctggccaaaggaacttcatgctgggatggccaccgtctatattcacactgtctcattagtagccatgctgtctgctcggcacttgaaatgtggctactgcaactgaggaactgagtttcaattttatctaattttaattgatttttaagttaaatcctaagtaaccagatggctcgtggctactgtactgaatagcgcagctccagagtcaagggcaggctgccagggttccaatcctggcttcaccactcccaggatgtggggcctggggccagtttcccagcctctctgtgccccacagtcctcatctgtaaaatgggaatagcagtaactcttgctgtggtgcttggcagcttccactgtatgacttattgttattatttgctagtcatagctacacacaggcttctaactgttggtactccatactcagaacacatcgttacatgaaaaagacacattataaaacaacatatagtaagctatcatttttttaaaaaaagtaaattatatacaaagaaaaaccttcattaggactttcaccaaactaaagaatggttgtagtcatacttttttttctgtattattatattttgctttcctacaaagaggacaccctgttttattatataaaaataatccaggccaggtggagtggctcacaccggtaatcccagcactttgggaggccgagacgggcagatcacttgaggtcaggagttcaagaacagcctggccaacatggtgaaaacccgtctctactaaaaataaaaaaattagctgggtgtggtggcatgcacctgtaatcccagctacttgggaggctgaggcaggagaatcgcttgaaccttgggagacagaggttgcagtgagccgagattgtgccacagcaatccagcctgggccacagaacaaaactaagtctcaaaaaaaccaaccaaccaaacaaacaaacaaaaaacccaacctttaatgtctccctgttgctaagtaggtgaaaggtccatctaagccccttggtcatttggtcatctgggtacaatccacccctgtaaggttactttccatgcttcccctcctcacccgggctgctccggagaaactggccaggacacccacccactgggcccttcccctcctgcccgccgcgccccaggcggcttgcccagctgcgatgccctcacccttcttctccttttcaaatctctctcgtgcctgcatccttcttcacttacactgccgcaaatcaaagtgatcgcccccttccaaagttcctgtaacacaaactggtccccagtacacagcctttctaggacatgtcttcttaaataggccaaaaccttccttcgagagaagcagccccggtatgtcaccaaatctccctccacacttaagtgtgcagcccgggacacccatctaactttctatcacggacattttcaaacagacataaaagtagagcatcccctaaattcttcaggcggctgaaattatttttccttggtgagtcctactcttgacttcgctagctaacaggacagtaacacaacgcaaggataaagtgacacgccaccacgcctagctcggtgcatgttggctaacagacgatggtcggtcctgaaatgcaagctgagaatcacacagagctgtctgccttctccccgtcagtaagtccttgtcacccttcagaacacgttcaggggtcattttgtgacctcatttatgcagcaaatctttactgagcgccaattctatgccagggaccgtcctacactctgaggatacaaaagtgaggacactactcttatctgccttcaggaggcttacattctggcgacagaccaatagagaacaaacaagcaaacaaaataatcacaaactgtacagctgtgacagatgaaacctctaaatgccttccccaacccaacacacttggtcaggttcctgtgcttcccatctcagagtgaaaggggacgctttttctttatggtacttaacagtttatagtatctgagccttcttcatcagaaaccattctcccttctagactataaacactccgagggcagggacagtgatcagtacgttgcccaacagatattaggggctcgatatttgactctcaaatcaaggaactgattgattcccctttaacaggatctatggcaaataggacgtctgcccccgccgccacgccccgctctttttaaaacctgagaacccccttgccaacagtccctgcataagcgtggacaagagttcagagatctatttgagcacaaaagcagaaaaaacaaaaacaaaacccgtgcatcagggcgtggtcctatggcccagctgcggaaagcagggctctctctcccggctaaaaataactcggcgccctacgccccgggggtaggggagagagaggaggaaggactgggggtccccgccaagatcccccaggccaaacgctctccgaagcccaccctggaataacctcctgcttcacggggacgcaaggacgaagcaacgttcaccgcaggctgcgggtccccgaaggcgggcggccggatttgcctaaacggacccagccctatgggggctgcagccgccccgtcggggaatgggggtcccggcgtgtccccgagccgcagtgctgtgcgaccttgggcaagtcacctaacctctctgggcccccgtcccctcccttgtcagagagtggcctccggggcagcccgctgaagtctaaagaaggcaaaaactccccgacccctcaaggggaagacgcgagccgacggccggggctccggatgtgccaacagcgccaagtttcaagtctgtgtcgcgtgaggggggcgctagcccgccctgcagcttcccctcgggcccgccccgaagccccgcgccgcgccccactcacctccaaaggcgggtgggctcggacgaggtccccggctgactgcggcagccgcactcgccgcccctcgacgagcagcggcatcgcggaggcggccgcccaggcaggcccagggaggcggcggccccccgctttgcagccccgggccgcccgccgcccccgcccctcgggccgcgcgtcccgcctcgtcctgccccgccccaccgcgggcgctgccgggaagtggagtccaggcggaggcggtgccggccgaagagactggagaaatccaggacatggccgcaaggcctcacgggaaatgtagtccaaagccaggaagtggccctggaagcagcgcgcggcccgcctcctccgcaaggggcgctgggaagtgtagtcccaaaagcgtgggagtgaaggagcggggaaaggagagctgccagggagcagctgcaccagccaagagagcctccgggcgagttcctggggcgggttctggctccgactgctgcgctttaggtcattgctccacgcttcccaggtgtgtgaccttccacaagcttgagtttgggaccctgctgtgcagctccgtaggattgcattcaatgagtaataataaacctaatcaggcgggcacggtggctcacgcctgtaatcccagcactttggggggccgaggcaggaggatcgcttgaggccaggagttcgagaccagcctgggcaacatagtgagacccaccctcccccataccctcgtctctgccaaaaatttaaaaattaactgggcacggtggcatgcacctgtgatcccagccactctgtaggctgaggcgggaggatctcttgaccccaggagtgggaggctgcaatgagctatgtttgggcactgcagagggacactctgtttctgaaaataataaaaataaatgtaaacggtcttaaactgagaaaatagatcctgaactgtgctagccccacgtactaaagagatcatcgattaacacgtcgtgattggaatgcaataggccactcacaggtgggctgggaaccgtgggggaaggatttgcggatactgactgcagagcccctaatctgaggacaggtccccaaggtgagaggcgtctcaccgtggagctctcttctaaaacttggaaatattgctcaaattcatccaactctgcagcacattaacaaaaagtaattttacaaaagatacagaggagccacatgatacagcagaaactttattagaattttatcatctgtattcatcgtcttctttcataaatctccccctcagcttacacaccccgttcaacaaaaataccaggaaatttactaaagaaatgactgtagaagatggtgttcccatcgccaggttacccaacttctcacccaaaataactctatttctagctaccaggaaattatttctctgtattattacacctacatttctcatttgtccttacaaatgtaggagctactatcaacacctcatttgtcatttgtcctcacaaatgtaggagctactatcaacacctccgttataacagatacagtaacttgctcaaagtggtagaaataagtagtagaacgaagactgaacctagctttgcatgattccaaaggcagtgctctccatcactataagatgctcctagactgtactgtaaacaactcattctaatgcaggtgacattaagtaagtcccaactaggaagctcggagctaaaaacagggtttgaaaccagggtgatcaatgaccagcaggctggcctggagcaagttacttaacttccctgaactggttttgtagaatagcatgtttgtttcacctggtacatactaaacactaaagatagctattattggaattgcagagcaaagagtagtcaatcaaagtgaggcatttggaagtgcaaaggtgaagaacaaggttctgtgggttctgcctggggctggtgcagtttgcctaactggtttttcacttttgggtgatcttttttcaagtaatctcaggttatcaatctcctaggctgagtactgtgttaaaggactaaatgagccagataacaagcaggaaaccactcccctacctctcttcccacccagctccacaaattttggtctacaggcaatgaggaagcaatagcaggtgtgtggccagcactgcggctcatgcctgtaaccccagcactttgaaaggccgaaggaggactcacttgagcccagaagttcgagacgagcctggacaacacagggatccctgcttctccaacaaatacaaaaattagctgggcatggtggcaggcctgtagtcccagctactcgggaggatcaatcaagccctagaggtcaaggctgcaatgaggcacgactgtgccactgcactcctgcctgggtgattacagcaagaccgtctcaaaaaaaaaagaaaaagaaaaagaaagcactaattacaatgttggaaagcctgtttctttaagataggaaaccaacctgcctcacaagatggctgatggcaaagttcaaagaatatatacagggaaatattttttaaattacacttttttgaggccagacatggtggctcacgcctgtaatcccagcactttgggaggccgaggcggacagattgcttgaggttaggagttcaagaccagcctggccaacatagtgaaactccatctctactaaaaatacaaaaattagccaggcatggtggtgcgtacctgtagtcccagctactcaggagactgaggtgggcggatcacttgagcccaggaggcggaggttgcagttgttgagctgtgattgcaccactgcactccagcctgggtgacagagtgagactcttgtctcaaaaaaaagaatgatgaacattatacagaaccttagtaaatatttagtgaaaggatcccaatttgtgtttcaaattttttaatgtagagatgggggtctcactatgttgccccagctgatctcaaactcctggcttcaagagatccttttgctggcctccccaagtgctcagattacaggcatgagctaccacacctggccccaaattattagatacattataaatcctactcaaccatccagagtcagactgaaacacacaaaagcatttgatggaagaaaacatggtggagctttggatgttcaattagttgaaacaagaaaagtatgcagttgtacaccaatgaacagttctcaaggcagcctgcaccttcgaatcaccagggggctttaaaaaccatccatgtccagacccctcttctggagactgattcaatcaaaggttgagttggtgtgtgacgtgagcctgggcatccttagtttctcagcactccaagggactgattctagggcacagccagggttaagaaccaccatcgtaagcactgcccggcaagggaaacacgctggttcctcctctccagttcagatctaagttggtaccagggaggtaggtattatggaagaaatagaagttatctttaaccaaaaaaaacttcccatggaagtgcttcctttcttgcaagaaaacaacagccattaacttgtacatgcatcgaatccttaaagccttacactagtatcttattcccattttacagtttaattagcgctcagagaggttaggtaacttgctcaacgtcaaacagctagctaggaaaggaagcccatggcacttggtaagttgacttgtaaaaattcagccacttctcatcaaggaagaccaaaccagagcacacagacaaaaggacagaccctggagactcctacaactgacagctttttagtgaaaggaaaaattcccattgttggcatgtaatttataaggagatttcacagtatttttccccatagatgtcccttcaaagcatgtaactttttgaaagaagtgtctgcttcccttggacctgctcaagcctcaatcactctttgctgggtgtgattaaggagagtcgcggatacttcatatagtgcacacggaaaccatcctcaccccggcatgcaatgaattccatcaagctccccgccacaccagcactatttctccctcttcaacagcaatgcctcaggagttttccactgcaaaatgctttaatacattaaattaaaaaaaaaaaaacaaaacagaaattgaaagaacatgtattgaggtaccttttattggtataagaacgtaagttccagattaaccatgtcattgtttcattttcaccatggattttttttcacaaactcctttgaaattaaacagacttatatgtaaatgtctttctacattaaaactacttcccaacccacaaagaccccacttactactaatttctggggaatttcgtttactcgttttatctaatattaaaaaatcaacattttgccagcagttaaaaagacaaccttaaagttctcaaattactttccaccaaacccggaaaagaaaaccacccatatccaaaactttaaagcaataaaaatttctattttccaaaaaagtatttacagactgaaattcaaactctacattgccatcaatgtaattatacaagtgcatacaaagccctggaaaagaggaagtatttcattacaaaatatttatgatcaagaaaatattgcttgcctttaaataaagtggcagaaaataaatatgcttaaagatggccattttcacaagtaaacaaaaaagtacacatgtaagaaacaaagtgaaaatgcttgagcttcaaaatgactctagcagtgtttgcacaaatttgttttaaagcgaggtcttctgaagacttcctctgtttagttataaaaatacaaaaagaggctttagagaaggatttcaccaagccgaatgtgcgatgcacacagccatcagaccaagactgcactagcaacttccacctattgttgtgagcaaaaccgtacaccaaataatctaaaaaaattttcctgtttccaacaaagaaattcccaataactaagtgatgcagatcaaaactgactcgatctaatggccaccaaggagcagttctagatctaaggggacacttgagagccaaggggtcaaatccaatctcatgtgttttacacaagcccgaactcactttcagtctgtgtgaattacatctacctggacctccatttttgtcttttaaatccattttttcgctgtgccaagtatattacacatctgattctgtttccctatatcctctctctcttccctatgggcttttattggtctctgaagtccctggagatcttcagtgccagctccaactctgtgtcccagaccatgtcgggccagctctcagctttccttctgtcttctctacactcccttgaaatcccaacagacaaataccaatacagcagaaggtgaacaatgtagccaaaataaacactttctagttaaagtctttaaatagaagttttatcttagaggattcttcactgaaagctcatcagtcaagtcctaagaccatggatctgacaaaaacccatgttaaaacagcaacccgtaaaacagtctgctgcctatattagaaattacccagtaattgtgtcaaaaagctgttaacacaaaaaatgtacatattaaacaagcaaatccttccaaatgtatcatcaaccccactgtaaaagattgcacatgatagtcttcattttgtctgtaaggggaacaacaacaacaaaaaaacccagtcttcagatgcttgattcagtcgaacctggaagtgccacagccgaggcaggcactcgctctagttcaatgccatcaatgcccaatggcacaagctgggtgctgagggcatgacaagtgatggggaatcccaaatgtcacatctcagtcacaaatttctgccgtcagaggggactgggttgcatgtacaacacgggtggggagcccacactacttgaaggacttcggaaatgcgtgtcaaaggagcttggtgtgatcccaatcacggtatcattctggggcacttcgcctttcagaaagtcatcatcttcatcttccactatgtcctgcagaaacatcagaaatcatcagtaacatcaccagtgctgactgaaaagctttcaacaattccttcctcaggaaggtgttaacgtttgtaaagatggtgaagaaaatatcttaatttcaaaagaaagccagtgtagtggcacacgcctgtagtcccagctactcaggaggtggaggtgggaggactgcttgagctcaagagttccgaatccagcctgggcaacatagcgagaccatgtctctagaaaaacagaacagaacaaaagctccctctgataagcacttccttcttaccaacatacccacataactgctcatcacacattgtaatcatttgtttcaagtctgacttgcaaacagatttgaagctcaatggggacaggaaacatgacgagtcattcttgcccagtgttaggaactcttgtacctaacacaatgtgaatgaattacacgcccctcaacaaatgaaacataaagaaaaagatgaaaggggctttccaatgattacttattaaaaacaacaacaaaaaagccatcttgaagctgcttttaatgagaaaacaaatgtgctcccaagcaacagagcagcgaaattctttattactggattctaactttcctctctaactgtaactgtctcagctccacctcatgtgacctggagggtatgttgcaacctgcgtcttcaccacccattcatgaagatctataaaactaatgtaaactgctggggcaatttcaacatgagtcaactggagattgttacttggtaagaatgcgcaagtggcaaagatctaaattcattcagctaatttgtaattaaccttcgcttctcacatgtcagtatgtgaagtgtctggtttaagcaatttatccaaaaaagccatagactctttaaataacaacaaaacctgggcctggaattttataaaggcagaatgagtaagacacggttttggtgtgcttttttaaagaaaacagggtcttgctctgttgcccaggatgaagtgccatgctgcatttacagctcactgcagccttgacctcccacctcagcttccagaggagctgggattacaggtgtgcaccaccacgcccagctaattaaaaaaatttttgtagaaacagggtgtcactgtgttgcccaggctggtctccagcaatcctctggccttgaccccctaaagtgcggggattacacgcacgaacgacttgccacttactatctcactgtgacctggaaccagaaaggagattccgagagtgtgctcaatcaatcacaaactgacctttttcatgggtttcttgaactcctgtagctcttcagcactcatgtcttcccacacctgataaataggatcaatgaatttctttgacctgtcaacaaagatcacatttcaaagtcaagttaaatacttcggcagaagtcaaaattggtttggatcttttctcacaagatctattacccaaaaccaagaagtgaaaactacagcttaaataattacatttaaaaaaaacctggctgggtgcagtggctcacgcctgtaatcccagcactttgggaggctgaggtgggcagatcatgaggtcaggagatcgagaccatcctggctaacacggtgaaaccccatctctactaaaaatacaaaaaattagccgggtgtggtggcggacacctgtagtcccagctactcgggaggctgaggcagaatggcctgaacctgggagacggagcttgcagcgagccgagatcgcgccactgcactccagcctgggagacagagcaagactctgtctcaaaaaaaaaaaaaaaaaagaaaaaaacaaaacaaaaaaacaaccctctatgtaaatgctgtaactaatgtggctctttctgtataagagttcattcactcatgtcgatggagtattgaactaccgtttttcatctttccattttcatgtgaaattgtttctaaactttacaaagactcacaagtcagttagatacagtatatccaaatggaaatgaaaccgtaatattctggaactctcttttttatatttctgtagtaatttgctgaaaagtaagtctaggaaaaacaactaatctggtttcagtcaaccaagacttcagggaccagacaatcccagatggtcatgatgctgctagttattttagaaaccataataagcaaaaatcctgcttccttatacaagtgccaagttaaggctggcccagtggttttctagaacaactcatctagataaatcgctttttgttttttttttgttttgtttttctgagacagagtctcactctctcgcccaggctggagtgcattggtgcaatctcggctcactgcaacctccacctcccgggttcaagagattctcctgcctcagcctcccgagtagctggaattacaggcgccaccaccacacccagctaatttttgtatttttagtaaagacagcgtttcaccatcttggctaggctggtcttgaactcctgacttcaagtgatccgcccgcctcagcctcccaaagtgctgggattacaggcatgagccattacgcccagccaatcgtttgtttttcgtttatcctgtgcaacagaatggtatgtggtctctagaggaaggaacaagacacttggcagaaaattatgaagcaagaaaagacagcaccctcccctatcctggcaccattatccccattaaccttacatgtttaaataacagtttaaagaaaaacaaaaaacaaaaaacccttgatgtcagtctggctcctagtgaggcaaagatctacccactctggggtgcctgcgccactcggcaagtcctgctaggcatcctctactttgcatctggtgaaatatacgcagggagaccacgagatgctcatcaacagcgaggaagggccacttctggtgaagagccctaaatcccaattttgggaaaagcaaacatgtatcacgtttaaatccacctcctggccgggcgcggtggctcacgcctgtaatcccagcactttgggaggccgaggcgggcggatcacgaggtcaggagatcgagaacatcccggctaacacagtcaaaccccgtctctactaaaaatacaaaaaattagccaggcgtggcagtgggtgcctgtagtcccagctactcgggaggctgagtcaggagaatggtgtgaacccgggaggcggagcttgcggtaagccgagatcacaccaccgcactccagcctgggcgacagagtgagactccgtctcaaaaaaaaaaaaaaaatccacctcctccagcgtcaatgtttaaaagtacctacctcttcagcacacagggatcaaaggggaagaaggtgtccagcgggtttgtgcagatctgcactgagtctcctccagcggtactcctaatgactggcagcatctggcgattgttcctctcaatgatggtgtagcagaagacgagctggtacttactgtggaacaaaaaaacaacacagacagaggcattaacatgctggagtgactcggtgcagatgtgagctgcgtgtgacaactgtacctaccacagagaaattgctgaatataacaagtgctagtaaaaataacaatataaagcagaaagtaacacttttagggtaccgttctatgggtcttctatttgcaagtttgctaaggagaaagaaaacgtggctatcactcagaatgtgaaactgggcttatattttaatgagtaatagatattattcattatattttaatgagtaatagatactattcattaaaaataaatgtttgcaaggcaaaactcttagattacgtaactataggtgtctttatttttactgtttgcaaaagaattagaaggttggtggtaaagggattcaggagttactcaggaggaaatagtggttggtgaagagacttgctgaagaagcactgaaaaagaaataagcctttactgaaggagggacacggggttgactaagtcatgacctcaaaaacaggcacagaaaggactaggcatgccgagtgagaacagttaaatgcatagaagaaaacataaaataaagacaattatgtttttaatttttccagtagttgtctctaaatgattgagcaacttgaaaaattatctattggacagcttctccaagatgaggactcagatctcacttctgtcactctccatctcaggttctcaggtcaccatggcaacttcaagccacatactttgatttctgtcctgttagccaaggctcacagcacttgacccctcctcctggtggaggacacatcagcaaaaccacactggagggtggtttgcactatcaggtaaagttgaagatctgcatctcctacaaccccgcagctgaccgcacttccgggtgtgtgacaaggaagcatgtgcccacacacaagaatgttcctgagcactaaaacactaacacagccggctgggcacggtggctcacacctgtaatcccagcactttgggaggttgaggcaggcggttcacttgagctcaggagtttgagaccagcctggtcaacatgatgaaaccccatctctactaaaaatacaaaaattagctgggcgtggtggcaggcgcctgtagtcccagctattcgggaggctgaggcaggagaactgcatgagcctcggaggtggtggttgtagtgagctaagatcacgccactgtactccagcctgggtgacagagcaagaccttgtctcaaataaaaaaaaaaaaaaagacaaaaactaacagatgaaatcccaacaaagactcaataaaaaagattcccagaacataacacagcagttaaaatcaaaataaagctttgtgtcaatatggttcaatctcaaaagcatcaagcaggcaaaagcaacagctacagaatggtacacgcctttatttaccatatctgtacctaggcagagacttttatttcaatcccctgctcttagcctcacatcgcatcacactctgtgcctccaatgcgcatgccaaccccaaatcgagagcccctggaccagatggttcacaaatgcagtcctctgtccccaccccgagaacataccaggggcagcggcctctgctttgcttcatccatcctcactctttgagctgctcaccatcttaaccaacgtgctgaagcctccacccactcactgccgttgcttattggtctctttatgccttttcctaatcctttactatcactgagactcagaagagaggacaccttgaaccagacgcctagcaaaggagaactaaagaggctgacggagctcagcaagctgttggctcttatctgttgaagattttaagctatgatccggcctaaatatcctcattgaatattcaattctccaattcgctttctccataaagcagaataacttagtgaaagcttacaaaggagccagactacatttaaatctgtgctgccagtctagctctatgactttaggcaagtgatttcacctctctgtacctccacctccctgttgataaacagggtttcatcctagaggatcaaatgagttctatgtaaagtgcttagaactgcctggcacagaggaaaggctatggattagccatagctaccagacctgagagaacagaactctctaaaccaatctcttacaggtcaacatttgcctcatgtccagtttatttctattactattacaggagtcactctaataagcatctatggctttgcccctctcagcttactggttgccatacttatttcaaagtgctgccctttggataagaagtagtagtaatttccaacgccatcaaagtataaaaacaatagctgtatcacagtatttcctgcaaggactgggttgtttttgtttgtttaagagacagggtctcattctggagcccagactggagtgcagtggtacaatcagggctcactgcatccttgacttcctgggctcaagtgatcctcctacctcagcctcctgagtagttgggactacaggcacaggcaaccacacccagctaatttttaaaatttttttgtagagatagggtctcactatgttgctcaggctggtcttttaactcctggcctcaagcaatcctcccacctcagcctcccaaaatgttgagattacaggtgtcagccaccacgcctggccttttataatgttactaatttcatagaaatttaacactcttacaatactagataaacataaataaaaatattttaaataactcccatcaagaaagcgtaaataacttactttgtgattgcagcaaaaaagttaaccactgagggcaggcaaatcttcaggggatttagctggctcatcactatccgctcaaaattcagactctgaagatactgcaaacctttggtttaaaaaaaaaaaagatttttttaaaggtacaaataagtgaaaagtgtaagatacttttaaaagcacaaattatcacacatttaaaaaaaactttaaaaaattatttgcagaaatgctttaaataaaggtccatgcagatagtcacacagtatatggcccagaagagtatcactaggctaaccacattcattggtcaccaaggcagcttctctaaagaaaacttaggaagtagcaggctgtaagattccacgacaatgtgaaattcatatgtttgcaagctcagtgtatgctgagataatacagagggagaaaagaccttgtgatttggtttcagctaacaatcatgacaggcaacaaaacaaaacagcaatttgattctagcttgcatgtcttgttagtgaagctgagtgctgttttcaggtgcacagtagtcatctgtagttttttttctaaacaagaaaactccaaatttgccttctacctcaacggacggcaaatttagacagaaaccactttcttagacttaatgaatataattcttttctacatgagtaaaataaagacatcacatttattttaagaggcaagctgaccaacttgtacttaagtatattttcttaggagtttctttgatacgtatttcaataaaaattacctaaatgggatgtcacagcttacaaaaacaagatatttaatccagattcctggcattaatttatacaaagaaaagcagagcttgtatttacttaccttgtgataaaacctcatcctactagttcatacaacatcttttagaagcatgtaggatgtaggtaaacatatataatgcaacacatacaactttcagtttagagctgtggctgttaacccaaggagactgcgacccccgcagaggacacctggcagtatctggagacacttttagttgtcacagctgggggtggtcggggactgctgttggcagctagtaggtggaggctgttaaacatcctacagtgcagaggacagcccccgacgatgaaggatgatgcagcccaaatggcaatcgtgcagggttcagagaccccggtttagaggaagtgacccacaaaaccataagaattattcataaacataaacagaacaatttacaatgacttataaacactgttcttggagactctcttcaactaaaatacactaatctaataagtttcaactgacagatttgaattataagtaactcttagaaattagcaaaacaatactggtcaattaagtctcaaggcttcaggcagagtttaatctatataaactcaaactttagggtcagccaaacctggcttcagttttctaatcctgccactaaccatgtgatcttgggaaaatgactttcctgtgctttagtgctgtctgtaaagggagaatacctgccatttactgggctgttacaaggacaacaaagagaaggtgcatccaactgaagctttgtacagggcgctggcacagcccagggctcagcctcacctctggagacatcttcacatttcaaactttcaaaggcagaaacctctttcttaacctcaaatccatcttaaggggtttgtagggttctcaagctcaaatctatcttaaggggtttgtaggggcctatgagctgcttgaaattattattaaaagtttgagtgcacatgcagttttctgaatccagtttttataaaaatctcaaaaaagtaatgaatcaccattctgaagggtgacaagaacacaaggaaaatccagtccagcactcccacaacactgaccttctttcaggtttccgctcaaaagctgcttgtgtctaaaaacaaaggtgtagaacacagcttggcaggctgagtaaaatggtccatggagagcaacatcgcagaatgcctttgttcccgaatcctggttattaaggtatatgtgcagccagttaaccaaaagatctaggcatgattttacagtactagagaaaagaaaaattcaagtcaactttacacatcataaaaaaaccagaataacataaaaacacacaactgcctttcattacaaaccatgctaagtaagttcataggtttctttaaataatacccatgggtacagaggaaaagcaaagaaaggaaggataaggatgggtgcgtaggaagacaaccttccaattacaaggcagagtagctctgaccttctaggaacaggtgagcccctaagaacgtcccaagggatggaaagcaggttctcctaaccatctcaaaggcacccctcttaaggtgattggccaaacaggacacgttcaccaacacctctcaagagaaagacagtctggtggacttcagtattccctgatgcatcctagtcaagtcctatggtgaataattttgtggttggggaagggtttcaacagcatccttgtccaaaggtatctttatgggccactggaagaaactggcctcctagataggtctattacctttaaaagggtttttcttcagctttaacagatacaatagatttggaatgcaaatgaaaaaatgacaaacctacaaaaagaatcaaaacagtatacaacactgtcctctatccacaaaacaaatggatctttaagtgcaaccaaaagagatgacaaaagccttacatacagggttttatatataaaaaaggagacactttattctaaaatcaccacttagaaatataaacatcttgcacagagtagggattttattcactttaaaaacatgccaaaaaaaatgggagatatttctgacttgagacaatgctatactctttttaaagcatgatattaaaaagtattcggaaaattaggctacttacataagaggaataaatttagctcttgccaaaaagcttccaatataatttccagcagcctgcctgatgatggcaggattacttgggtcctgcaattttttccagagatgttccaaaaatgcctctgcgaatccctataaaaagagagggcgtcggtgtgatcttttttaatgcctaagataatctggctatcaaaatcccaagatttttacttcaccaatgtagggaaaagttctactatctcataactatctcatgggcttcatttttaaaacacattgagagaatatcattaaaaacaaaaggcacctcgggtgttaaataatccagtggatcccaaacctagctaagcatcacaatcaacccggggccaggcacagtggctcacgcctgtaatcccagcactttgggaggccgaggcgggtggatcacccaaggtcaggagctcgagaccagcctggccaacatggagaaaccctgtctctactaaaaatacaaaaattagccaggcatggtggcaggtgcctgtaatcccagctacttgggaggctgaggcaggagaatcgcttgaacccaggaggcagaggttgcagtgagctgagatcatgccactacactccagcctgggtgacagagtgagactccatctcaaaaaacaaacaaacaaaaaacaacaaaaaattcaacctgggaggtacaaattcaataggtttgtgacagggctttggaatccacatattacaaaaactcttcaagtgattccaatgtcagccagaactggtgaccaacaataattcacatcccatggagctccacatgggcactcctgtgagtgcaaagcaccttccggtctctggacacactgaactcaaccacgaacagaaatacggactaacgcacagctggtatttgagttaattatgccaatcatggaaaaaaacagacacagcttctcaccaaagggtgtaacttccaacttctcctaaatagcgctgttctaaagctaggcacacccatgtgggcagactgaattcaaccttctttcccatgaccaacactctcctgatctctaggaagccacaaaatcgttgcagagaaggaaaagccttctacattctttcccccaccaaaaaaaaaaaaaaaagaagaagaagaagaaaagacaaagcctaaagtttttaaaattctagattaataagttggtttgggctagttacaactcaacccttggaaagaataaaggaaatacagttaattaccccatatgagattttaatagagaaaggcttaagggaagagcaccacctagtgaccaaaaggcaggatgacattttcggagcacctagctgggctggcaggcagcaatctgttttctctccaagtgtactgagaagggaacgtgggccaggcacagttgttcacacctgtaatcccaacgctttgcggggcaggaggcgggcagatcacttgtggtcaggagttcaagaccagtatggccaacgtggcgaaaccccacctcttctaaaaatacaaaaattagccaggcatggtaacctgtggtcccagctatcgagagggtaaggactgagagtccgttgagcccaagaggtggaggttgcagcagtgggcagcagagcgagactgtgtctcaaaaaagaaaggaaaagaaaacaaaaaaagaaaggagaatgcgattttattaagcagactagcaagtaagctcaaagaaaagaattatttacttcatggtctccgtccaccccagtttttagggaaaatttttgggcaaaaacaaagtaagctaagataatgttaatcacattcttactcaccaatttgaaactacagaggtaaaacatgaaaaactgtacatggcaggaggcatgggtgggcaacaggagtttgtcaaagatgtttatcaggtcgcgatatagatcctttgttttgccgttatcaaccttacctatggagaaaatctggcatctcagtttttataaagacatattttcaagtttcatctgccatattttttataaacacaacaccattaaaaaacaacattatccagccaagcacagtggctcctgcctgcaatcccagcactttgggaggccaaagtgagagggagcccgggagttcaagggcagcctggggaacacagggaagctctgtctctacaaaaaatcaaaaaattagccaggcatggtggcacgcctgtgatcccagctacatgggaggctgaggcggatgaaccgcttgagcccaggaggtcaaggctgcagtaagccatgtttgtgcgactgcattccagcctgggttagagtaagaccgtggctatttaaaaaaaaaagaaagacagacattatccattaaaataccattaaaacaaaatgctacttttagtttacacagattttcctctgaatataataatctaacacctgcaaggaagcaggccctcacctcacacactgtggcaaggtcagaaatgcaaacccttctgaagagcaattctatcattcgtgtagcaaaagacctctaatccgatcattttactgttagtaaacagctgaatatataggcacaagtatgttcattataactgttacttatcatggtgaaaacagtaaaagacagttaaacccatgtgaccaacaacatttattattacgacttttttttttagagatggggtcttgttatgttgcccaggatagttagtcttgaactcctggcctcagtgatcctcccaccttggcctaagtgctgggattcaataacaattattttaaaacaggcaatgatatgagaaaatgtttatcttcagcatccatgtaaagggcagattatgaaacacttgtgtttagtgtgacacccaaattcactaaaaaatactctcctacatatacagacgctaacagaaaagggaaaaaagtcaaacttcaaaatgctcacaatggttctctgaagagtagaaatgtggccatttaaattgtttttatcctttcctgtagtttccaaattctctaatcaacatgtattatttttataacagcaagaccgttaaaacagtaatgcagtcaactcagattccagttctattattctgactcactgagctcatcttaaatcttagcaatgtgaatggaaaaaaattctgttttcgcctggcaaagcctttaaagttccatgaagtcaagaagcacatatagtactaacactggcacaacaatggtgccaggcaaagaccctctaaactcaatacataacggagcaccatatattagtgcaccctacatcattcttcagtgcattcagcaacttgagcgtaatttgatctaaaactggccaaactccatatataatctttcaatacaacaatcagtgaaaagacagaagacaaatataactcagccagaatcccagtcccattttcaagctatgtgactggcaagtaacttgacctctttaaatcatcttaaactcatactcaatagatatttttacaggatttttagtattactagagataatggatggaaaatgcccagcacaaagccaggtacactgcaggtgttcaataaacagtagctactgtgatttaccatctacatagcagacatccttcatgtaggacaaaaccaaagacatcaggatgtccaggcgctcggctacaggatgcaccatctggtcgagccgttcaggaccagcctttgtttcatgttcagtttcttcatcttcatcctttgaagacaaaaagtaaatactaacattaaaaaattcaatgtcaaagtggtttagtaggaaaactgtcataagtgattatttcccttaaaagataaaacaaagaggctggggaaagcggctcacatctataagcccagcactttgggaagcagaggtggggggatcacttgaggtcaggagtttgagaccagcctggccaacatggtaaaactctgtctctactaaaaatacaagaattagccaggtatggtggtgcacgcctgtaattccagttactcaggaggcagaggcaggaaaatagcttgaactgggaggtggaggaggctacagtgagccgagttcgtgtgctccagcctgggcaacagaggaagactctgtgccccaccaaaaaaaaaaaaaaaaaactaaactaaaacaaagaaatggaccacgcacagtggctcacgcctataattaccaacactttgggaggccaaggcaggaggatcacttgagctcaggaacttgagaccagcctgggcaacacagtgagacctgtctctacaaaaatagaaaaaaagtagctgggtgcggtggtacactgtagtcccagctactcggggaggctgaggtgggcagatcacttgggcccaggaggtcgaggctggagtgggccaagatcacacactgccacactccagcctgggcaacagagtgagaccctgtctcaaattaaaaaagaaagaaaagaaagaaagaaatgcagacacctttccaggcaggggtctcattcagggatgtgaatcagaaccaccagtgaaatttaaaataaaagccaagactcacagcaccagcttctgattctcattgagaagacccaatgagacctatccatgcaaaaatcacagatgccccctacctctgctcctggtgcccaccatggcgggtgcttttggtgccgggcccccttttgcaggtcgggatatccacctccccactgctgtgagtactggcggccaatagctcacagccgcctactttctccagagctgccctgagcagaaaggagccaggaccacccttgcactctttccagcccctcccccttagaaccaatgactgattgacaaggcatcagaaaaggacatctccttggtctcaagctgggaacaaactctgtagaccaatccatgccccagaatgcctggtgggagcaggctgtagcgacctcccaagtgagacccggcccccgtttagctcccctgccctcttctgctccctgacaccctctgtcccaagggcacctgaatccctgtctcagactctccttccactgaacccaacttcagataccacccaaaagaagtaatgctataaagtgtacaagtggtaaaatgcagaaattaaacaggtatgcttttctattaaccacgccctcacagacagcatctggcttacaaaaacaaacactgaaagttacaagaacaaaagtgaaacatacttcaccaaacccaaattcaaagccttggaaatagaccaactatgctaagtgctaaatgacatggcagcaaattactcatataaggaatcgttttcaagtttgctgaactattttaattctttcaatctaaagccttaacaaagatgagcagcactagctgtttccaccctttatgataaacttcatctccactttcattaataaactgctaaccatattaaacaatccttccgtggaatctgtcccaccacaagtttgagttgctgtttcttcagcatcttcaataccctgccgggatgcattcacctataacaaagggagaaaaaaaaagaataaaaggatttaaaaaatacaactatgttattttgggatggaaattcatctgatatacgcatgttcaaggtgtccagattagtgccttatatcacaccccaacacaatacacaattatggtgcaagcctgtaaactgacctaggtcatgaaggaatttaaatataataaaccaagccccttttactacatacttatataaaatcgacaactatcacatgatgctctatgccaggcagcctcaacaaattcaacatttattctagctctgatatggtctggctctgtgtccccacccaaatcacttttttttttttttttgaggcagagttttgctcttgttgcccaggctggaatacaatggcaagatctcggctcaccgcaaactccgccccccaggttcaagagattctcctgcctcagcctcccgagtagctgggattacagtcatgtgccactgtgcccagctaattttgtatttttagtagagatggggttactccatgttagtcaggctggtctcgaactcctgacctcaggtgatccaccggcctcagcttcccaaagtgctggaattacaggcatgagccaccgcgcctggccccaaatctcatcttgaatcgtactcctcctgtaagtcacacatgttgctggggggggactggtgggagataatttgaatcatagggtaggtttcccccatactgttctcgtgatagtgaataagtctcaagagatctgatggttttatcaggggtttccacttttacatcttcctcattttctcttgccgccaccatgtaagaagtgcctttcacctcccgccatgattctgaggcctccccagccatgtggaactgtaagtccaattaaacctcttttttggccaggtgcagtggctcacgcctgtaatccgagctctttgggaggccgaggtggacggatcatgaggtcaggagattgagaccatcctggctaacacggtgaaaccccatctctactaaaaatacaaaaaattagccgggcatggtggcatgtgcctgtaatcccagctaatcaggaggctgaggcaggagaactgcttgaaccccggaggtggaggttgcagtgagccgagatcgcaccactgcactccagcctgggcaagaagcgagacaccatctcaaacaaacaaacaaaaacatctctttttcttcccaggctcagctatgtctttatcagcagtgtgaaaatggactaatacaatctctatgcacaagacactcacagacacattgtgtaataaacatatcgtcaatcaactgagcagaaaaatgatgaactgccagccaaatgtgcatgatgcaatatttattttggtatatcaccattcaaatatcttaacataccactcaaaccatgccattttttattatctatgcttgaccttctttgtaaacattctaaaatgttccttaagtatataccagagaaagactataaagagtacatatacagttggccagagaggtgcaactccaagtgagcactgcaccagtgagcccaagctccagctcttctgagaccttgttccatcttcctgctttcctatagcatcaatgttttcctccaccaaagctcctctcccctcagtccacaaacctgctcacgtctctccactcctaaaccacgcctcttagccctgctccatcccctccttccaccacaaccctgcaccaaggtctctaacagccccaattctgcttccccaccatccacatcctctcccgaaatgcagtttctgcgtcttcactgacatggtcctccagaaagcaacaaagactaccttctaaccactaaatccaaggactgttgctcttttcatctttctaaaaaatgacagcagtatctgatgctgctgaccaaactcctccttccggcggatccttcctgagcatccaggctcttggttttccccatacttctgatcacccttctcctcccctgtcctaaactgcatctttccaaaggtttatgctcaggtccccatctgcagccacgactgcctgtgagtattctctggtaggctgcccaccagcaactgaacctggccaagatggaactactcttccaactgcctcctcttcgtatttttttctttttttttttttttttgagacagagtcttgctctgtcacccaggctggagcggagtggcgcaatctcggctcactgcaagctccacctcccggattcacaccattctcctgcctcagcctcccgagtagctgggactataggtgcccaccaccatacccggccaattttttgtatttttagtgagacagagtttcaccatgttagccaggatggtctcgatctcctgacctcgtgatccgcccgcctcggcctcccaaagtgctgggattacatgcgtgagccaccacgcccggcctcctcttcatatttctaactaccattaatggcaacaccaagattcaattccacagggagcaaagttgaaggattcctttcccttactgtctgcctcccctcctccaaaccagtctcaagcaccagttcatctttcctgacaatgtcactagaatctactacttcctttcattcccactgcaccttagtgcgggcctccttaaacaaagttttaactgtttataattataatctgcccttaagaaaggccaaacaggaaaaatcacttccgtaagaatcccttcctgaccccactgtgattctatcaggttctctaactcataatgtatgtttcattcatagcattttccacaaccatacttttacatttggataactatgtatttaacgccttgttctccaatcatgagaaggaactgtctacaactcccagcacatgcacacattcaaagaaaggaagcaaagaatggtgctagtggtttcttttcttttttttttttttgagatggagtctcgctctgtcgcccaggctggagtgcagtggcacgatctcagctcactgcaagatctgcctcccggattcaagcaattctcccacctcagcctcctgagtagctgggattacaggcacccaccatcatgcctggctaattttttatttgtatttttatagagacggggtttcgccatgttggccaggctggtctcgaactcctgacctcaggtgatctgcctgcctcggcctcccaaagtgctgggaatacaggcgtgagtcaccacgcctggccaagtggattcttttctatcactgactattgtttccacatactgtgattataacaaattcaagtcagtaaatgaaaataaaaatagattactcaatacttacatccaacttgagtagtttttcaataataagctccagaatttcatgcctcaaggttggaaaatatacactaatccttagtaagttatgaacgtaacattcctaaaggagaaaatgtaagataaaacatttcaacagagaataaacgtttcacagttatgtaagcaaaacatcaattacatgacctttagtttcaaatatttaaaaagaaaaaaacagactatccagcaatacaaaaactatactgtttctacatgtattatgttcggtataatcatttcaattattcccagtaaatgaaatttttaatttgcataactataggtttttaagtagctgtattgataaaactcatatatcatacaatcaccaacttaaagtatacaatttaagtttttaatatattcagttatgagaccatcaacataatcaatttcagaacatttatttttcttttagagacagggtcttgctctctctctcaggatggcgtacagtggtgcaatcatagctcactgcaaccctgaattcccaggataagcaatccttcctcctcagcctccctagtagctagaactacaggtgcacaccaccacatgaggttaatttttccttttagagagacattttctcactatgttgcccaggctggtcttcaactcctggatcttcccacttcagcctcctgaagtgctgtgattatgggcataagccactgcgcccagccagcaattttgtaacattttaatcacgctaaaaagaaatcctacatccattagtgcacccctaaaaaatgaagaccttggcaaccactagtctttctatgaatctgcctctttgacatttcatataaatggagtcatataatacatgtttttagggttcaatcatgttgtaacatgtaaaccattcctctcatatcaatggagtcatacacagtttgtggcatgtttttagggttcaatcatgttgtaacatgtaaaccattcctttcatatcaatggagtcatataatacacagtcttttggcatgtttttagggtccaatcatgttgtaacatataaagcattccttttcattgctgagtaatattccattgtaccatgttttgtctgttcatcagttgacagacatttgagttgcttctacttgaggctattatggatgatgctgctatgaccatccatgtacaagtttttctgtggacatatattttcatttctcttgggtataaacccagaaatggaactgctgagtcacgtgttaattctacatttaaccttgaagaaatgccaggctattttccaaaatggctgcaccattttacattctcacagcaacatatgacagttccaacttcccatttctccatatccttgtgaacacttgttactgtcttctcgttctgattatagccatccttgtgggcatgaagtgaaatcatttccctgatggctaatgatgttgagcttcttttcatgtgctttttttgcagaaatgcctattcagatcctttgcccacttcagttgggctatttgcccttttattattcaattataagagttctttacatatacaagtccattaccagacataaaatttagaaatatttcctcccattatttggggatccttttcatcttcttgaagatgtcctatgaagcataacaacgtttaattttgaagtacaattgatgcatttttttctttggttgcttgtgcttaggcatcaaatctggaaattactgcctaaaccaacatcatgaaaatgtactcgttttcttctcagagttttacagtttttactcttcatgtagggcttttattgagttcatttttaaatatggatatccatatgcttcattcttttgcatgttcatatccacttctgccagcagcatttgttgaaatgactattctcccctattcaattgtcttgaacaactggttagtgtatgttagtcttctgtcccgtaaccatgctgaactcatttattatctctaaaatttcttgtgtgtgtgtaaactccttagaatgacatataaaatcaccttgcaaaagagagtttacgccttcctttccatctggatgcttttaattctttttcttgcctaactgccttggctagacaagcagcaagagcggacatccttgttttgttctttgtcttaggaaaaaacttttggtctttcaccaatgaatatgatgttagctgtgggtttttcagatgccctttatcaggttgagaaaatttccttctgtttttctcgtaaaaggatattggtgtttgtcacacacttctgcatctactgagatgattatgtggtttttgtcctttgttctattgctacaaaatattttattaattcattttcaggtactaactcaatctcggccggtcacggtggttcacgcctctaatcccaacactttgcgaggtggagacgggtagatcgcttgaggtcaggagttcaagaccagtctggccaacgcggcaaaatcccatctctaccaaaaacacaaaaattagcggggtgtggtgccccatgtctatagtcccacctactcgggaggctgaggtgggagagtcacttgaaccctggaggcagaggctgcagcgagctgagatggtgccactgcactccagcctgggtgacagacggagactgtccccccacccctgaaaaaaaaaaaatcaatcttgcattcttaacatcagtcgcacttggtcatggtacataattctttttgtatgctactagattcggttttctactaaggcaaccactattaattattaaaaactgcacagatgatctgaacattgtacaaaaacttaagcagaattcttctatggaaggctttgtcttcaggttaaaataaggcatgttcacaattagtaatacatgaactattatcttctagtaattcttgtccatatgagcataaagccactacagatattcctgaaatgaactcagaccttgacttgcacatagtaataacagaaaaaggcactgggaatccccaatagccgctttataagaaaggaatctgagtcaaattcttagacgtcagtttaaagtctagaagacaaagtaacctttaagaaaaagacctaacattagctgggcacagtggttcactaatcccagcactttgggaggccgaggcaggcagatcacaaggtcaggcgttcgataccagtgtggccaatatggtgaaaccttgtctctactaaaaatacaaaaattagctgggcatggtggtaggcgcctgcagtcccagctaatggggaggctgaggcaggagaatcgcttgaacccgagaggcagaggttgcagtgagccaagatgacgccattgcactccagcttgggcgacagagtgagactcggtctcaaaaaagaaaaagaaaaagaaagactggaaaagaaagaaaaagacctaatatcatctaaaatgaaatcgtacaaacaacttttccatgatgttctcaatgaaaagatttcttaccagtgttctctctgattttcgaacaaatggaaatttttccaccagtattggcatgagaaaccacggtgtcctatttttaaaaaattaaatcaatccatgttaactttactttctagaaaaggaataaaaaggaaaactaccattctaaaagcaaatattgatagacataggaggcaaacaggaacccctacctcaaagaactggaactttttttgttttttgagacggagtttcgctcttgttgcccaggctggagtgcagtggcgcaatctcagctcactgcaacctccgcctcccaggttcaagcgattctcctgcctcaacctcccaaacagctgggattacaggcatgcgccaccatgcccagctaattttgtatttttagtagagacggggtttctccatgttggtcaggctggtctcgaactcccgacctcaggtgatccgcccgcctcggcctcccaaagtgctgggattacaggcgtgagccaccgcgcccggccagaactggaacttacaatgtatagcttctgagaaaatctataacgacttagagaaaataaggttctgttaactctgatatcaacagcaaatcaaagagggagcttctctcccacagaaacataacagcacttttgctgacatttcccactacacatgtatattatttttaaaagaagaaaaaatcatcaagttggattttttttaagttaacaaataatcaacggacagagggaactagaggtccacccctccaaaagaaacccacaaacctgaaaagcttttcttagaagtgcaatttttattcatatggcatgacacaaacacacccaggggtttctcactgaaaaattttggatagcatatctgttgaagataaaagcaaaattccaaccaccatacaaaattgggggaggatctgcatacaaactttgaaaaacaattaaagagaataaatagaaaatggaaatgccactttttgtagaatgtaatgtttcctcaagtggatacaaaaaaaacatgcaatgtaagactcaagctttaatactattaacattttataatttttactaattgattacaattttcttgagaattaaacattcaaaataaggaaaagtatactcacgatggtacatatcttgctattatttgcaaggctctgtgacatgtgtcaaaatttgcaggaagatctgaaaggagaaaagttcagagtatgagcatcaaaacaaaactgaagggcgacacgcttgaagctaaaaataaatgctggctgggcacagtggctcacgcctgtaatcccagcactttgggaggccgaggtgggtggatcacctgaggtcaggagttcgagaccagcctgaccaatatggtgaaaccccatctctactaaaaatacaaaaattagccaggcatggtggcaaatgcctgtagtcccatctactcaggaggctgaagcaggagaaccacttgaacctgggaggtgaaggctgcagcgaaccgagatcacaccactatactccagcctgggcaacagagcgagactctgtctcaaaaaacaaacaaacaaaaagtgacatacttgaagctaaaaacacatgctaaccaaaacggaataatttatcagagaaataataatttcaagatttttctccaccagcatcaacgaaaattaaatggactaattatataaataatgcattcaggacaaatgactgcatatcaatggtaaatataacaaaaagattacatcaaaggttgtcatttgttgcagtctacttattagaataggtgccaggtattctgtgctttacttttttttttaaagaagacagtgtcttgccaccaagcagggcttgaactcctgggctcaagcaatccacccacttaagcctcccaggtagctgtgactaaagacacacactaccctgcctagttctactttaagccttttttaagaaaatatttgaaaaaaaatgtttttttgcagagacaaggtctcactatgttgcccaggctggtctcaaactcttggcctcaagtgatcctcccgtcttggcttcccaaagtgctgggattatgggtgaaagctactgtgcccaggctttaaacctttttatacttactatcatcttcatcatcagaatctgaaacatctacatcgccttccttaatgatcactcgggcttttgagggaaaaagaaaatatgttattctgtcattgatctagacaatgaatggctatacaaaaaaagttactgacctagacaatgaacagctataaaaaaagttatttttccataatccaaagttagcccaatgattaattaaacgcacaatctgaaaaaaagtaaagcaactttatagtttttaaacggctaaaaattcctagatttcaccaggagttcaataaagcaaataaattcataaaactcacagcaacaaatgaatctagacacctccataggggtcattacggggaatatatgtctaccagacctggtgccaatatgcatctggaatcttccatggtagcagtctctcatatataaggggaaggtagtattttaataaagaagtattaaaaagaaaataaaattccaagcaatgacttacgaggcacaaaatgggaagcaatcatgctgagacacggtctgaggaaaacagtctgtgctgatacaagattaccaagaaaagccaaatactcttccactactgtttgacttctattcaaccaaggcaatctctagagtgggggaagaaagataaaagcagcatgttattaatataacatatactattaccaaagttctgaattacatactttacagtaaaataaatggtgaacttactaatataatactgataagttgctcaaagtcttttgtcaagtacatgatagaagaacggaattctagcagccagttgatgatctggtcatccttaagttaaacaaagagtactttcaaaatcacaaatcctctaacataacagaaatttacagctatcttatatcaatcatttatcaagaataggttggggggaaaaggtcacaaacttggaaggaactcaaaactgggtattaaaacagaaaaagatgtcacaataaattacttaactgttttaagaaagtaatctagtaactctaatacacaggagaaagacttaaatgcaatacttcagcctgatcacttctgtttgccctgaaaaagcgaaatcacctcaaatgttgacacctgggacttttaaaaactgcagcattctagcagactgaaatattagaagatcacaaaggaacaatagctacctctatttcctctatattcaagctgaccaggaagcatgctgataaaactcagtcgaggctgatcaattggggtcatgaataaacataacttttctaaaccaaacctgtggctgagtttaaatatattatgatgtgattgttctgtataaatgatagccccattcctccatgaaatatttttcgggcaatcaaattactgttcatagtaattgttagtgacatgagaagaactgctaaatttgaaacgcaatgtataaaatacagtgtcaattatgtaaaatattactatattaattatattcatgcatatatactgcacaggaaaaaaaccattaagaaaaagcccctaatttgtggaaggcttagacatataaataaaagcaacacaaggtcatacctacagggatattcatatggagttatcatttagtgagaatacaccatatgccaggcatggtgcctgacactccacatatatatcttcttctaatcctaaaaactctgcaagatgtttagttattcccattttgctgttcaggaagctgaggctaagaacgattaataagcaatctgcccaaccaagaggccagtaaagaagcaggtccaaacccgtctgtctcggtcaaggctatcctctgtccaccgtcccacacgcctccctatatgcggagaagaagctgtccccttttccccaccttaattcagctactgagtgcttactatgccatatccatgtgtcaaactcccacagatcaaccattttctgatgaaatcccaagtagcctggcagtaaaataaagtaaaaccacaactcatttgtactatggtaatttcatatgtccacaactgttaaggataacattaacggtagctcactaaggccaaaggcatgtagaaaacaagctaagttagtgtacaaataaaataaactatcctatctcttttccactaaaaagactgcaacaaaactataaggataacatttaaactgtaccatttttaaaagtaaatcaggctgggcgtggtagctcatgtctgtaatcccaacactttgggaggccgaggtgggtggatcacctgaggttgggagttcgagatgagcctaaccaacatggagaaaccccgtctctactaaaaatacaaaattagctgggcgtggtggtgcatgcccgtaatcccagctactcgggaggctgaggcaggagaattgcttaaaaaactcggaggcagaggttgcagtgagccaagatcatgccactgcactccagcctgggcaacaagagcaaaactccgtctcaaaaagaaaaaaaaaaagtaaatcagttgcagactttgatgctttagtactgaactattattatttctactagcaggcaggaacagtggctcatgcctgtaatcccagcacttttgggaggccaaggcaggaggagactgcttgagcccaggaatttgagaccagcctgggcaacatggggagacctcatctccagaaaaattagccaggcatggtagcacatgcttgtggtcccagatgctcgggagcctgaggtgggaagattgcttgagcctgggaggttgaggctgcagtgagccatgatcgggcccattacactccagcccgggtgacagagcaagaccctgtctcaagatggaaaaaagttctacttgcaacactccacacaactagtgcaattcttggtatgtcaaaataccaagaatgagaactgctgatacaaaatacagtggaacacaaagaaaatgtccctttgtatctgggaaagaaggcaggggtcaggaaaagctttaaagagaaagtgatgcttcagctgtctttaaacagtaacacagttgagtcttttctggaagttctgcttcttacagaaggaaaagtatgttttcagaaaactgaaaaacgttcagtatggcaggcatgtatagtgaccaagccaacagataataaatctggggaacaaagaagcaccaaatagaccatggggggccttgtaaaccagatctgtaactagagagatctggaagtgtgggaaatggactcaatgaaggaacaaccatgtgcttagagagaaccagggaaagctccatgaaagatggagcccagccaagagtggacatgctaagtttggagcatctatgatgattctgggtaaatgcatctaacagacagttaagaaacaagtctaggccgggtggagtggctcacgtctataatcccagcactttgggaggctgaggcgggtggatcacttgaggtcaggagttcgagagcagcctggccagcatggtgaaaccccaaatctactgaaaatacaaaaaaattagctgggcatggtggcacagctactcgggaggctgaggtgggaggatggcttgaacccaggaggcagaggttgcagtgagccaagatcatcccactacactacagcctaggtgacagagcaagactctgttctgcccgtccccaaaaacgaaaatgaaataagtctggagcccacaagagcaatcttggctacagacacaaatatattaggacacaggtagatttcaaagccatgaagggagatgaggagatcacacagaagaatcaacagagtgagaaaagagtcaagttttgaagcccaatcaacaccaaatttaagatcaagaaactatcaagaaatactagcgattaaaggatcactggccgggcgtggttactcacgcctctaatcccagcactttgggaggccaaggcgggcggatcacgaggtcagaagatcgagaccatcctggctaacatggtgaaaccccacctctactaaaaatacaaaaaattagctggcggtggtggcgggcgagtgtagtctcagctacttgggaggctgaggcaggagaatcgcttgaacccgggaggcggagcttgcagtgagccaagattgcgccactgcactccagcctgggcgacagagcaaaaaaaaaaaaaaaaaaaaaaaaacagattaaaggatcaggagacaggaggatcagaaacgctgaagttttaagaagtgggtggccaacagtgtcggctgatacaaggaatacaaggcttaaaaaagtaagtccactgaggctgggctcagtggctcacacttgtaatcccagcactttgggaggccaaggcgggcaggtcacctgaggtcaggagttcaagaccagcctggccaacatggtgaaaccccgtttctactaaaaataaaaaaaattaaccaggcatggtggcgggtgcctgtaatctcagctatttgggaggctgaggcaggagaattgcttgaacccaggaggcaaaggttgcagtgagcccagatcacaccactgcactccagcctgcgtggtaagaaggagactttgtcttaaaaaaaaagtccactgaaatcagcatgtaaaaaaaaaacatgggtaacctgtcagggtaattactacagtgataagaacagtggacttaaatgtgagtgagaaatgatacagcgcagtcagctggaacaaaaacaacagatgacaattattgcccttactttgagtcagagactgttctaagtgcttcttgcatattagctcattgaatccttgttaagtatttccatgtttaaagccaggcactttaaacatggcatgcacctatagtcccagctttttagaaggctgaagagaaaggatcatttgaggccaggagttcaaggctgtagtgcactatgatcacacctgtgaatagccagagcaacacagcaagaccacatctcttaaaaacaaaacactccatattttttaaatctctattgttttcttggtttcacacagtggaaaatagaggcagagaggttaaaacaatttgctcaagatcacacactggataataaaattggaatttcattccaggcaatctaactaccactgccatagtaataaaccattctcttcaaaactgggcagtaaaggaagaatggtgaaacaaaatgcattcagcttttactacatgataggtgtatctcgaacctggaaatgctgaatcagtggtttgttttttttttttttttgctttgttttagctttaaagagacaagagagttgcatgcagcatggaggaaagaggtagtaatctaatagaaaggaagcattagagcagggtttcccagcctcaacactgttgtcatttggggctggatcactcttggttctgggaggctgtcctgtgcactgtgagatgtttagcagcatctctgtcattcacccactagatgccagtagcaccctttcctcccagttgtgacaaaaatatctgcagccatcaccaaatgtcttctagggggtaaaactgtccctggttgagaaccaccagattaaaataagggaggaccatggagagagcaagttctggaggacagaatgggacccaaagagcaaactatgtctgtatacagtggcaataattttgctaatgatcaaacacaaaattaattacctttatgtctggatctaacagctggttcttcaacaactcaaagtcatttgtttcacccttaacaagaaggggaaagaattaagttatgcttttgtttcctgtttagtatcaacagcaagacttttaaccgtactttaacatcagatgaaattataaaaggaacactaactttcacatgtcaattgcggattataaaatcatgactacaaaaatttaaacactcatgttagtgcagccagagggcttggaaaaaggaaaatgataaactacatttagctatacttctgtattgacatttgaatataatagttgatactcctgcgaattctcaaaaagcatgagggaaaaaaacagccagctataatgatctaattcaggaggatctaaaaaagtattcactcaaatatggatacaaatggatattacatataaacatatggttacttaacattttccctctactgctgagatacagtagaaatgcttctaaactaccacaaaaacaaaaatccctactcagagaactggtttactgtcccaaagtaatgcttaggtaagttcctcaaaaaataaaatgctgtaggccaggcatggtggctcacgtctgtaatcccagcactttgggaggccaaggcgggtggatcacaaggtcaggagttcgagaccagcctggccaacatggtgaaaccctgcctctactaaaaaaataaaaaaattagccaggtgtggtggtgtgtgcctgtaaccccacctattcggaagactgaggcaggagaattgcttgaacctgggaggtggaggatgcagtgagccgaggtcacgccactgcactccagcctgggtgacagaggaagactccagcacaaataaataaataaataaaatggtgtaattgtttttaattctggcacttgctaaagttaaaagatgcttcgtaaataaagcatttgaagaggtgaaacctcagtaaagacattattactctctcattattacctgtgaaatgggccaaggtgggggaaaaaaaggacactattactctaattttgcactgacggcatcatgctattattaaatatttgatttcaactggtatcttaattaatcttgctatttctattggtctttagtataacagcaatagttgtattctgacctaaccaaaagcaaacctcacacattatctccccttacctttttgtacttcagcaagacttctgtcacagttccaccaaaccgaacagtttttcttgggggagaattgaaaaagtcattctctaatgcacgcatatttgaaatcctgtggaaccaagattaacaagctattaagttcatgaaaataataaaaattataatagccaacatttattgaaccaacataattcagtggaactattgttaaggcctctttactggtctccctgcttccactcttaaccaacaatccttcctttgctcagcaaccaataactgtcttcccactgcacttacagtaaaaatccaaatctctcagtgtggtctttaagatcctacattaatctggcccctgcctacctctctcacctcatctccaacaacttgttttactacagccataacgtcttttctgctcttcaaacaagccaagctgtttttcatttcacttactgttcactctattggaaatactcttttcccaaatctctacgtggctggatttttttttttgagatggagtcttgctctgctgcccaggctggagtgcagtggtgtgatcttggcttaactgcaacctccatctcccgggttcaagcaattatcctgcctcagcctcctgagtagctgggattacaggcacctgccaccatgcccggctgatttttgtattttcagtagagacgaggtttcgcacgttggccaggctggtctccaactcctgacttcagatgatccgcccgcctcggcctcccaaagtgctgggattacaggcgtgagcaaccgcgcccggcctagatttttgtcttcattcaagtggaagctcaaatgacagatgtcttcccaatgagaaatctcaaaagctccttctctcccttctccctcccccattaccttgttgtataactgaaatcatcgtgttcgtttatttattggcctatgtactgcctttcccccctatgctgtaagctctgtagaaagcagggacattagtgtctttggataaaccactgtccccagtgtttaacacagtaagcaggagctcgataattattatgaatcatattacgctaattgttttacaaggtttgcttcacttacacgtagtaaattaatgaaaaaacatagcatcctaatgactctgaaagttaaacgccaagagtgctacgggggttagggattttaaaagtggagcaaaataaagactgcgaaacaaatacgtgtgtcgaaacaaattccaaacaaaaaagatgtaatattcaatttgccatgagtgacgacgttcggctgataacccacatagcccagggaaatcccttccaaatttggacgaagaagagggaaggaagaggggtcaaggcgcagaaggcagtacccaggcctgggaaatcacgaagagacacagtcgggaaagggggcctccagaacagagaacatagtcacttttccaggccccacccatgtctattacccagttaggaggaatgagctcatttctgtgaacgtgagatgaccctccaccccgtgctcctatcacacgccatgagctttgtcccacatcctttcaatccgctcctctaagcgccgtcctgagctttcgtcccagatacgcagaaggaagcggcctgaatcttacccagtcctcgacgcgcccagcttcttaactgcagaggacgaagcggccgcatctcccggcaaacgcgtgtgaagcagcggtgccgccattgggccgaactaacgcgaccgctgcgcctcaggccggatgcccagctccttccagccacagcctctgtcccggaagttgcgcgtgccagcgcaaccttcagccaatcagcggccccgcgtggggagggcgtatgctctcggcgggctagagcgccgctgaaacccgctcctcgttctacttggaggacttgttccagccagcgctagtgcgtgagtataaggagagacgggaaggaccggctccatccagccctgaggatcccgaagaaagggtggaaacaccctggatgtgctaagctgtggccgggtacactcaagtgttaattttttggagtcaaagcctccctcagtcaaatcgaagaaactgaagcacttgtgactgacccagatcttcacggaggaaaggggattcgaacccggctgacccaggagcctgggctctatactcagtgcagcagtctcacagacacccaagataacgttatcctcacggaaacgagctcgacgaagtgacctacctcagagcctcaaggctatggtgatgctggcatgagaaacaacaggagagttacgaagaggtgttacccccttgactttatttatttatttatttattttcttttgaggccgagtcttgcccttttgcccaggtggagtgcagtggtgtgatctcagctcactgcaacctccgcctccccagttccagcaattctcgtgcctcagcctcccaagtagctgggattacaggcgcatgccaccacacccggctaattttcgtatttttagtggagacggggttgcactgtgttggccaggctggtctcgaactcatgacctcaggtcatccgcccgcctcggcctcccaaagtgctgggattacaagcatgagccaccacgcccggccaaacttaaatttttaaaagaggaacaggagtcagccagaccaacaaaagagccactggcgttccaagcataggaaacggaggaaacagaggccaaaacctcgggactgtggaggatgtagagggagagcaggggctgcccctactctcagggaggggaaaaggttgcaactttggaaactgtacaggcctatcaaaaatacaaaaatatccagcctgggtgacacggtgaaactccatctctacaaaaaatttaaaaaataaaaataataaaaattatctgggtgtggtggcacacacctgtagtcccagctactcgggaggctgaggattgcttgagcctgggagatagcaccactgcactcctgcttgggcaacagagtgagaccctgtctcgaaataaataaataagtttttaaaaatgcatatgtatgggcccggcgcagtggctcacgcctgttatcccaacactttgggaggccgaggcaagtggatcacctgaggccagaagtttgagaccagcctggccaacatgacaaaaccctgtctctactaaaaatacaaaattagccaggcatggtggcagtgcctgtaatcccagctacttgggaggccgaggcaggagaatagtttgaacccaggaggcagaggttgcagtgagccaagatcgtgccattgcactccagcctgggtgacgagtgaaactgtgtctcaaaaaaaaaaaaggtgtgtgtgtgtgtgtgtgtgtgtgtgtgtgtttatatgtatctctctccaggagttcaagaccagcctgggcaacatatggtggtgcatacctgtagtcccagctacttgaaaactgaggacggaggatcacttgagccctggaggtcaaggctgcagtgagctgtgattgtacccctgcactccagcctggacaacacagcaagaccctatttcacaacataaaatacagcaatttggtttttttgttttttgttttttttttgagacagagtctcgctctgtcacccaggctggagtacagtgtcatgatcttggctcactgcatcctctgcttcccaggttcaagcgattcttgtgcctcagcctccccagtagctaggattacaggcatgcgccaccatgcccagctaatttttgtatttttagtagagacagggtttcaccatgttggccaggctggtctcaaactcttgacctcaagtgatccgcccgccttggcatcccaaagtgctgggattacaggcatgagccaccacgccccgccagcagtttgttaaacataaaccatagctctgttttgcaacagtgtaaaatcagtaactgtctttcctgagtctctatttggtccttactgagttccttgggaatgttggacaggaatcatctgtgtctcaaggacagaggaaataattgcaccgtagctcacaaagatacttcaagataactgtttaaatgagaatctcttcttcacttccaagggaaagcaaagcaaaaacaaaaagcaacaatagcaaaacagcaatctgacaattatctgttttgttttgttttggtttgagacaggatctcattgtctagcccaagttagagcgcaatggcgcgatcatggctcgttgcagcctcgggctcctacagcttatgcaatcctctcacctcagccgcccgaacccacaccaccaagcccagctaattttttgtatttttggtaaatacgaggtctcactttgttgcccaggctggtcttgaacccccggcccaagtgatcctcccaccttggcctcccaaagtgtgtctccccacctacactcccattctttcccttaaaaaaagtctgagtctgggtgcagtgactcacacctgtaatgccagagctttgggaggctgaggcaggaggataacttgaagccaggagtttgagaccagcccaggcaacacagccagactccgtctctacaaataacacttttaaaaaacttacccaggcatggtggcacgtgcctgtagttccaattatttgggagacagaggtgggagaatcacttgaacccaggagttggaagctgcagtgagctatgactacaccacgacactctctggcctgggtgacaaagcaaaatctcatctcttaaaaaaaaaaagggaaaaaaagcttgatatgtacaaaataatatgttaatgtaagttataagaacataatgggccagacacagcggctcctgcctgtaatcccagcactttgggaggccgaggcaggcggatcacgaggtcaggagatcgagaccatcctggctaatgcggtgaaaccccgtctctactaaaaatacaaaaaaaaaaaaaaaaaaaaaaaatgtgccgggcgtggtggcaggcacttgtaatcccagctacttgggaagctgaggcaggagaatggcatgaacccgagaggtggagcttgcagtgagccgagatcgcgccactgcaccccagcctgggtgacagagtgagactccgtctccaaaaaaaaaaaaaagaacataatgaacacctgtgaacatatcgcccaatttaagaagccgaacattaactaggacaattgacacttactctgtgctgctctcggatcccaccttctacctgctttcctcccaaaaatagtcaccatcatgatttttaaaagtcattttagttttctttgaataattatcatatttatactcctaaacaatgcactatatttacttttatttgtctttgcattttataaagttatctccatgctgtattatactgctgtttgttttcaacattatgctttttttttttttttttttttgagacggagtctccctctgttgcccaggctggagtgcagtggcatgatctcccgccgtcctcccacctcggcctcccaaaatgctgagattataggcatgagccaccgcgaccagcctgaatattcttgtatcatgtcctgatgtatgtgtacaagtgtttttctagggtggaactgttgggttggagggggcaccaaaagcttttaggaaaggagaaaggaacaaattggatatctatgattttttttttttttttttgagacagagtctcactctgttgcccaggctggggtacagtggcacaagctcagctcactgcaacctctgcctcccgggttcaagcgattctcctgcctcagcctcctgagtagctgggactacatgtgcccgccaccacacctggctaatttttgtatttttagtagagatggggtttctccatgttgcccaggctggtctcaaatgcctgacctcaggtgatctgcctaccttgacctcctaaaatgctgggattacaggtgtgagccatcgtgtctggctactattagtttttctatttagaaattgttcatctggatcctccctacctttcagccatttgcaatacatttgttgagcataaagagtgaccttcttggccgggcatggtggctcacgcctgtaatcccagcacttttggaggccaaggtgggtggatcacctgaggtcgggagttcgagaccagcctgaccaacatggaaaaaccctgtctctactaaaaatacaaaattagcctggcatggtggcacatgcctgtaatcccagctacttgggaggctgaggcaggagaatcacttgaacctgggaggcagaggttgcagtgagccgagatcactgccattgcactccagcctaggcatcaaaactccctctcaaaaaaaaagagcaactttcttgtccacagcaaagaatcactggaagccatttgatgcaatatgacctcatctctctagccagtgtcgattgggttacaggagggcaccaagaagctttttgaaggctgtgccaatgtacacttccagcaatatcttcttaagcttgagtgcagctccttattttcccaaagcacagctaagactaaggctgccaagtttttaaaaagatttaaaggaaactctgagcattatacaagaaaaatactggccgggccctgtggctcatgcctgtaatccctgtactttgggaggctgaggcaggtggctcacttgagatcaggagttcaagaccagctgggccaacatggtgaaaccccatctctactaaaaatacgaattagcaggtgtggtggcaggtgcctgtaatcccagctacttgagaggctgaggctggagaattgcttgaacccaggaggcagaggttgcagtgagccaagatcgcaacactgcactccagcctgggcaacagagcaagacttggtctcaaaaaaaaaaaaaaaaaaaaaaaaaggagaaaaagaaaaccttaaaactaaatgcataatttctgttgtaattctttgaccatgtccgttctttgtggagcctctattcagtcaaattgtcctgtgggccaactcatcttggcaggataaaagcctccttatccagtcttgccttccccagagaaaataaagggggtgggggagggataaagaaaattaagaccctccccctccaaaaagagaaacaacaaaaagcatgcaaggattaacatgctatctgcaaagtcaccaccctgcccacagtgtggcctttcacttcactgagtaatatattgtttgtaatacaacaatgtaatcagcttcttcattccagaacaaaattttgctttactatcatcatatacccagaagacccattaaactgttatttcaaaacagcagcctttccttagagataaattttacagctacccctagagtagttctgttggccaaagcctcttagcttgctagtgaaagaaacaaagtcaagccagcttaagcagaaaaggagaatttgttctgaggatacaaatatatagtaaggtaccaaaaaagaatttatcattggccaatttggataaggtgccctcctgtaaccctcctgtaatctaatcaacactgttagagagatgaggtgacagtataccaaatggcttttgatgaatctttgctgtgaactagaagggattaagttatgctcaactaatggtttgcaaatggctgaatggtagggcggatccacacgaaaaatttctaaataacaaaaccaatagcatgtatctcatttgtcctttttcctttccaaagagtcaacaattattgtatgagtcaattatctttataaaaactacattcattaacacaaatgcaagatctcaactatatatctttagttatatacatgtatacacatatatgtgtatgtatacatacattatcctcaaagacaactaatttagagcgttcctcatcccagtatctcagagaaatacaaagcagtttcttagatttggcatcattgagattttgggccaaccagatacttctctgttgggtggggaggaggctgttctgtgaactgtgggatgttcagcagcatccctggcctctacccagtagatgacagtagcactcctctcctccccacagtaacattcaaaaatatctccagatgttgccaaatgtccctggggtacaaaactcttccaattaagaaccactggtataaacaagtcagctgggagtggtggcacacacctgtggtcccagctatatgggagggtgaggcaggagaattgcttgagccaggagcttgagaccagcctagccagaatctctgcctagcctaggcagatctctacagaaaaatacaaaaatcagccatagtgttggtgtgcacctgtagtcccggctactcaggaggctgagacgtgaggatcaattgagcccaggaggtcgagactgcagtgagctatgatctccccactgcatcctgcaacagggacgctatctcaaatagttaattaattaatggaagaaagaaagaaatcctagctttgtaatttactctattactttgggcaattgccttatgtttccagaacttcaattttcttatgtacaaaatgggaataactttttgagctattttagagctatcgtaaggattagagcacataaccacaaaccacaaaatatgtcacggtgtacaggacagggcaggttctccgtaaatgacagtatttgcccatttattttcctgtaaatatgaaatatactaggatacttgatgtggttacactcaggtggaaactgacctatgagggagatagacagataggcacggtcttttttgtttgtttgtttgttttttgagacggagtctcgctctttcacccaggacggactgcagtggcacgatctcggctcactgcaaactctgcctccaagatgcaaatgattgtcgtgcctcagcctcccaagtagctggaattacaggtgtgcactaccatgcccagctgttttttgtagagatggggttagtagagatttgtttaatagagacggggtttcaccatggtctctactaaaccctgtctctactaaaaatacaaaaattacccaggcgtggtggcacatgcctgtagtcccaggtactcaagaggctgaggcaggggaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggactgcaatggcgtgatcttggctcaccgcaacctccacctcctgggttcaagcgattctcctgcctcagcctcccgagtagctgggattacaggtgcgtgccaccatgcctggctaattttgtatttttggtagagacagggtttcgccatgttggtcaggctgctcttgaacgcctgaccttgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggaggaaatccaattttacgagagggtgtagcctggtgaggcctggatgacctccggaggcaggggcttgtgcctgggctgaggcctaagggtcaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcaggacagggcatggtggggccaaaggaatcattacccaagacggggattttcagggaaacagcttagataaggccaggtgtacagtagctcccacctgtaatcccagcatttggtgaggctgaggtaggaggactgcttgagcctgggagttcgagaccagcctaggcaacatagtgagaccccatatccacaaaaaatttaaaaaaggagtttgtgttcctgtagtagcagacttgggaggttgaggtggcagtatcacttgagcccggaagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacgctgaagtgggaggatcgcttgagcccaggagttcaaggctgccgtgagctatgattgtgcctctgcagtccagcctgggcgacagagaaagaccctgtctcttaaaaaaaaaaaaaaaaaaatcttagataagaggatgctgtgcctccctgggggtcttcagtcacccatggtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgtggcaataaccactgcttccaagtctctatagaccaccccttgggtatatctaatgtaagtgatatttattttatttattttttgagtcagagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccgggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttcgttagtttcttcagattatcatccactgagggtggaaggggagtgagcagacacacttgggaggtgtcttgagattatcatccgctgagggtggagctgagggtggaaggggagtgagcagacacactcgggaggtgtcttgagattatcatccgctgagggtggagctgagggtggaaggggagtgagcagacactcggaggtgtcttgagattatcatccgctgagggtggaaggggatagagcagacactccgcaggtgtcttgaggctcagggagttatcagttatagaatgttgttgagttggaggaggtggctggtggcccatcctgttttttaaagtttcagctgtgaggtagggccagcagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcatatcacccttccactgagtactgccgacagctggggggtaaagaaaagtcactgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccattgtccacacatgttgcagcttctttttggagaatgttttccaggccctttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgttattacaaatacggaacctctgacacttagaatattagatgggggccccactgggtggggatgaaggtgtttttgcgcaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctgtaagagtacagtctgagccggtcacggtggctgatgcctgtaatcccagcactctgggagggcgaggtggatggatcacgaggtcaggagattgagaccatcctggctaatacagtgaaaccctgtctctactaaaaatacaaaaaattaggcgggcgtggtggcaggcacctgtaagcccagctactcgggaggctgaggcaggggaatcacttgaacctgggaggcggaggttgcagtgagccaagatcacgtcattgcactccagcctgggtgacacagcaagactccatctcagaaaaacaaaaacaaaaacaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttactgtgtttcacagggcagaaacagctgggcttataaacaggaatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtgctttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgattcaaagatcccccctgcaaccttcccacaaatgaaccaactgattctcacaagcaaagggagaatggacacctcccattgagggacaaaaaaaaaatcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgctggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgtcatgtcctgaaaataggtgacaactgcaaaccatccaccctggtgttgactgactttaacaaggttcagttcacagagattgagggcagaaaaaggaaatggcctcaaaagggtaagtttgctgtgttgccctcacaccacttgattcatggtcctgatcctaaggatctcacctgatacttggttttataggaaggatgtataaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccgtggcctttgtagggactgagcctgcaccgacgacctcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatgggcagcaaaatacaatgtaatatgaccaaaacatgaaagactgtgaaaatgaatctggaggtgacccaagcattgaattcaacaatccaggctgggtgcggtggctcacaccgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaaaaaaaaaaaaaaaaaaaaattggccgaatgtggcggcacacacctgtaatccaagctactcgggaagctgaggcagaattgcttcaaactgggaggcagaggttgcagtgagccaagattgcaccacagcactccagcctgggcgacagagcgagactctatctcaaaatttaaaaaaaaaaaaaaaaggctgggtgtggtggctcacgcctctaatcccagcactttgggaggctgaggcgggtggattacctgaggtcagaagttcgagaccagcctggacaacatggtgaaaccccatctctagtaaaaatacaaaaattagctgggcgtggtggtgggcacctgtaatcccagctacttgggaggctgaggcaggagaattgcttgaacccaaaagacagtgagctgagattgtgccattgcactacagcctgggcaacacgagcaaagccccatctcaggaaaaaaaaaaaaagagagagagagacaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaaccttggtttccacctgtctccataaagtaaagatgtcttccaggacaattttaattcctggaaaggaagaaactcttttctttgtgtgcatacaaatggacttcagcccttggtgagagtgaggagaggagaaggtgagaaacctgagggcaagaagctgttctttccctttccagggcaaactcatttccacactatggggactccaacagaaccataccttcctgtctacggcggttggacctcctggctctctgctgtacatccgtggatccatcatgtccattttgagacgggaagatagtcttcaggaaagacacctaggaaataataatataagaatgacggctgggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccgagctactcgggaggctgaggcagagaaccgtttgaagctgggaggcggaggttgcagtgagcggagatcacaccactgcactccagcctgagcgacagaatgagactctgtcacacacacacacacacacacacacacacacaaaacacacaagaatgacgaggctggcatgttggctcactcccgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaagttgtgttgagctgagattgtgccattgcactccaacctgggcaacaaaattcaaactctgtctcaaaaaaaaaaaaaaaaaaataggccaggtgtggtagctcacgcctgtaatcctagcactttgggaggccgaggcgggtgaatcacaaggtcaagagatggagaccatcctgggcaacatggtgaaaccccgtctctactaaaaatacaaaaattagctgagcatggtggcgcacgcctgtagtcccagctactccggaggctgaggcaggagaactgcttgaacccaagaggcagaggttgcagtgagccaagatcccaccactgcactccagcctggtgacagagtgagactccgtctcaaaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaaggaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaactttacgcaaaacattctcactaatgactgaattcccaccaaatttccatattatcacagtatgcttttaatcttctcagatattaagtatttgttctcatcatagctaaaatgcaaagcaaatcccatctcagatgtgggtcagatacctatgaatctcctgaggtagtcattgaaatgacttttttcttgagacggagtgtcagtcaaccatgctgaagtgcagtggcgctaccttggctcacggcaacctccacctcccagattcaagcgattcttgtgcctcggcctcccaagtagctgggattacaggtgcctgctaccatgcctggctaatttttgtctttttagtagagatgggatttcactatgttggcccatctggtcttgaactcctgacctcaagtgatccacctgcctcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtacaaagttgtccaagtccaacagctcaactgaactttcctaaatggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcgtcttgggggtgagaaaagaaaaaaaaaaaaaaaagcttcctccaatttataccaaaaattctctgttcaggactaagtggcatagagaatgttaaatgtgcctagatatcttcataactcatatattttctgttttccacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccacacaaccacatttttactgtcatgagtggcaagacaaaatgtagagctcaacttacccaaaggaaaaaaggctcaaaagacaaattatgccacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaatagtttagaaagactttcccatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaagtgtttcatataatttattcttatttgtgattacaagtatacctctacagaaagttagtatactcacacaaaggtaagttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaaaaatttttttttttttttttttttgagacagagttctgctccactcagtcgcccaggctggagtgcagtggtgcaatctcggctcgctacaacctccagctcctgggctcaagccattctcctgcctcagcctcccgagcagctgagattacaggtctctgccaccatgcccgactaatttttgtatttttagtagagatgaggtttcaccatgttgcccagtctggccttgaactcctgacaggcgatctgcctgcctcagcctcccaaagtgctgggattacaggtgtgagccaccgtgcccagccattttttttctttttgtttgttgtttgtttttgagatggggtctcactctgtcacccaggctagagtgcagtggtgtgctcttggctcactgcaacctctgcctctcaggttcaagtgattctcctgcctcagcctcctgagtagctgggagtacaggtgcctgacagtgcactcagcaaatttttgtattttttgtggagatggggttttgccatgttagccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttctttttgttttgagacaaagtcttgctctgtcacccaggctagattgcagtggcatgatctcagctcactgcaacctccacctcccgggttcaagcgattctcctgcctcagctactgagtaactgggattacaggcgcctgccaccacgctcggctaatttttgtctttttagtagaaacggtttcaccatcttggccaggctggtctccaactcctgacctcatgatccacctgcctcggcctcccaaagtcctgggaatacacgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagtgcttaaaaattaacaaggtgggccgggcgtggtggctcacgcctgcaatcccagcactttgggaagccaaggtgggtggaccatgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccgagatcgcaccactgcacttcagcctgggtgacagagcgagactctgtctcaaaaaaaaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaatatggtgttgagcagaacaaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcggatcacgaggtcaagagatggagactatcctggcgaacatggtgaaacccagtctctactaaaaatacaaaaattagccaggcgtggtggtctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcgtcttgggggtgagaaaagaaaaaaaaaaaaaaaagcttcctccaatttataccaaaaattctctgttcaggactaagtggcatagagaatgttaaatgtgcctagatatcttcataactcatatattttctgttttccacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccacacaaccacatttttactgtcatgagtggcaagacaaaatgtagagctcaacttacccaaaggaaaaaaggctcaaaagacaaattatgccacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaatagtttagaaagactttctcatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaagtgtttcatataatttattcttatttgtgattacaagtatacctctacagaaagttagtatactcacccaaaggtaagttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaaattttttttgttttttttttttttgagacagagttctgctccactcagtcgcccaggctggagtgcagtggtgcaatctcggctcgctgcaacctccagctcctgggctcaagccattctcctgcctcagcctcccgagcagctgagattacaggtctctgccaccatgcccgactaatttttgtatttttagtagagatgaggtttcaccatgttgcccagtctggccttgaactcctgacaggcgatctgcctgcctcagcctcccaaagtgctgggattacaggtgtgagccaccgtgcccagccattttttttctttttgtttgttgtttgtttttgagatggggtctcactctgtcacccaggctagagtgcagtggtgtgctcttggctcactgcaacctctgcctctcaggttcaagtgattctcctgcctcagcctcctgagtagctgggagtataggtgcctgacagtgcactcagcaaatttttgtattttttgtggagatggggttttgccatgttagccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttctttttgttttgagacaaagtcttgctctgtcacccaggctagattgcagtggcatgatctcagctcactgcaacctccacctcccgggttcaagcgattctcctgcctcagctactgagtaactgggattacaggcgcctgccaccacgctcggctaatttttgtctttttagtagaaacggtttcaccatcttggccaggctggtctccaactcctgacctcatgatccacctgcctcggcctcccaaagtcctgggaatacacgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagtgcttaaaaattaacaaggtgggccgggcgtggtggctcacgcctgcaatcccagcactttgggaagccaaggtgggtggaccatgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccgagatcgcaccactgcacttcagcctgggtgacagagcgagactctgtctcaaaaaaaagaaaaaaaaaaaaaaattaccgaggtggagatcatgaaaatggcatgaatagtgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaatatggtgttgagcagaacaaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcggatcacgaggtcaagagatggagactatcctggcgaacatggtgaaacccagtctctactaaaaatacaaaaattagccaggcgtggtggtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaacaaacaaacaaacaaaaaagtcatcaaaccagatgacacaaatcaaatgacatttcactttgttttggtccgttttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccgaaagagcagccacagcacccatctactcacacaggtggactgatggctgataaatcccagcaggagccaaaagagaagccaaaagagcagccaccgcacccgcatgtcctggtcctttcagggcgcccggaggtggccaggacagaggtggaggtggcttagggcaggggggagggaaggggacggggactgggcgggatctgagttggggagggggaggggaaggggaggggaaggggaggggaaggggggagtaagggaagggaaaggagaagggggctgttgggtacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccatctcagtcccccacgctcctcccaagaccaggtcctctctggaaccttcacaaacctgatttctggtccaccccaaccagctccctgtccctgcttctgggcgctccttccttcctgagctcccagggttcctcaaggtcacttttggtgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactggcctctcagggacgtccaaggaatctatgcatttcaagaaacaaagttcatcagcttctctcctaaggtgtttgcccacaatacccagagggcttggccgcatcatgtgtgatgggtggggagctccaagcaggtgggcaggacccaggggcctggtgaccaggacagacccccactgtccatcacctttcctggccctgtcctcagctaaacttcccacaggccttctgcccaatcacacagagtgtgcccaaactctctcaggcctctggcagctgaaaaccactgctttaaatccctttaccatttactatgacataaggttattgtaaacaggaaatattctattgatgctacaaatagaaagccaatgcctttaccataaatagaaaaacaaccctaagaaacaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtgtctaataaaatacaaaaattagccgggtgcggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaaccccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctaggggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctgctgcccggcaggtgtggggctcgggctcccagccacctgcaggacgacagcagtggtcagcgggcggcagctcagacctgctcaggacctggatgagaagccacctcctcagcagacaggacagagcccggtgccatctgacagaatgtcctagaatgctggatatatgggacatctgcaccgtccgtgatggcagcccctcgcgacgtgtgccactgaacacttgacagcagactggtgcagctaaggaacagagttttcaatttcatttttttttttcttagatggagtctcgctctgtcacccaggctggagtgcactggcgcaatctcagctcactgcaacctccacctcccgcgttcaggcgattgtcctggctcagcctcctgagtagctgggattacaggtgcctgccacgatgcccagctgattttttgtatttttagtagagacggggtttcactgtgttggccaggctggtcttggaactcctgacctcaagtgatctgcccgcctccgcctcccaaagtgctgggattacaggtgtgagccaccacacccggccatcgttccattttaattaacttaaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcctgagcttttctttgtgggattttttttttttttttttggagatggagtcttgctccgttgcccaggctggagtgcagtggcgcaatctcggctcactgcaagctccgcctcctgggttcatgccattctcctgcctcagcctctcgagtagctgggactacaggcgcccgccaccatgcccagctaagtttttgtatttgtagtagagacggggtttcattgtgttggccaggctggtctcgaactcctgacctcaactgatctgcccgcctcggcctcccaaagtgttgggattacaggcgtgagccaccgtgcctggtcctttttaatgttttatatagatgtggtcttgctatgttgcccaggctggtctcaaactcctggactcagatccgcccacctcggcctcctgaagtgttgggattataggcgtgagccaccacacccggcccggccactgggaggtttctaagggactaactcggcctcttcacttgctatagacgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggctctgggcatggtgccgaggcccaggctccattcccagtactccccggtccccagccccagcccaccttgctccgggacatccagaagagaaagaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgtcccgacccctacggcacccacctgtaggcagagtcaccaacagccccgtaccacacggcgttggcgcccaggaagaggcagatgaggagaacgcagcaggtggccctctggatgcgagtgaaacagctacgaggcggccggtcccatatggagagccagatgtgcttgtcaaagaagccgcactgcagctcagccaccagcaggcgccggaagcgcaacagggctgcgtgacctagaaggcagggagggccgcactgcaggaggccacggggcaggaccaccctgcccaacctcccacggagtgggaacatggaacgaggccttactcgcggccagcacctccttctccaccaggcccccgttggcctccgtctccaccgaaagccagtcattgaccaggaagaaggtgctgtgtgccgtctgcaggtccctgatgatgacgtgctgcaggaaccaggcagggctgagccctgcagaggcgcgggagggaggtcaggctcgcagggcgccccaacgcgggggcagaggggcagagcttggcagggtccgcacagacctttgtcgtgccacactcggatcttccacacgctacccaggctgtgcggggtggcgatccggaagatgtccaggctgttgcggtggaaggctctgtcgccatccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacggctctgccatacacgaggagctgaggttactgcaatttgtccaataaacagcaggacctcaaggacatgattaagttacatggaaagaactgtaacttgtgacatgcaaacatggctgcacacgcctcagtccacaccacaaccagtgacccgcactgcacacctgtccacgcctcagtcacgccacaaccagtgacccgcaccacacacccgtccctcagttcatgcatagactgcaaagcgtgaagctgtgtcacctcctctcccagtgacagacccaggtgacagtattttttttttttttttgagatggagtcttgctgtgtcacccaggctggagtgcagtggcgcaatctcagctcactgcaagctccgcctcccgggttcacgccattctcctgcctcagtctcccgaggagctgggactacaggcgcctgccaacacgccggcctaatttttttgtattttttagtagagacagggtttcaccgttagccaggatggtctcgatctcctgaccccgtgatttgcctgcctcggcctcccaaagtgctcggattacaggtgtgagccaccgcgcccggccgacagtttttaaaagtaggtaatcaaaagaaagaactgggaaatgaagataaaagcagcacggaaataaaaaatgggaacacggccaggtgtggtggctcacacctgtcatcccagcactctggcaggccgaggcaggcggatcacctgaggtcaggagttcgcctggctgacacggtgaaaaattaactgggtgtggtggcgtgcacctgtactcccagctactcaggagaatcgcttaaggggaatcgcttaaacccaggagctggaagttgctgtgagccaagatcacgccactgcactccagcctgggcaacagagcgagactccgtctccaaaaaaagaaaaacgaaaacaaaaagggaatgccagaagggcaattccaatgaaaggaaaatagaggtattgaagaaacagccacggggagggtgctggcgcctccgtctgagagacgagctatgcagtcaggatcgcgggtggatgcacggtctcccacagtggtagcgatgctcatgtcacttgtggggccacgctactgtgcagaatgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgtctgcgatgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcggccccggctggcatccaactggtccagcttgtgcaggatggcggccatgaccatgtaggtcaccaggcacacagcacatgtcagcatgacgatgtagtttacatccgctgtcggctcctgtgaggacacagccgccgggcccaggaggtcacgtgcaagctgtgccttctcaggatagagccgagcccacccaggccctcctcgactctgcagaggctcccaggagcacagggtcactcacaggaaacacaaagcgtacatggcttgggggcacgaagaggctggcgccgaaggcggtgaggtggcgggtgaggcagacggcctggcggggcgaggtctcctccaggggcagcagcccctctgtccgccacaccacgtcctcctcgctgaagtactggcacagggacgtgtacaggcccacggacacctccagcgccgacaggcggaagtggctggagaggttcagacggtaactccccactgggtctctggtcctgggcagggaaggggcagtggacgtgagcccaggctccgccaggttggatatcggagtcccagagcccatacccggtccagtcccctcgctgcctgccgtccccacagggcctgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgtgctcattgggccggggctccgagtgcaggtagactgccaggtagggctcgggttcctcagacaggtagcggcctggggcagaacgcgcaggtcacacgcctgctgggaagctcaaccacccgggggacacccacgatggccctcctgagcccaccctctgccacgggcctgaaaggccataggagcctctgcaccagagctggcacctgcttctccgtggcccccagctcctctccggccaggcccccagcagcccatgaaacagaaagcaaatttcaccagagacacccatggaagccctacgagaaacgccttccccccaagaacaaggccagggggccgcgtgtgcctcacccgctgcacgcaccgtccagcagcgtatagttgagctgcagatgcagcacggccgcagggttgctgctgtccagggtgaccacagcaccgacggaggcctggggctggaccacaacggagttggcagagctgcggtggccccgggcagcccagtccgagttgttgggcaccttcacggtgatggcgcgctctgaggccagccgctcgatggggatctgggcgccggcctgtgtctggaacgccatcgaggccaccttggtggagacggtgtagttgctgatatagccaaagggaaagggattggagtccaccagaaagatgagctgcaccacgtcactgaggttagccggggccctgctgaaagcctaggggatggagaagtggcagccaggccctggggcgccgccatagcacagcaggctccgcgggtccgagcgcttgccctgggccacgatctcctcgcccgccagtgtcaggggctcctcgttgagcacgcgggagcgcgtgaggatgcgcatgagggcagaggtcaggttgtaggcctgggacgccaccatccgcgatggtgactcggctcccagctctgagcgctgtggtgcccgcacgtctgagctggccaggtggatgaggtctcctgcagacagacgtgaggtcagtgcagagacagggaggcagagggagggtgggggcaggcaaaaagggggagccggagggtgggggctgggagaaagggggaacctgagggggcagagagcgaggtgcaggcagaagaaagggggaagctggagagagagtggtggaggggggagggggaaggggatggggatgaggacgaagatgagggggatgatggggagagggaggaaaaaggaaggaaaagggtagagaaaagagaaaggggagaagaggaggagcagggggataagggaggggaagggggataaggggataagggaggggaaggaggataagggggataagaaagatgaggggaatggacaaaaggacggggaggatcgggggggaaatggagaaaaggggagagagatggagaaaagggatggtaatagggaagggggagggggaggagaatgggaattgggggagggggataaggatgggaagggggaggggaggaagggggaggggaggggctaggggagggaggggctgggggaggagtggaggggctcagcgggaggaagtgaggggaaggtctaggggaggggaggaggagaagggctagcggaggggaggggagggggcaggggctaggggaggggggaggggcaaggggagggagggggaggggaggggttaggggagggaaggggcaggggaggggctaggggagggaagggggaggggaggggagagtggaaggcacagaacagcatcttcttagtccctccccacatctgggcccctctttacaccctgggtcccccgagaggcaccctgcgttcacacaggacagcagaaaggctgaggctactgaagcaggtcagagaccgaggaacgccatggcatgaaggagcccaggctggaggctcagctcctcggccaagctgcccgtctgccctggggggctgaacccagtaccctggcaggcatgcggggcggggtgagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcaggcggcacagcaagctgtcagcagggcaggagaccggcaggaggccagcagatgcccacgactcccggggtgcagttacgtgctagatgctgtgtgatgtgggcattgacccgcaacactgagctgtttcttcatgggcaaaacagggtaagcacatgggccctcctgggcgggggctgcattgtggaaagcagacgccggagagggcccggtgggtgtggctgctgggagcggaacgtcggggtgctgcttcagggtcactgggatttatctctggggcccgggataagccctccgcaaagctccaggcaggggtacaggtcttggtccccagcacgcatgcagcagatgtgaggtcccctgccaggctgcactcacctcgttcaggacggtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccatggcatcacgggagggctccgtgacgtcacagtcgggggatcccgctgctccccctaagcaggcctgtactcacccgtgcattcgaagtgcaccttggtggtgagggcgtgcacagcgcccagtgggaagaggcggcaagagccccccagcggcgggcggttgggggacagggggatggaggcgcagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagtgtcttgttgctgaacgtacgtgcagcccaccgctgcaggcagaaggggtggtgagggggcgcaaccctctgccctgtcagccccacttctgcctgcaggccccgtcccctcggccatgggacccatccccagcccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactgcggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgcgttctggtgtactggagccagctggaccctgacaggaggcaggcaatgctcactgagggcccctggggggatgcgtgtgggaacagacgtatgtgggggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggcccgttgaggaaagcagggactggggaacagacacccactctggggcaccagcaggccccgcctgacagcagcaggagcagccaccacgggctcagggtcaccaagcctcctggccggtccagagtggggagcgtgagggtgagaaccggcccaccacatccagcaacagggacatgggctggggacagtggctgcctctggggtgggaaggggctcttcctcactgttggtattgctgggggactgtgtagcttttgtcactagagcatatgtggcttgaagactgtatgtggaactgtggcaggtttggaaggaagcaaagctgaagcaggctgtcgtgttacgtagaatttgcatcagaaacagagagggaagagcgcgcggcctccaccagcactaaaacacggaaaacagtagatgagcagggaggttgggctgtccaaggcaagtggccgaggggcgggcggcacccaccgtctggttggtggcctcctccttgcggccggccttccacacggtgaggctgaaggtgtactccacgccagccgccagccgttcccgtggaatggtgaccgtgctgctcccgcggggcccaaagttcagcgcacacccgccagcctccctctgcaggccgagaacaaggggcgacgtggcccgagaaccccatccagttttaaagcagagcccggcccaggagacagcgcgggagaccccctccccatgctgggacggggcccaccaggcactgaggacgggccagccctggtggcaagctgggtgttctctgggctcatgggtgtggacgggtgaggggcatggaggacggccctgccacgcactgacctgtgtcgaagccacacaggcccactggaaactgagcggcgtctggtcgccatcctccaggttggggtcgtaggactcgctcccatccagcaccaggtcctgtgtgtctgaccacacgcggtatgagccaccctcagtgatgggcaccaggcgctcaggggccaccgtcacattggcctggatgctccgtgccagtggcgtgtccccaaatgacacgacaaacacaaagcagtagtgccccacaggcagcgccagccgcggcagcaccagctgaggccggctcacgtccacgccgggcagggccacacgcgccgggcaccccggctggtgggcccgagccagatgcagtgctcggctgtggctgggtgtggctccccgggcagccagttctggcagctctccaggctgaaggcctcgccctgcggcgctgggcccacctccacccgctgcacagtcgagaagccgatccacacgtctaggctcctgggggcgggtgtgggatgccagggggctcagggcactcctccatcctcccaccctcacagcagcccgctgggagccccatcactgtccccctttccagatggggaaactgaggctcagagcctggagagcagggcccaccaccccaggctcacagcagcacccacccacggggcctgtgggcaccggcagggatccccgcgcaggccacctcccgtatggcgtgcccaggagtgtccggaggctgcccccagctcgcgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtgggggcaggcacctggtgacccgggagaccaggaagcgctgcacggcgggactgtccaccattgccagggcggccccggcccaggcccgacactgctcctgcgcctgcagccaggccgccttctccaccaccaggcggtagcagtgcccgttgccagagaagatctccgtgtccgaggggcagagcgggtgcaccgctggagaccggtgggaatgagggtgtcaacggtcagtgtgggcccaagacgggggtaccaggctctgccccatctggatggccctggggaggaaggggagtgggcagcagacactcacctcgggccggctcctcgcccagggccacgatgctgtaggcagcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggcccccagggccagcacggccgtcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccaggggggcccctggggaggcagggaagacgtgctggaggagggtggggcccctacaggtgggggcaggaggcggcggggggccggagcagagggacaggcaggcgaaggaggcactagagggctgggccgccccacacaggcaccagccctgctccgagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacacccccatccgcccgccgcactcacaggctcccatgctgttcccttggcccggagcccccccccagagaggccttcctgagccctgcccagtgtctgcagggcccaggtcccacctggctgggaaggacagagctggccccacccaccggcactcaccacagccactgtccagcaaggggatgccaagcagaggctggccagccagggagtcaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacagaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacattgccagcatccccaagctatggcctcccacccttgagctccccactcccagaggtcaggaggggcctttctgatggaagacccaaatgaacactcatctggggaaaccaagccgggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaagaaggatcgcttgagccagggaggtcgaggctgcagtgagctatgactgtgccactgcagtccagcctgggcgacagagcaagacccggtctcgaaagaaaagaaagagaaagcaagaaaagaaagatggctgggcacggtggctcactcctgtaatcccagaactttgggaggccaaggtgggtggattatgagatcaagagatcgagaccatcctggccaacagggtgaaaccccatctctactaaaaatgcaaaaattaggtgggcgtggtggcgggagcctgttagtgccagccactctggaggctgaggcaggagaatcacgtgaacccgggaggcgaaggttgcagtgagccaagatcacgccactgcaatccagcctggtgacatagcgagactccatctcaaaaaaaaaaaaaaaaaaaaaaagaaaagaaagggaggagagagagaagaaaaggagaaggggaaagagccgggtgcaatggctcctgcctgtaatcccagcactttgggaggctgaggcgggcggatcacctgaggtcaggagttcaagaccagactgaccaacacggagacaccctgtctctaccaaaactacagaattagttgggcgtggtggcaagcacctgtaattccagctactcaggaggcttaggcaggagaatcacttgaacccgggaggcagaggttgcagtgagctgagatcgcgcccctgcactccagcaccccatcctgcaagagtgaagctccatctcaaaaaaaaaaaaaaaaaaaagaaaaaggacggagggcgagagggagggaggaaagaaagagaaaactccaaaaacaaaaaaagaaaaaccaggcaattaaaagaagcacaattggtcacagccatgggaaagacatcccatgtcagcagtcagtgaagaaaaggcaacagaaaccaaagggcggcagcatgtctctcttttcagagctgcccgagttacaaaccaggtcctggagctggtgatgtggaggtgagaagccagagagctggggcaaaccgagaactccacctcccctcggcctcaagcacctcgggggtcaccctgccgcccaccctgggcacccctcctggtcccacgcactcccagtagtgctcctggcacagggactgtggctccgcaggtctgcacaccacccccctgctccccaggaccccgagacctcacctcctgccacgggcctctacttccccaggtgtcaccctccccacgagtgacccagcaggtgcctctgcctagacttgctcttcccagcaatgaccacccggcagccaggcccaagccggggtggcctccatccctgagcacccgcccagcccctaccggcctccatccctgagcacccgcccagcccctgccagtccctgccaccctccatccctgagcacccgcccagcccctgccggcctccagccctgagcacccgcccagccctgccagcctccagccagccctgctcctcccaccggagctccgctcccgcagcagcctacccggcgcaggagagacgcacacacaggctgcctggtggggcccggggccagggcaagggcttgaaaagggaaccaacaaagaaggggaccagaggccaccccagctgaggggacagagcagccgaggccttctccgtgccaggaagcagccccagccacggacggtggagccgagccctcacctgggctgggcgcccagacagatgagacgctgggcactggctcccggagcttctcgttccatctgcggatggagggcacggttgggggtgcagttcccttcccccaggggctgtgggacactcagagagcctatgcctgtgccctgggctccgggaggggagaggatctgggggccaggcacacagggaacggcccctccggcagggccaccgcttcccccctaactgaaccctgcttctctgccgtcccctcctctacaccaaggtagggacacaggctgaggtgctccccactgcccataaggatgggtgggcccacagccacgctgctaggcatccacaccatccccgccgtggggtgggacagggtggcggctgggagaccagcaagaggccattcacgagacagggtgaggcagctggactcacacccgctgcccaagcaccatgcccgagggggaacactgtgctgtaaggaactgcagttagacctgaggagggacttttcagcggctgcggcggcagcagaaccaatgctttagggagaatgaggcaccaggacctgaggcgcagcagccctaaggggcgagaggtgctgcagaggccacggtgaacacaggcaggccccctggaagggacacagctgtgaaactgccccggggaggggcacaggcatggggagcagctcccacccaggccacgggagaaaggaaagaaggaaaagcctgaagatgtttggccacacctcattttctggaaaatccatcaagagtggctgctgctgggagctgacaagccagggcaggggtgggggcaggtcagccgaggaccccagagcccccccgctccccacccatcccactgtgaaccaggcctgggggtgccatggacacttcttccatgccagcaggcagccccgcctgtcaccggttctggccatgcactccctgcgtgccaggctccaggctggctccttctcccggccctcaccccagcccaaggcccacaaatgcagcaaggtcttggggaccccgctcggccgagctcccagggcccagggcagtggaatgaagctggggcccagacaggagccaggtgcagtcccccagcccccagggtgtggaagcgtctgccctgggtaggactcaggtgccccctgggtgtggaagcatctgccctgggcaggactcaggtgtgggcttcagggacagggaccagtacagggatccccgtggagtcctcaccccgcttgctcccgtacttttccacgtctgcatctgcttttgccatcgccgttctgggggaacgccaaggcctagccaggcagcctcgcgccagcccccccaccccgcccctcgggcttcctctgcacccgccaggtgacatcatcgccgctgtctgatgccctgcccccacgttctggttccctgcaaggatgggggacacagcagggcccaggcatctggcagcaggaccaccgagcggccctaagcccaggcaagagcacagagcagagtgcagggtcctctggggtcccaagcccttgctgccccacgcactcctcaccccagttcctgctataagctggaagggtgggagccaggtgcacagggacagcctgatgggtgcccgagggccaggatgtgctcccagggaagctgaagccaagcttgttgggagaagtacacccccatggggggcaggacggtgccccagccccgggacacaaggggcccccagcgccgagcgtccgatctggaaggcaggaggagttaggaccatcctagcgtgggacccagcgggctccttagcggctgctggggcaccactgggtggagaaggaagtcccaggtgtgtggccacagtacgggtcttcaccccttcccagcacccttgccaatcctggagcaggagcagcaacagcagagggtgtggccaggcctggaggctgcccctccacacccctgtcacaggtggggccacgtcccagggctgtgggcagcagggccagcctgccggcccgaggtatctgacacgtgtctcatgctgcagcgggtctgcccgccacccgggcgtgtgaaccccaggtcgggccccctcgccctggagcctcggcccctcaggggtgttcccagccaggcgctggctctcctgccctccccctgggctctgcccacagttggcgcgagggtgggtgaagcctgaggctggcagggcccgggaagtcttgtggctgggccttctgccccacaggcgctcctgggccgggggagccggggtcggggcgtgcaacagtgggactgagaacttccctgggtgtggggcagctcccggggccctcccaatccacaacagagggaatggccccagacaaaccagacctgcctcagagcctcacactcagagctgagtgccccaggcgcccatttcccagaccagatgctgagtggggtctgggggccggacggagcccccaaagaaacatctgcacattccagacgcgtgtggtcagcggcgggcgtgtgccaggcccggcacccctgcccgcgctggccgcctcactggaaactgggctggggggaccggctcggaggggccacctgcggagcttatgtaaccgctcctccctcggcaggggcaggacaggacgccagacccagggaggccccatgccccctgccaggccccgtcctctcctggaggagccggttcccctccgcccagcaagaggacccccaggcccgtccctcccgagagcaggcccagggtgaggaaatggggtgcagtgtgggcgctggagaggacaggggacaggcagcagtgccacccccactgtggccccttcctcgctgggccagccgagccatgacctcttctgtttccctctgcgctgtgctcctttctatttaaggagagtgaggcggcttccagggccggaaatgatcctgtttaaattaacaggctgcagtttgggacggtgctcatttgaaaaaaaacagtgcagccccgggctgggcagacggctgctggctccgcctaccacttccatggggagggccagggaggccggccacaaccctggccccacgaggggtgggggttgcagcctctgatagaggacgaggctgccaggccccaggcaacagagccctgcacgaggttctctgggtcccggacacggggtgtgagactagccggggagccccaggctcagcggcattctgtccttacagatccctcccatggctcaactgttcccaggatgagacgccgggggtgacatgggcagcctcaggtcctcccgggacccacaggcaggcacagggatggagactccggcctcggaggctgaacgagggagatgagaaaggggagtctgcgatgtccttgcctacacggatggaaaaacacagccagctcaaaaagggccgtttggagacaagcccacctgtgggtgtaggaaggagagcgcttcatacgtatgccacctgccgctggggtcggggccacccttccagttcaaggggagaatgagggccggctcctggtgcccctgcacacagctgacatggagccaggcgttgtgacccccttgcatccctctccactcccacccttcacagcctgggtgggcaggtgctgcactgaccttatgctcctgatgggcacagaggctcaagaggccctcctcctcccccaacaccatcccccaaacacctccccgggcagccagcagggtccagagtgtcaatggaggaagccaaggtaggaagagggtggtggggggggccaagcaaactggccatctgcgcccggctgtgcgggcacagcagtgccctggagagggcagcagcacagatccagcggggcagccggaatcccatcacccactcggctgtgggcacagccaatgatggcacgagccatcctgaggccagggccacgatgcacagtggacgggctcacaacccggagcccctgtactcccacagctgtgacgttccctgggcatgggcttgccccagcgctggcctcattcctgcctcaaccagaaggaagagctggcttccgcctctgcctgggcacaaagccctttccgaggtggcctgacagaagccagcctgtcttcagatcatggcgctgctaaggtcaggaacgccaggctgggccagggctgggccttgggagctgcagggagaaaaggacccagcccgcctcagccccagatgtagcccttctcctgccaccagtgcctgggcaccccggcccctaggcgaggacagctgccaagccatgaagagcgaggtgttctgggaaagggcgtgagctgcattttccagctgcgctcactctgcagggagactgtgacgcccccgccgctgtgcccgcagacgtgcccggcctcagccagctggagcgcaggcagcagagtgcaggccaggcccagacggcagcgggctgttttcattccagggtgcttggcgggctgggctgccgtggccactgcagagctccagaaaagaacacgtgtgtctccctccaaagtatgttcctcgctggaaagcagatcccaggcagggtctcccccacgagcagggggagaggcaccccaaggtgggggagcgagggcagtggcagaaccaccccataccctaggggacccagggaggggcttgcagatgcgggacccacatttggcagcggtgcccggccactgtcacgagatggtggccagcgcatcacccacacgtgggccaggatggcagaggagatccacagagatggctccagcaggaggccctcacagagatgccctggcctcagaagagccaacagaaagccgggaagggggacgtcgaggctcaagcttggcacaacctccccaaagctcccaaaggctcttggtgcccaccagcgacagcgcacaccgccaccacctaacagcaaggatgcagcagggtccgcacgtcagggcgggcactgagcggaactcaggcagtgccactcgccagcttacgtcaaaagaacaaaaggagtgaggacgatactcgcggctctgccaatacttcccagccccgcacgtctcacacacaccagaacgcgtcaaaaggcaccaatgggcaaacacccagaggtaggcacaagcaggagtaggccgggtcttgtgagcccctacagccacgcggccctgcgctgaaggcaccgaggctgggtgctgaggggtccataagagtccacccgcccaggctgcactggctcccgtcgtccagtgtccggtctaagcacaggcacagtgtctggctctcaccctcaggctgttacactctgctctgtggcagggcaggtctcacagtgcatggaggacaggggaatgggcccccggaacccctgagggaaccgacagagctactttaacaaggtatgattgttggggctgccagtggctgagccaggtcactgctacactgccctgcagggtgcatctaatcatggagcccactttacaggtgaggaaactgaggctgagagactggaccaaggtcacaccagaagtggaggcgctgggacgtgaacccaagtctgactccagggcgcaaattccctacatctgggttcccagcctccttcctgaaactgaacaggaaactacagggaagggacacagcagggatgagccagggagggagaggtgggaggggctggcagggagggagaggtgggaggggctggcagggagggagaggtgggaggggctggcagggagggagaggtgggaggggctggcagcacccaagcagctgcacctgggtgcagggcccctcagcccctcggggagtgcaagcacatcccagcccgactcggaagcgccactgccacctctgtctgtctataaaccagggcactagtgtgggccccaggcaccctgtgcggctgcaggggtctgccccagagcatgctgatgaaatcatcaccacggcttctcagagcctcaatttcctggtctgtaaaatgagaccaggagtggctgcaaccctgcagtgccgtgatgagctatggagagacaagaacacagagggctcagcgcagggcccggcgtggccaccgcggggagagggtgcggactcttcctagaccttttctttttgagacagagtttcactctgtctcccaggctggagtgcaatggtgcaatcttgcctcactgcaacctctgcctcccaggttcaagcgattctcctgcctcagcccccaaagtagctgagactacaggcatgcgccaccatgctcagcatttttttgtttttttgagacagagtctcgctctgttgaccaggctagagtgcagtggtgtgatattggctcactgcaacctccgcctcccgggttcaagtgattctcctgcctcagcctcctaattagctgggattacaggcgcccaccaccacacctcgctaatttttgtatttttagtagaacgggtttcaccatgttggtcaggctggtcacaaattcctgaccttgtgatccccccaccttggcctcccaaagtgctgagattacaggcgtgaaccaccgcgcccaccctgtttttttgttttgttttttttttaaagaccgtttcctagtcacccaggctggagtgcagtggcaccatcacagctaactgcagtctcaacctcatagactcagggaatcctcccccctcagcctcccaactagctgggactacaggcgccaccactaatatctatttattggtctcgctatgttgcccaggctggcctcaaactcctggcctcaagccatctgctctcctaaagtgctgggattacaggcgtgaggcaccgcgcccggctggacagtggttttgatttccgtttccctcatgactaatgaggccgaccatcttctcacacgctgttggccatctgtgcatcttctttggagaaatctctgttcagatcctgtgatttttttttttttttttttttttttttttttgagacagggtcttgctctgtgacccagcctggagtgcagtggtgtgatcacagctcactgcagccttgacctcctcggctcaagtgatgtcccacctcagtctcttgaatagctgggaccacagatgcacaccaccacgcccggccaatgttcttttattttttagagaccggggtctcaccctgttgcccaggctggtgtcaaactcctgggctcaagcgatccacccaccctggcctcccaaactgctgggattccaggcgtgagtgaccccttgtccatgtttaaacggggtccctgtctgttgttgaatcatagtgttccctgtatgatctggatgcaagccgatactgcatggatgacctgcaggtgctctctgtctccacagtcgcctctgcagtgggcgctcgggtgccccacattcccaactgctacagacacaaccaaagcctccccatcccttcccccacccctgccggcaatcgcgtacaggagtgagcgtgtgacttcttgtccacatttttgtccacaagtttggcgagtttgcatccgtgtctaataaagaaactaccgtttctcacgcaggcacgttctgaacgcccgagtgcgggagccacgtaagacccggctcagggaccccgggtgaggccagctgcacatgcaggatgcaggtcctcaccactgcctccgctcggctgccagggctcttcctagaagacacgggcctctcctaggctctcctgactgaggccctacccctgcccccgagtcaccttgccccttggggactctctctgggcagctccctgtgggagctttgaaacctggcttcaatgtcacctgcactgggggtccttccaggccagccccctccccatcatccatctctgtccttggagaatcatctgcgtgtttgttgaacgcgggctccagtgataacggagccctcgagggtggccctccttctgctgagggctcatggaggccttggtgacaatccctagtccttgctctcaggatccagggaccagaaatgggagccaggggcccctccgtggcctggccagccccccaaggaagctgtgtctgtggcagttgcgctctaaggcatcaggcctaggggtcgctccagaatgactgtcttccccgacgccaatcccaggcaggggccccggggtctgcgcctgctgtccctacactctcccacactctcctgtcattcagggatgcaggtgggaaagggcaaggccctgggtgctcctatattttacatcagtgaaccaagcacctaccaagtccctcgatgtgcccagtcctggaccccagcatttgcgagacagcagcagacccaggtgacccccagccagggtgagtggcaaccagcaccagaagtggcctttagagcagggggccctgagctgatgacatctacacctaggtcactgccagccaggacaacctctgggacaatgggatgtcggctccaacgaccaatttacaagaaacacaaaggacacactcacagcaccacggaggagacaccatggaggtggcacccccaagacacagcgagaaatccaggctgcaggagccagtttcttcaacaaattgcacaaggaaaaagagaggaagggaagctcctagacatcatcggacatttaaaagacaggcggtggctcaagcctgtaatcccagcactttgggaggctgaggcgggtggatcacgaggtcaggagatccagaccatcctggctaacacggtgaaaccccgtctctactaaaaatacaaaaaattagctgggcatggtggcgggcaccagtccaggctactcaggaggctgaggcaggagaatggcgtgaacccaggcggcggagcttgcagtgagccgagatggcactgctgcactccagcctgggcaacagagtgagactccatctcaaataacaataaataaataaataaataaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagccgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatatacatttttgtctgggcgcgctggctcacacctgtaatcccaacactttgggaggccaaggcaggcggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcgcttgcaccagggagtcggaggttgcggcgagctgagatcatgccactgcactgcggcctggagacaagagcaagactccgtctcaaaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcagtattgcgatgccctccaaaatgcttgcagataaaagggtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatagaaaattagccaggaatggtggtgcacgcctgtaatcccagctactcgggaggctgaggcaggaaaagcgcttgaacccaggaggcggaggttgccatgagccgagatcgtgccgttgcactccagccttggcaacaagagtgaactctgtctcaaaaaaaaaaaaaaaaaaaaaaacacatgggtcaggaggggaagggtcggggcagggagggcagggcaggctctggggtggggggtctgtgagtcagccacagctctgcccacgtctccccacggagcttcgagccacgcagagcagcacgttttgcagtacgccatcttttccaaaagccaccacctctcggcagcatcattaacccaaggcaggctgtggcctcagaagccccggctgtcctccacctggaactggacacagctgtccctgctgagcttcagcagccagggagccacaagtggagaggcacctgcgtgagctccccaggaaggctactggtgacacccagacagcaacgctcctggacccttaaacacctgccagcagctgtgatctgtgtccttcacctctcccagcttgacccctcttccctggggaaaacccagccgtctccccgaggaggagtttgcagggtagacagcaaaatggctgggctgccccacagcacagagggtggcctggggggccagccagggccttcacatccttcctagggccctagtttcccatgggtcccctcaccccaccttccagaactctcccagcggcggccccaggtgtgtacagaacagcacccacctgcccacgaggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggctccgctgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccggcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccacccaatgtttagcaagcctggggatgtgccacgtcccccagggatccagcacgcacccaaggagacactgtcccggcgaggagcctggagcctgggaaatacaaggcatcagactggtcccaagactctccccagcgctggggacaactgtctgcttatcttagtcccctgcgcccttttcaatccaaccctgggtcctgggcacctcatagttccaaatccctgctatgcacatcccggctgtgatgcctgggacaggtcctgtcctggctgtgatgcctgggacaggtcgtgtcacctctccaaacctgtttcctcatctgtgaaatgcaaatctccacggtccctatgcctcggatggtcagagtcaggattccgcatgacgacccccaacaggagcctggcacagacctggctctgggcagcgtctccataaaggccacctgttgtttttatctcccgaaagcgaacatgacaaggctttaaccccccacggcaatccgccctcacccctgttctcaggatagccttggaacccaatagcagagcgcctgaggcccttcatgaccccagcccacccgcgagcccacctcccaccctgcccctacccctcacacctcccgtggccagcctccagcctcatggtctttgctcacaccgttcaccccccttcttctggacccacctcatcgccccttcctaagcatcagcccaattcttgcacatccatcaaatccttgtccagacacctcctggaactcttccctgcagccccctacaaccatccccacctctccgggtaccccgcagccccaggccgcatcccaattcctctccaattagcgactgtttgtcctcccagctgagcgggcctccgggccccgcccccgctggcgtctgcacagcccccgggtgggacgtctgtctccagacccggggtttttcggctcccccgggccgtgccaaccgcggctccaggcgttccttatttagcagggccgctgtgcccgcgccggagcctcgccctgggagcgtcctggcccgcgtcctgcttcccgtcccgggccagggaacgcgcccacacccgcccgtcccgcggcctctcccgggtgccgctgggcccgctactcacagcgctgtggcgtccgcggggatgcgcagcgcgggaccgagcgtccgcagcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggaggccgcggctcaggcggggccggcagacggcatggcgggcgcggggctggatggggctgcggccgcgacctgctgctgagcgacgcccgctcgaggctcggggccaggccgctccgggagcttggccgcccgctcggacgctggcgctgcagtgcgagccccgccgcggctcctcctcctccccgcgccgcgcggggcggacggggcgcggtgggggcggggcgggtgcaggctccgcccccttcgccacagcgcgaccaggccagcgatgagggactggcatccggaggcttcaccctccgctccacagggtcggcagcagagcggggcctccggaagctccgccccacgcgttcccggggcgcatgcgacgtggggcggagcgtctggaagctccgcccgtcgcactggagagtcggccgaggcgcacgaggtatttttcacgctccgccccactgcaggctaaagtgcgtgggcgggaagcggtgggcagggtgccatctggctccgcccttctcctgtggtgtgggccaggcggcgggttcctcctcctgcagcagccacaggctccaccctgatccttctcccgcggcatggatccttctcccgcggcgtggatccttctcccgcaatctccgtgcgcgtccccagtcagtacccgcagcctcccgacgcacccgctggctccaagcctccctaccccaggtttcctggctaagagagagacagaaggagagagggggaagagagagaacaggcaatgggaggttgatggtgagagcttattgaaagacaagagggaggaaacccacatcctccattccccatccattcatttattgccttatttattccattgaatcttcacagctctagaaaaagtgtgctacaattattccctttattaaatgaggtcactgaggcacagtttaagaaatttgccagcagggcacagtgggtcactccggtaatcccagaactttgagagggggaggaaggtggatcccttgagcccaggagttggagaccagcctggccaacatggcgagaccccgtttctacaaaaattagccaaaattagccaaactggctcacacttgtagtcccaggtactcgagaggctgaggccggaggagcgtgtgagcccaggaggcagtggctgcgctgagccgtgattgtgccactgcactccagcctgggcaacagagtaagaccctgtctcgaaaaaaaaaaaatggaaaaaagaaaaaaagaactggctgggagtggtggctcatgcctgtaatcccagcactttgggaggccgaggtgggtggatcacctgaggtcaggagtttgagaccaacctgaccaacaaggtgaaatcccatttctactaaaaatacaaaaattagccaggcgtggtggcaggtgcctgtagtcccagctactagggaggctgagacaggagaatagcttgaacctgggaggcagaggttgcagtgagccgagattgcaccactgcactccagactgggcaatacagtgagactccgtctcaaaaacaaaaaaaatcctaccacatgtgctccaccaagctctgtctccaaggtggccttggaagccacatggggaaggtggcagagactctaggagcctgagcagagacccagatgattatgaaaaatgcagacctacccatccttattcacctgggaccaccgtgaactatatcataagaaataaacccctattgtacatacatgcaccattccagttgggtctatttgttacagcagtttagccaaccctaatccacatatacagtgtcaacagtggctgagatgacatgttgcacagacatgagagtcagaaagacctgagttcaagtcccagtgatgacatttactatctgtgtgaccttgaaaagctgcctaactactctcagaccgtttcctcatcagtttgttttgagaatcaaatgagaaaattactaaaaagcccttagcactgcatctaagatggggaagagacagtcaatgaattcaagtttcctgaagcccagttgcatccctgccctgtcctgggctctgagagacagttgccgaagctagtgttaaagtgaactaaatatggcctgagtgggacttcgtacttctatagttgagtccttgtggacaaattgcaacctagcttaataggtagacaagattgaaaacctaacttaggagtatgcgtctgtaacaatagctgagtcttggccaatcccagaggccgtagttcaaccgctcatacgctgctgagtgttcaaactgtactcaaataaggcaaacgccaacttgtaacaatccagccattctgtacttcacttctgatttctgtacatcatttcccttcttttgtccataaatcttcttccaccacgtggctgcgctggagtctctatgaatctgctgtgattctggggtctgcccaattcgcaaatcattcattgctcaattaaactactttaaatttaattcagctgagattttcttttatcactaatttgagctggttttctaatgtttgcaaatgggagggctgactaatataacactgctccaaatattaacgtctttctcccaacccatcacccaggcagaagtggtccagcctggggaaccctaggaggaggctagctctcctctaggaaggcttaggatgcagccagtgggcagtaactggctcactgtcccctgcaactgaaatcagaactggttccagaaaccaagttgacccccaaccagtctttcccaaaatatggctctatgcccatctctggtcaggctgggctgttttcctggacagagaagtctcagacaagcaggcagtggttagtgggctgtgcccaggctgagaacatttcccagagcagatggcatctctggcagtcccttaaagccagcagaggccaagtcatgtccaagaggccaaaagacccaatatggtggagacagtctacagtccccatgaataagggatgccgatgccttccctatgtaccaggtagtcactgcctgaggggcccagagcagcaggagggcagagccagcctgggcaggggcactgggccggaagtggggctcacatcctcagcgcgcacacacactctcacacacacacacacacacacacacacgaatgcacgcatgcacacacaaatgcacgcacgcacaggtgcattcaaacatcacatacacgtgtacattccttgcaaagtcaacttctgctgatagcacaacaaacaatggggccacagtgtggcatggaggaaaccctggagtctgatctcatttttttttttttttgcatctgtcaggagataaagatatttgataaaaatccttgagtcacatccccaccaggtccctgcctacctgtagaccccatcaagccagctccatggcccctcagataccgcctcactgggtccccagggattgacctcagtcctggaaatgcagaaatatctgtatctgtcacagctgagactggcggccttccgccggctttcctggaggcagaggtggagacagggacttgggtggatgtggtttttgtttttgttttgaaaggggctttcaggagaagggaggtgaggactacaggatgcagaaggggacagagcagagtgagaatgtggtcccttaaagtcccgccttgacctatcccacgagcagcagagagcacgccacaggatcgtccccaccgtggggcagggaccagccattcacgttgctgtatcagttagtcactgggccattactgggcatggcatcccatcccaggcaacgtggctcccatctgagggtgattctctagagaaggacagctgtgagctctcagcaggtgaggctccaaaagcagctatgccagtctagacctcaggggaagggggaattcatctctaggcagggatgattttcataacattgaactcttgacatgcaggagcaccgaccaatcagaacagacacggtgaccaaacaggcacagccacaccagtggataccagcggaatgtccacgctgcctctgcgaagggacagtcccatgagccaagccctagaccagctgttctgggagcactgcatcattgcactgaattctcacaaccgccccataatgctgggaccatccccattttcctgcccaacagcctccgtctcatagacactaggcggctctcccagggtcacacggtccagtcaataacgggcagaactcgcactccgatctgtctggctccaaagctgctaaaaattttctacttggcctcactggcttgacaaagattaaaaaagaaggcaagtccttctttccaagagatgctgaggtccctcggcgacgctaggtcatgattttatcatgttcagagggcaatgaaagggacagaaaacaagcgatgtgtgatctcctgtcatgtcaagagacgctgatttcaaagaaacgtacgtttcgcagaatcaatacgctgtggggcctcagaaagctgaggcagacacacggccccgacccgtgcacgtgggagccctgttacaagagacggcagaaattaaactgaatcacctggagcaagtacattgtaaatgttcaatattaatgacccacctcggccccaaagaagagagcgttgggctttgtccagctgtgtgctctgttgttaaaagaccaccttgtggccaggcacggtggctcgcacctgtaatcccagcgctttgggaggccaaagcaggtggatcacctgcggtcaggagttcgagaccagcctggccaacatagtgaaaccccgttgctactaaaaatacaaaaatttgctggatgtggtggctggcgcctgtaatcctagctactcgggaggttgaggcaggagaatcgcttgaacctgggaggcggaggttgcagtgagccaagatcacgccattgcactccagcctgggcgacaagagtgaaactccgtctcaaaaacaaacaaacaaacaaacaacaacagaaaacaatttgtgccttaatgggcattcctttcccttcttgctaagggatgagatgatggcagaacttgtggccactgtcctggaggttgacaagctttttctgtaaagtgctagataataaatattttgtgggccacacgatctctggtgcaactacacaacgctgccattgtcatgcaaatgtagccatagatgatgataaatgaatgggtgtgactgtgttccaataaaactttatttataaaacagacagcaggccagagttgggcaatgggcagtagtttgccccacactccccgcccatccgtcctattccttggcttttttgggtacatcaaggagtgcaatctggatgctgggctattttatggccactgggcataaccttaacctgggccttttgtctgttaacctgggtcagtggctacggtgaaggtcgggcaaccaaggtttagatggctcagtacacattcacgcccacaaaccaaaccaggaaaaagatgtgctaagttgagcatatgacactgttggtactcaaatggtttgtttttttttttaaataaatgtttaagtaaattttttattttagaacagttttagaaaaatggtgaaagcagtacagagagtttccatgtaccccatagcttgatgcattatgaactaaagtccatactttttttgggggggtggggacagggtcttgctcgtcacctaggctggagtgtggtggtgtgatcatagttcatggcagcctcaaccctcgacctcccctggctcaagtgatcctccatctcagcctcccaagtagctggaaatacaggtgcctgccaccatccccagagaatttgtttttgtttgtttgtttgtttgttgtttgtttgttgagacagggtctcactctcattgcccatgctggtatacagtggcacaatcacgggtcacttgcagccttgacttcccggactcaagtgatcctcccatctcagcctcccgagtagctaggactacaggtgcacaccacaagcctggctaattttttgtattttttgtagagatggggtttcgccatgtcgcccaggctggtcttgaactcctgggctcaacccatccgccggcctcggccccacaaagtgctagggttacaggcgcgagccaccgtgcctggccacctgaagtccatagttgattctgattgccttagtttttgcttaatgtcctttttctgttccaggataccacatggagcattttgaggagtgctggtcaggtattttgtagaatgttcctcaactgggatttggcagatgcttttctcatccttagtcttggcttgtgtgtgttttgaggagaaggaccacagagcttaagaatcattctcagcactctgtatcaggcacgcattctctcaagatgacttgccgctattgatgttgactttgatcacctggctgaggtagtgtctgtccgtgttctccactgtaaagttactctctcctctcttttcacactgtactctttggaagagagtcactatgcacagcccacacttaggatgtgggaagtccgctccacctccttgacgatggaatagctatataaattacctggggccgggcacggcggctcacacctgtcatcccagcacttgaatgggaggccgaggagggtgatcgcttgaggtcaggagtttgagaccaacctggtcaacatggtgaaaccccgcctctactaaaaatacaaaaaattagccgagtgtggcagcgcatgcctgtgatcccagctactcgggaggctgaggcacaagaatcgcttgaacctgggaggtggaggttgcagtaagccaagattacatcactgcactccaacctgggcaacagagcaagaccctgtgtaaaaaaaaaaattaaataaaaataaataaataaataatctggaattcttctgcctgggagatttgtctcttctctcttatctgatcatttatagcagtatggaatcatggtatttattctttgaattctaatctgttacgtatttatgacagtatcagtaaaagcctcccttgaaatttaccaatggcatgaacatttcagatgagtctgccatctttggtgctcctgggacacgagagagacctgtcttgcttgctgatcacaaaggtggctttttctgtggccaaagctaaggctgtagggtctggtaagaagaaaagatggtcatgttcctcgtcaagtttccagttggctactggagagatcagtcaaagagtacaacaatcaatcattcgttcattcaaaacttaagtgcctcctatatgccaggtcctgtgctatggaagcaggattttgattagaccttttaaaatgggaagcaacaagaaaagggagaaagtcttatctttgatttcagcctaaccaagggaggcatcactgtttccttcttcttttttctttttcagaacgacgtcctatattactccctgacaggggtgaggagtgtttcctacagttcacaggaaagattatgcatccatgattccagtccctaggcttggaagagaggtctgcataattgagatacagcttggtatgttctccagtgatactgagaaaagagtgaggagagtcaaaaggaaaaaataataatagcagcagttgtaaaacctaacacattaaacacttactatgtgccgagcactgatctcagtgctgaataagaataaacaaacaaacaagtaactgagttctcttactagaaaataattgtaaagtaacgtacaagtttgatattttctacacatggagttttaaatatgaagcagatatgaaggtatagtaaatagatcaaattatttaaagcaacatgtttaaactttcaaataaaacttaaacagaatcagtagtgttcaatcagttctaagttattaatactaagttactcagtcactccattaagattcaacaaaatggttttgttaatcagtggtaccaaaaattaaattttggttttaaccttagtccttgttgttagctctcctggaatttttctgaaatttcatgaaaagaataaaagaatgatttcagaaaaaataaaaaataaaaataaacaaacagagccctttcattttctcctggaggaagtagcaaaaacagcagccctatggagagagaatttcagaacggtatcaatggcctccaaaatatccctgccatttgactatattctttgttttcagagaatcctttggaactagcaccaaagcttcatgcaaaaagctgtgcagcactggttacaatgacctaaaacctggaagcaaactgtgttccaatagtaggggctggcttaaataatctctcgtacatacatataaaagaagaatgaggacactctctactgacatagaaccatttccaagattaaccgttaagtgaataatgcaaggtacagttttgaaatacacattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggatgagtatgttaattgacctgatttaattattccacaatgtatgcacatatcataacatcccattgtaccccataaatatatgtacttatttgccgattgaaaatgtttttaaatataagatgcagaagaatgtgtgctatcttttaaattttatggcatatggatgtattaactttttaaaaatttaaaagcaatatgtcaaactatttatagagtagaatccaatgatctatgtgggaataagaaagtgtgggaaagaatttttgggaaatgttcactagttttgtttgggtagaagatcactgggtaattctttcctcccatttttctctatttctaaatttagatgtgtggtacaatgaaatacttttatcatgaaaaaaagacattttaaaatgaaagaaatcctggatccaggctaggggtttgcttagatatttaaaatcctagaacgcatataaaaagggactcgtgatcacaaaaggacatcagagaatgacaaaaatgtcaaagatatggtcaggaaggcataaaccctacactaatttgccaaaacccaaaaagccaatgggctctcaaaatcaagccttaaagcaactttcagaggtttgctgttttaagtgtttggttaggactttgctgcaattaacaagaacctcaaatcaaactgggttaagcaaaagaaggaatttattggcttaaataatcaaaaagttcaggggaaagaaaagactgtctttagaatagcttggtcctgttcactcatattttttcttttctttttttttttcttagagatggggtcttactctgtcacccagactggggtccagaggcatgatcatagctcactgcagccttgaaccctgggctgcagcaatctttttaccccagccttccaagtagctgggactacagacatgtgctaccatgcccagctaattttttttttttttttttttttggtctacagacagggtctcaccatatcgcccaggctggtcttgaactcctagcctcaagcaatactcccatgtcagcctcccaaagtgttgtgataagaggcatgagccaatgggcctagactcacttacatcttgacttttttcctcttgactcagctctctacctggggcaccatattggggcattctaaatatcaggccctaggtagtggctcctagaaggccatgttcactgtagctttttttttttaagcagttctagaagaaaagagccaaaggtgcctcttccccagcagaggcaacagtatgcattgcataccaactgagtcacctgctcatttctgaaacaatccctagagacctgagaatgcaatgccctgagtggcggggtggaaccaacaccatcagaagcgcactattctagaggaaaagcaggtaccaggaaaacagactgagcattcagcagcaaaacagcaggcagcagagaaaattgcaaattcatgtgtgcccatctcttcaagtaaaatgaataaataagcaaaatgaaaaaatatatatgtatatcattaagaagaacatgaaatctgaaatagatggacagcaagtaagagaacattgctttaaatgaattcaaatttctaggccacatgcacaagtctcagaacccatgttcatatccatggagctacctccaaagacctgaactgtgatccctttcagagaaaccaaaccggagagaggccgctggggtctctcttttcacaaaggggatgggttggaagttgacatccgagaaccagatacaggcattgacttctgaggaaacttttttattaatcagttttataattgacaaataaaaattgtgtatattgtatttattgtgtgcaacatattttgaaatatatatacattttaaaatgccaaatcaagctaattaacatgcatgacctcacacattactctcttagcaaatttcaagaatacattgttgttaactatagtcaccatgttgaaccacagatctcttgaactgattatctgaggaaattactgaacaaattctaaaatagcagatttatgaaggcttagagaagattgatcaataaaacctactgtaaacttaccaagatcgtgtggtaccaaaacacactccacaggattacgagattgggagctctagggaagcccgataaaatccaattttaaaatagcacaaaaattaactaactattgggtactaagcttagtatctggatgatgggatcagcagagccccaaacctcaacatcagagaatacacctaggtaacaaatctgcacatataccccccgaatctaaaaatatttttaaggaaaaaaatatttaaacaatctgttggccaggtgagatggctcatgcctataatctcagcacttcagaaggctgaggtgggaagatcgctggagaccaggaattcaataccagcctgggcaacatagtgagactttgtctctatgaaaaatacaaaaattagccagatacagtggtgtacacctgtagtcccagctactcaggaggctgaagcaggaggatcgtttcagcccaggaggtcacggctacagtgagccatgatcccaccactgcactccagcctgagtgagaccttgtcacttaaagaagaagaaaaaaaagcatatgctattttcagaaacgcatttgaaaatttgaaaacatccatgtttgtgttctgaggataaagacaggtagaagaaacatgggtgtgaattagtagctgattgtctatccataccaactaaatgccatcatcatcatcatcaccataggtatttgaaggtttttactaccttacttagtcctctaaggctgaagtgctagcaggtagatatttattagtccccttttagagattaaagcactgatctcaagaggtgaaataacttgtccagctagcaaataatggagctggcatcctgacccagatctgtccagctgcaaaaatctttcctctcatgagttgttagcattattccaaacaaaacactgccctaaaagtgtgaaaatgtcctcagttcaccccttctctgcagtgggaccctgacatttaaaggcacaccaagaggagacagtgctccctgcagggctggagggtaatatctgaggtctgggagggacaaaattcacaaccaagggttactccctcccacctgtgcctgacatttttctttctaaaaaatctgctcatttctgttcttctttcctcttcatcttccccctctcccttttcaatattttatttctttatcttatttggtgttttcattgccaaagtaattcatgcttactataaaagcatcaagcaatagacaagtgtataataaaaagcaagaggtccaacccccaggaaactgctggggacagtttggtacctatccttccacagtgtttactgtgcgcacatcagtaaatcagacttaatacaatgttacaagttatatagaagtgctgaaatatacacctaagaagccagcagccttggctatagtctctggtgcatgcatgtggcatgattgtgcatggttctcagaaaccttgttgctgctcctatcattccttcctctaccagtccacaaatgtctaactgcccaccatgtgcgaggtgccatgctccgtgctcagaacacagctgtgaaccaggtggacatggtgcccttcctagaaacaaaatctaggctgcaagaatggtggctttaactcacttcaagaaatgcattcaccaagcaccttctctgtgccagcttttgcaggggatgaggcgatgtcacagatatatcagacacagcactgctctgaaatgctcatggaataatagaggagacaggctagaaaatgaggtccattatttgtgttttaaaattaggccaggcacactgttcacaatagcaaagacttggaaccaacccaatacccatcaatgacagactggataaagaaaatgtggcacatatacaccacagaatactatgtagccataaaaaaggattagttcatgtcctttgcagggacatggatgaagctggaaaccatcattctcagcaaactatcacaaggacagaaaactagacattgcatgttttcactcataagtgggaattgaacaataagaacacatggacacagggaggggaacatcacatactggggcctgtcagggcgtggggggctaggggagggatagcattatgagaaatatctaatgtagatgatgggttgatgggtgcagcaaaccaccatggcacgtgtacacctatgttacaaacctgcacattctgcacatgtacaccagaacttaaagtataattttaaaaataaataaataaggccgggcgtggtggctcaagcctttaatcccagcactttgggaggctgaggtgggcggatcaagaccagcctgaccaacatggagaaatcccatctctactaaaaatacaaaaaattagccggatgtggtggcacatgcctgtaatcccagctactcgggaggctgaggcaggagaatttcttgaactcaggaggcggaggttgtgatgagttgagatgacaccattgcactccagcctgggcaacaaaagcaaaactctgcctcaaaaaaaaaaaattaaattaaaaaaactaataaaataaaataaataaataaataataaaataaaatcaggccagctgcagtggaacactcacgtctttaatccctttgcactgtaacccctaagtactttggtaagccaaggcaggaggaccacatgaggtcagaagttcaagaccagcctcggcaacatagaagtttaatttaaaaaaaaaattaaatttaaaaatagccaggtacagtggtgcacacctgtagccccagctactcagggctgaggcaggaggatcacttgagcccaggagtttgaggctgcagtgacctatgattggaacccgggagtttgaggctgcagtgactgattatcatgccactgcactccaacctgggtgacacagcgagatcctgtctctaagtaataatgatgatgataaattaaaaaataataatttttattatgttgttgttactaacaaaatttattgagcccttcctagatgtcatacactatactaagtactttacaagcattaagtaatttcatccttttaaggaccgtttgaggtaactgtgatgattattcccacctcatagatgcagacactaaagctcaaagaagatgagtgccttgcctgaggtctcacggctggtgaatgaccgggctgtgactcaagccaagagctgtttgtctccaagactcttaaagactcttttttaaaaccagcatgctattccatttcatggtattctctttttctccctcattagcagattcctacagaacccacatgactctactgttcctgccccaatttatttttgcctgagtctccccactttgggcaaaagcctcgcttgaactatatcgatagctacaatgactgaaaattgtgtcacgtatcacatagaatctctgttcccaaggtacccagagagactgaaataggtccgttaacagtcgtgtgttttacattccacttggagggttaacattcagggtcacccttcttctgagccttaaaaaccaggggtatcaaagtaatgagggagtgcgagcattccatggagtttggattaatgatctgtgagcctctgttcagccctgaatgcgtgtcatttttagagttcagcctggcaagaaaacttaacaagaatcctggtcaaaagaagtctcggtcatttaatgacaaagggtaactggacaacctaccaccagcaatttatttttagaccaagttaagtcatacttctatgcatgacctcattcccatgactctcctgccctgcccccagttactgtcctcagctctatgatgcaaatattctgcagacgtgtctctgccctgcaagattccctagacagctttaccttgactacagatatgtcaatgtccgccaccatagaaaggtctttctgcagaccgaactgaactgatgctagcttgttccatcaggaccccttctttcactgtgcaaactgtcccccaagctcctgtgctccaatcagacaatcagaactttccattcatttcagcaaagttctattgagcttccactctgggttgggtagtagtctaggctggggacagaaagatgaatgagacccatgccttatgagacacatgatactcacagtgaggaggagagagcagatgacttacactgaaacaaaaacaataatgtttcacatccaataatataataataaacaagacacagaggaaggggttatttcttctcttctgagagaataggaaacaacaaagatacatttctacagagaagggctttaaaggatgaataggagttttccagggagaaaaggagaaaaggccatttctggcagagccaaccaaagcagaaaattctgaaagtgaatgtttgacaggagctgcggagagggaagaagagggtgacacataattcagtaaagtgattgtgttgaacatggaacagcagaggggtgggagatgagcataagaagttgtgatggttccttgacaccttgcttatttttgtaattttttttttttagattttgaaataatttgatcctaacaggaaagttgtaagcttggtataaagagcgctcatatacaggctgggtgtggtggctcacgcctgtagtgccagcattttgggaggctgagctgagagcattgcttgaggccaggaggtcgagaccagcctgggcaacatatcaagaccccatctctacaaaaataataataataatgaaagaattagccaagcatggtggtgctcacctgcagtcccagtaacttgggaggctgaagtgggaggatggcttgagtccaggaggtcgaggctgcagtgagctgtgactgtgccactgcactccagcctgggcaatagagtgagacactgtcttaaaaaaattctcataaacccgttttacctagtcttcctaaaatcgtcaatattttaccacacttgctttatcatcttttcttgatacatacatattgcatttgtatttttttatgaattgtttaagaatgagttggggtcatgatattcctttacccctaatcacttcagtgtgtatttcctaagaccatggtcattttcttaggtaactaccatataaagtcaggaaattgacattgacttaataccattatctaatccacaaaccttattaatatgtcaccaattttcccaataatttctttcatagtaacaaaaagaaaatgttgaccacctgtattagtccattttcacactgctataaagagctgcctgagactgggtgatttattaaaaaaaagagatttaattggcccacagttctgcatggctggggagttctcagggaatttacaatcatggccgaaggggaaacaggcatgtcttacatggcagcaggcaagagaggagagcaggggaaacagccacttataaaaccatcggctttcttgaaaactcactcactatcacaagaacagcatggaggaaagagcccccatgatccagtcacctcccaccaggtccttcccttgacatgcggagattacagttagagatgagatttgggtggggacacagagtcaaaccttatcaccaccctatttacaattgggactccaaccctctcaacatgccctgggccctggctctgctttttctttgtagcattttctgacctctaacatgtagcattattcctatttctaaaatgtctctcccttcccaccatcccactagaatgtagatctatgaggtcaagaacttttgtccattttgctcactgtcatatcaacacccaggagagtgactgccacatgaaagttattaaataaatagtctgaatgactgaatggccaaacctggaggtatctcttcccaacccctcttcctcttatttttttaagcaaaaaacaataggctattttttcatgccaagaaaactgagcctccatgttagtgtttttctccctttaagttcttgcttggggttttcttattttgcctcctgataggtacgtagggtatattgcaaaggagaaggttatccccagaacagctagggcttcttctaagaatagcccaagtcaactgaatctcccctgggtctcctatacagatgtgaaagtccttgacatgcaatggtatctatccctctgcaaacagagtgagcatctttagatctaattgaaagattaaaaagaagatccccagctggaaggtcaatttatagattccacagttaaatcaagccacattcttaagcacatgggacacaaaccttgcattaaatcaaagacttaatccaagttaagccaccctggatgaggagctagagctggagacatgtaattaacaccagccagtcagcaccaactgcttcagctgacaggtccacagcctggaaaaccttgttacaatttccaggagggctttggggatgcttgttctcaagttccagagacggtgggctttgcttctttccatctgatctcaactactgaccaccaggctccctgcactccagccccaccaacctccttgccacttctcaaacatgtcaaggacgcttccatttcaaggtcatttgcacctgctctctccctgagctccctctggactttgctcaaatgtcacctctctctcactctatttatttctgtaagcctctctcctccttgtcacctgctattccctcctgctgtatcccttcccgccactcttatcccacctgacacactgcacattgtacttatccatttactctttcttcccctgagaaaccccatgaaggcaggacctgtgctttttcattcaatgttccctcaccaatcatctagaacagtatgtagcatatatcaggcactcagtacctaactgctgagttaatttgttggctagttatctgattgattgactgattgattgggtggttaattaaatggttaattaatttacctcctgaggctgggcccccatatggccacctagctaagaaacaccatcaaaccgggggtgggtattttggttacgaaggcaaataagagctacctagaaatgccctgacgccagatgtcttcaatattctgagacctgagtctctgttataggttggtgtccttgggataaagttcaagttctctgtccctttggttcttaccttgaggaactccatcttccacccctgaactgctcatctaccctccagtgaactagaacttttgtcagctcctcaaagtcaccaggttcttgccacatatgacgtctcttcctagaacagtcctctccatcatgccatagtcttcaactctggccagcgcctgctccccaggtgtcccctgtctgcactcaccacactcttcttgcagtgaatcaccagactgtgggttccacgaagcgagagcccttgccttcttcttccccatggtatcccagtgtctagggcattgccagactcatgcttgaatatttgctaatttggataggagttatcatcttatttcacagatggaagttatgaactttttacacacctaatgtacgggaattttcacactaaacaatcctccaattctctgtggataccaattgggtattctataattaaattaaactttggcactgcctacctggtgttaccgtcagaccctatgagtgaagggttccaacccacaagaaggcccccaacctctgaggccagttgcaaatcccaggttgctacctgtactcctaagcaaccagctataaatcgggggttcctgcaacccactctcaggtttgataatttgttaaaatgactcccagaaatcagaaaagtgttttaattactactactggtttattataaaggatgaaagtcaataacagcccaatggaagggaagcataggggaaggatgggagaagggccccatgcacaccagcctcccagctccatgcactcaccaactcagaagctctctgaaccccatcctttagtattatggaggttccactacataggtgtgattaaaccattggctatttggtgattaggtcaatggttgttgacttcagcctctctcctctccttgaggtgggaagtaagatttggggtgggcaatgagcctaatagctcctccaaccttttaatcatgaggttggtttctctatagccagccccatcctgaatctatctagagctcaccaagagtcccctcatttgcgaaaactcaggaatcgttgaaagggacttgttatgaacaacaaaagatgctcccctaaacccatcattcaggaaattccaagggttttagaagttctgtgtcaggaaccaggacaaagactaaatatatacttcttccttcatcgcagaggttaaatatagtatagtggtaagaccacagctttgaagaccatgagttcaaatcccaactcttccacgtaatggctatgtgaccttaaacaagttatctcagctctctaaatctttttctcatttataaaatgacaatcatggtaaatttataattcattcaacaccgttctcaaggctaggaatatggcagtaaacaacagattggcccaaagtgatattcgagccaaaacccaaatggtgagaagaatttcgccaccttgagcctaaaaggaagaaccttcaaggcagagggaatatcatgcctgaaggtgttgaggcaggaacaacctcatagtgttcaggaaagataaaagaaggccaggccgccaggcacggtggctcacacctttaatcccagcactttgggaggccgaggcaggtggatcacctgaggtcaggagttcgagaccagcctgaccaatataaagaaaccctgtctctatttaaaaaaatacaaaatcagccaggcatggtggcacaggcctgtaatcccagctactcaggaggctaaggcaggagaatcgcttgaacccgggaggcagaggttgcagtgagctgagatcgcgccattgcacttcagcctgggcaacaagagcaaaactctgtctcaaaaaaaaaagaagaagaaggccagtggtgcctctggcatccccaaaagcaagcctccaataccacaaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcccctagcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccaatgctaaattcaatggcttataccaatgctatttgattcttaatcagtgtctgctccatctggtccctttacagtactgattctcaaccggggcaattttgctccctaagggacatttcgcaatatcgggagacacttttggttgtcacaactggggtggacggtgctactggtatttggtgggtagaggccagggatgctgcaaaacatacagcagtgcacaggacagcctgcccctgtccccaacaacaaattttcctgcccaaaatgccaacagtgccaaggttgaaaaatgctgcttttaagtaacacagctcaccctgcataaacattaaacatatatataaagagatgttaaaatgtatttgtatgcagataaatgcaaattaaaacattaatgagatatttcacacctcgcaagcagacaaatttcaaaaaggacaaatattggcagaaaagtggggacataggaaccctcaggcacagctgatggagggtatgctggtgtgacctgttactatttagtcaaaggaagattcacagacccaaggaccagcagttctataagaaagtcttacaaagctccttaggaagacacatacagaaataatcattgcaaggttatttgtggaaggtggaggtaacgaggttgtctatcattggggaactaggcagataaaagtggatgagcaaataccgtggggtattagaagtgaccttttttttttaatttttctttttcttcttttttttttttttgagacggcgtttcactccagcccaggctggagtgcagtggcatgatttcagctcactgcaacctccatctcctgggttcaagtgattctcctgcttcagcctgctgaatagctggaattacaggtgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatggaccttacagctttaatgagagtgaggagggggagttaaaaaaaaaaaaacaaaaacagcatgagacgattaatacaattccacatgcatcaatctttttcaaagtgtacacattgggagagtaaattggcacatgtactttggaaatttatttgatagtatttactaaagctcaatataaatactttgaaccagcaaattccactcctggaattatactcaagagatatgagtgtttgtgtccaccaaaagacatgtacacatttaatccataatagccccaaaccagaaacagccagttgttaataaagaaattgaggtatatgcatacaatagaatacaatacaacaatgaaaatacggatgcatctcatagacatcccattaagcaaaataagccaggcacaaagaatagacacagaatgcctcctttcatgaagttcaaaaccaggcaaaactaatcaacagtgttagaggtcattacactaatgtcctttggaaaggatagactttttttttttttttttttttttgagacggagtctcgctctgtcgcccaggctggagtgcaatggcgtgatctcggctcactgcaagctccgcctcccaggttcacaccattctcctgcctcagcctcccgagtagctgggactacaggtgcccgccaccacgcccggctggaaaggatagactttaaggattgacagggagactcctgcagggtcagaaatattctatatgttcatctaggtggtgattacacaagatctatacgtatgtaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggccgttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcaggagctcgagaccagtctagccaatatggtgaaaccccatctgtactaaaattacaaaaattagccgagcgtggtggcaggtgtctgtaatcccatctactcgggaagctgaggcaggagaattgcttgaacttcggaggtggaggttgcagtgagccaagatggtgccactgagccgaatccatcaaaagaaaagaaaaggagaaacaaaagaaaagaaaaggaaagagaaaaaagaaaaagaaaagaaaaggaagggaagggaagggaaagaaaaggaaaaggaaaaggaaagagagggagggaggaaggaaggaaggaaggaaggaaggaaaacctatacacagatacacaaatttatagacactctattcatagttagcaaaacctggagaaaatctaaatagcctccaaagaggaagtggataaacaaacatccacaccatggaatactatttggcaattaaacaacaaacaaactcctgatacataataaccagaatgaatctcacaggcattatcctgagtgaaataagtcagcctcaaaaggttattatcttagtccattcaggttgctatataccaaaataccataaacttggtggcttataagcaaacgaaatttatttcacacagttgcggaggctaaaagttcaagatcagggggccagcatggtgagggccttcctctagattgagggccctcctccaggttgcaaatggccaacttcccattatatcttcaagtggtagaaagagcatgagagacttctctggggtcccttttataagggcactaatcccattcatgagggctccaccctcatgatctaattatcttccaaaagcctcacttctaaatagcatcatattggggattatatttcagcatgggaatttgcaggaggacacaaacattcagcccacaacatgactttcttgaaaagacaaaagcataatgatggaaacagatcagtggttgccagggactatgggtgggggaagcatgcaactataaggaataacatgaaggacttctttggaatgatgaaagtgttcggtatcttaattgtgctcaaagtggttacattaatctatatatgtgttaaaattcatagaaccatgcatcaaaaaaagagtcaactttactatatgtacttaaagtataaaataaatgagatattgattcagagtcatattccacaattaataactatattaggaataaacaaatacgcgcacacaatattcttcaagaatatacacaaacaaaagatatacattaagcacacacgatggcctattaagggtaggaaatgtaagtaactagagtgaggtggtggggatgaaaggaaatgaacccagagacaaatcagtgagagacacatttgataatgcaactaggaagacttacaggagtgagaagcgattgtactcacagctatggtttattacaggatcggcaaggggcaagggacacacagcaggtagaatctggaagaatccatgcacagactcccagtgttctccccacctctctctagccctagggatcacggtgaatatgttctttcggcaacacctcttcagtgtttctgcctagagaagcccacgtttaggctcaaagtttgggtgttttattgagagctggtcacataagcacaaaaactagaaacaactattgaaattccaggctcctggaaaggaagcaggtattctgggcgcgaagcaggtattctgggagctaagcgggcaaaacagtgttttacatagttagataacaatgcaaaagccaagttcccagatgccagtgaagagccaagcctgaaagcaagcctttctaaagatggcaacctcatgctgactatgttaattctcccttgccctgggtccttgcagagacccatgtggatgtgccacgagcctgtgatccaaaaaaataaaataaaataatttttttaaaactaggatctgcttctggttttcaattcttctattatttaagtcatgcaacagtgttaaccaggcaggctcactagcatgatggatggataaataagtgggtgggtaggccgacggatgaatggatggatagacgaatggacggatggatgaatggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagacggaagattctcaccctactgcaatgactctcccagcccactgccaccaaagtttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccatagaaactctctgatattaattgatctgctcctagttttcagttattctattttttaaaacatgcgacagtgttaactaggcaggctcactagcatgatggatggatgagtgagtgggtgggtaggttgatggatgaatggatggacagatgaacaaatggacagatggatggatggatggatggatggatggatggatggatggatggatggatggatggacagatggacggacagatgaatggatggatggatgggtgggtggatggatggatggatggaaaaatggatggatgtatagatggagatagatatagacagaactagatacagacaaatagagacatcgttaaagagagagaggtaattatttatttttgcaacaagtatttattatctactttaggtcaggcactgctccagcttataactgtttgttataacagtaaccaaaacaaacaaacatccactaccttcccggagcttagagagagactataaaaattaaaaataatatatagaattatagatggtgttaagtgctatggggagagaaacatcaagtaaaggggcttgggaccggctggaaagagttccagttcttaaagaatagggtcaggaaaggactcaccagaaaagtgacttttgaatggagacctaaaacagatgagagtgttcaggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccaccccttatgttataataatgtggtaacacaaaaaggtgggatggcatgtcacatattgactcggaagtaggcaaaaacgtgagaccaacttgggcttagatacacatacctaggaatatactaggtgaagtcaaagacagcaggagattgatattctacataaatatggaaatgcactttatgagttcttgagaatctctggggatttttcataggtctcacccatcactggtcatgtaaatatgtcatttttagcaaaatcacattctcttcacttctatctgttctgtattgctgcaaggactgctttttgaactagggtatgacaatgatccgtcttgatagtgtttgtgagtcaattcagaattacagtgattactaaagttggtcacatattccccccatctctatatgcattcctctttgtgatgtcactttgctgtcctttccactaaatagtagaacctatttctctaccctcttgagtccttgtcatgtgatttgccttgaccaagaaaatctcaaagaagtgatgttatggtaattcacagcctacaccacaacaggccagaaacgtctaccttatccctcttgaaatgctaccctgagactgacatatggggagtctgggctagactccttgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaagaaccactcacctgagctcagcccaaattgttgactcacagaattgtaagtaaaccaacaaggtggttgtgttaagccattaagttttggataatttgttatgcgggaataaataactaatacagatggtagctacaagtctcttcctatgcctatggttgtcaagtagacaggtgaagcaattagtagtggaaactatccattcattaaacaagtacttatggagctcctactctatgcacacacagcctagtggctcacaataagcaacctttacagccactgcttgatgaaatatctccagacaaaagtattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagattattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggtttcatttgtgcattctcagacttgtgggaagatacttcaccagccccagccttagaaatgagagtaacagagctgtacaatctctgaggtgttatgtattcttaaggatacacttactggcagggaggaaatgctctaagccatttacatacattaccgacatcttctcttttaaccctccagggatcaggcatctccacggggtaggcactcccaccttcctgattttacaaatgggagtctgaggctcagaggaattgggtgacttactcaatgtcacacagctagttgcaggagtcagtcttttaactcaggcccatccagtcttaaaaacatggactgaaccagtgtacatccaactgacagatgagtttagaagctatctagtccagacaagcttgaactcagctagtccagcctttcatgcacctcacctatttagtgacagggaagtcattacttctccaagcaacttacattacgttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggtttcctgctcaaactcacacctcagcctgaattcccactcctgaagatttcttacctctctgtagtgagctctgttgatggcctctctccatcctgctgtaactcacaatggaacctgtctcttccttcatttctcccaatgatctctaagacagagctgtctcatgccgctgactttactgaagctctcaggatatggagggggattacagcatgcaataagccatgacttccacaaagttacttatctctgtcttgaagttcttcactcacccctgccgtaggaaatttcacttccctagcctttcctcagagcccagctgctgtcatttttggggggtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctccaccaagtctcttctctatttccttctaatttttcgcaatggtcagtacacccaagaccctctttccctgagctgggaaaagacctcaaattactatttttttgtcatgcataccaatgcaactcttcttaatctaagcttttctcatctctaccgtactccagaggaaacctccctgcaaataagaaaaccacaccaattaaagtattttttctgggaaaagaaaatatgcagttgtctcagaaggattcctcatgatactcctaggtcaactaattcaaacagcagccaacttttgaaatagaagttttctattaaataatagtaatgtcaactattaaacctgcaccttggcatatgatatgctacattcatttcttcatcttccaaatgaagaaactgaggctcagagagaaacattatcactagctttaaatcactgagctagaaagtggaaaagtgaagattcaaacagtccccaaaccaacacgcctttccagtgcttgaactatgatcaggcaagaaagtgcaacacttaaggtggcactcactctcaggggctgactgcacaagcatgaccctaagaatgggtacttccttaagagcagggtacctagaatccaagttcaggcaagtgcagggtgaatgcagctttaatttgcatcctaagcaccccgcttgcctcaccacagctggggccctgtaccttctcttccacaaccctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccattgtcaatctttacattagggtagatttttgaaacttcaggtccctacaatctagattctgatttaattagtctagggtgggaccctggcctttagtatttttttaaagctgcagccctcagtggtgactccaacgtgtagccagaattggaaaccactctaatttgtattttattttttttatttttatttttggaaacagggtctcactctgtcacccagggtagaatgcagtggcacgatctcagctcattgcagcctctgcctcccagattcaagtgatgctcttgcctcagcctccccagtagctaggattataggcatgtgccaccatacctggctaatttttttgcatttttagtagagacggggtttagccatgttggccaggctggtctcgaactcctggcctcaagggatccacctgcctcggcctcccaaagtgctgggattacaggcatgagccactgcaccctgctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttgatgcttactagaggcaggagaagggacatagaaggagcaatggggataggtcggccaaggggtacaaagttaatcaggaagaataagttcctgtgttctattacacagtagggcgactggagctaatgaccatacattgcatatttcaagatagtcagagaagaggagcttgaaaatgatcaccacaaagaaacggtaaaggtttgaagtgatggacacacactggctaccctgtttgatcattatacaatgtatatatgtatcaaaatattacactatacttataaacatgtataattatatgtgtcaattataaatgaaatgttaatatgtcccttgattcttgtttgtacctttttccaattatttagccttacatatatatccatgtatatataaattttacataaatgcataaaaagtgagcattcctttgtgtgtgtgtgtgtgtgtgtgtgtgtgtgtgtgtgtatgagaaaaagagacagagacaagcagagagagagagagagaggcagaaacagagagagaggaggagacagggagagagagacggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagccatacagacacacgagtgtgggcaatcattgttttatagaaatgggatcatattctaccaaccgttcccatgtattcaacaattccttgttgtaagccctccaagttgatttctcaaagaactaaaaatggaactttcactggacccagcaatcccatcgttgatatgtacccaaaggaaataagtcattctaccgaaaagacacttgtgctcatatctttatagcagtgctagtcacaatagccaagacatggaatcaacccagctgtccatcagtggtggactggataaagaaaatatggtacatatataccacagaatactagacagccacaaaaaaagaataaaatgatgttctctatagcaccatggatgcagctggaggctgttatcctaagcaaattaacgcagaaacagaaaaccaaatactgcacattctcacttacatgcgggaactaaacactgggtacacaaagacagaaagacgggaacaagagacactgaggattccaaaagggggaagtgaaggagggggcaagggctgaaatattacctattgagtaccaagtttgctacttgggcaacgagatcatcagaagcccaaacctcggcatcatgcaagatacccatgtaaaaaacctgcaggtgtaccccattaaactaaaaaaaaagaagaagaaaagaaagcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagcattcattcacttagtaactgtataatgaagacctaccttacgccgggcaccgtgctaagcactggggaggcggtggtgtagaagtcattatcccagccctcaattgctcatggtcttagggaggaggccaagacacaatcacattagagccatgaccaggacaggacagagctaaagcctatgacaaacataagcccagggaaattaaggagtatacagggaggcgcctaagccaacctggggaagtatcaaaggcttcctggaggaggaggatgaggaagaattagtaatgttgaatactggcaggtgaacaattcatactgtgagaggctgtggccccagtacccttgcatctgctctagactttgacttctacagtgagactcctggccaatgaggatctatgtccacagtccctgggggtcatcagccctgcactctcccacctccacatctttgtccatgttttttcctctgtatggatagcactctctggttccctctccccagtctgtaaaaccatcaccttcacctcccatcaaggcacagccccagtgctacttcttgcatgcagcttttccaacttcctctacctggaattaatctctgtctctttctctctctctctgaatttcaataacactttgcttgtttctctcttatagtacacagcactcttgacattgtattataattatttgtgtatttgtcttatctcctctgctaaactatgaactccacaggggcagaaaaaaaccttgtcttaaccacctttgtattccctgcagcgccttatacaaggcaggtgcttgatacaggttgaatgaagattatgtttaccaggttccaggtaagtggaaggaaattaaaagacagcccagctggaaacagtgggcaggcattacaggcaggcccagctttctaacagctatcataaaactggctgctcgctggagctgtgaatttcccatcgctggttagagaaattctttaaaagggagattcttttaaaaatggctgtcctagatgatgtctaagctcatctaattttcactaggttactacaatggagaatggttgatgagtaagcaaagacagcagaaacccactacacagtgaaataggaatagatgtgtgttattgtcaatgtgattgctcttggttgaatgatgagatcaggggtatttattagattattaaatttttaatcaattaaactaaaagatccattctcagagaaataatgacagtatgtcatgagcaaggattataactaacctaattctaaacatccgaggattttttttgttttttttagagataggggtctcatcatgttgcccacactggcctcaaactcctgggctcaggccattctcctgccccagattcccgaagtgctgggattacaggtgtgagccactgtgtctggctgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccagcccctttgcccagcagaaatgcagactcagcattgcaagctcttctgagttttcaaaagaatcaggaaattaagatttttttttgtagaacctgccatttttcaatgttaccttaaaaatgcttaaacactttgtgaaaaatgcccatctgtggctcagatctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattaccaatttctttttactcttccatattgtcacaatgttttacaatgaacctgagcagcagatgctgtcagtgccctcccacatcccctcagctcccttgatgattttgtgcacaccagtttcccatgtgctttcactcccaacagcctcagaatattggaatccactttctctgaatgcacggagagctagaagcacctgggaatttatgttgcccaagagcagcccttagccaatgattgacaggtggaggagtttaaatacttcacctcccttgcttcttaacgggaattacttcaaaatatgctgcctccagatctcccctgcagattgagccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcatcttctctgttaatgcccttatacaatcccctcaccatgagtgtgccatgtttctaaatccaaaagtgatgagtgtcacttccatgattgggatagaagagattgacttccatcttgccaccagactctctagattgtcttctctccttgtgtgctttgataatgcaagctgccacattgaagagacccacatggcaaagaaatgaaggtcatctctagtcaacagccaacaaagagctcaatgctgccaataactactgagtgagcttggaaatggatacttccccagtcagaccttcacgtgagaccacaaccttgcaccaacatttgattatagccttgtgcaaaaccatgaagcagaggacctagctaactcacatccatattcctggcccacaactataagataataaatgtgggtcagtcaagctgcttaagtcatggggtcacctggtatgtagcaacagatcccaacataagacaatgtgtaatatttctataattagaaaatattccatcctagatatctcctcctgaaagccattcctgagctcccagaccagggtgtttttgtcacctctgtcatggtcttcatcatcctgaatttaataattaatatgccctgcctccccatctttttctcccctactgatcaccttgaaggcagagctttcagagagaaaaggtctgatatatttctttattcatcatctaagcatagtatcatataggagatgcttaacaaatgtatattaaagtaattgatttgttaattgttttccatatgagattttggccaagtgcctccctatataccattattctgcagatgccaaatcaagggtaagggaggccttcaatattcagcaaaatctctactccatgcatcccccacatcattttctaagcagtttcttcctttccatcaccagggtgcttatcaattgtacattgacaattcctcccatctgttcaattcatctgttggatggtcactctctgccacttcagagcaatggggagttcactctgcctttcatacccctctgggaagcccaggaaaattatctctgattaatgtcatttcttcttttgggtctaatgacaaaattacagcaaaatccagccctactttgcaccacacttggaaaaaaatctgctcagcttttgtctgccaaccacagcaaaaacttgattaaccaggactcagtgcacatgggcagagggctttttccccccagttagcagagggatgaaactgaaaatcccatttatttcctcccttattaacagaaaaaaagaatcaatagcttagcccacattgctacccactgtcaataaattcccccaaagaaattgagtctctcttggaaagatgagcattcttgcaggcctaagaattgtgtattctgggactaaagatagtgttagaaattagactgaatcagcagagatctttggcatgtggaatttttatttaaaacactatttgctatcacttatattcccgtctttgcccttctcccagaagcaaagtataaaaaatgtgtgttctcatttttcaagtgttccagattcctaaagtccagttcatataaattgcagcatattcttatttatatgacagagactgtcacaggcatctaagctcaagcttattaaactgaagtttcctattctatctactcaatgggttctcatagtctcctaagcatctcatcatcttcctcctccctctgagacatgaaactcctacttggaaccttttcaaggtctacggcattgtgcaaaaagaaaaacctttcttgttatgcaactaacagatcctttcagttccaggggaggaaggagccaccagaatggtcactcaataacttagccaagtttcaactctgttttaagggaaaggaattgcaaagaaaggaaacattcgattattgagcactgactatgccaggcactgaattgagaatgcattttttactcctaatcatagcctgaggccctgcacgatctggtccctgcctgcctttttgactacacctctgaccatgcccccacatcacttaatatgctatacccacactggccctttttattttctagagcatgccaagctcttcctaccccagggcctttgcacttgctggtctctctgctgagaatgcttttgcccagatatgtgcgtggctcactccttgtcattcctcatttcttaattcaaggccacctccaaaaggtaatcccgaactaagctgtccacctcccatgctaagtcattctttatcttgttcctttattgtattttttccataacacatcaccattttaaattaacttagttattgcctgcctccccatgaatatataagcttcatgaaagcaaagtgtgttcctgacttactcactattgtgaaaccaacatgctagcacatgcctgccatataatagaatctaaaaacatttctggagtggatgaataaataagtttctctctgaatcctgccaagataaatattgttattatccccgttagcagataaggaagttgaggttccaagcagattaggaaatctcacaagtttgcacagctagaaggtgctagagcaaatcttacaaccacggaactgtctaactccagtgcatgcattctccatcattcctagacactgtgtgggaagacaggagattatagcttaatcaattgttttctaacttctgttcatgaaaaatgtctgggcagctgtgacaaggaaaaaagtcttttatcagctcacagttgtgagtgtgacagagcagggatatatcttctgcatcaaacattgccagtttgtcaaatatcagaatagaattgaattttaggaagccactatttctgatgcagctgtttcttttggatcctctcaatgggcagagaagatcccagcaatagaatgggtgaggcacgcatctgtctattaggatggttggaatgcatgaatttgataagccctatatttggtgagggatgtctgtcctcaccccaaaccttctcaccaacgtgacctcccgccagcatggaagccagtgttacaacattgtgagaactgggccctgcaactgtgctggtggccatttttctgggaccctcttcttttactgatacctttgggagtactcccatattcatttccgttgggcatctcattcgttgctgtaattcttgtcttcagttcaaagctcaaaagcctcaccataaagaactgggttttactttttggatcttgatccttggggaaaccccctaaaaaagtctatatctactatatccactccccatcttccagtcatctctgagcatggctgatgtagggaattgctcaacacagtttcaaagccccaaacaacaagctagctctggacatgcctacctgctatggtttgagttcagtttgtgtccctccccaaaattcatctgttaaaatcctaatccccaaggtgatggtattaggaggtgaggcctttaggagatgactgggtcataagacaggagccctcatgaatcggattagtgactttataagagatcccagagagatctttgtccctcctatcaggtcagattatagtgaaaagtcatccatgtaagaaccaggaagcaggtcctcagcagacactgaatctgtagataccttcatcttgaacttcccagacctcaaaacagtgagaaataaattcctgttgtttataagctaccaagtttatggtattttgttacagcagtccaaatggactaagacactacccccattctatttaaaagaaaataatctattagctcaccacatttactgtgctgaaaatttccaaccagaagaaaaagctttatggaggtgacccaacgatatggaggtgcttacaaccccatgggtggctacaagaatcaaagagagaaattatagttcaaaggcaaaacgtatactatctcctcatccctattttttcttggtttaagtcatttttattaagagagtcataatgttctttatctacatgacactttccatctttaaacattaactaattaattgactgaaatggtatctcgggagcatttatcatctatcacattagccagagagccagggaactgtctataaaagctgttgaacactcagtggaggcttcatctttccgcttcctttcccagaaatgtttttttgtgtgtctgcatatgaatgtgcaatggggaaaaaaataaaaagagaggatttgacttccaccaactgctataaaaatttacctctgggagacatggaatttcaattgtgaaataatcagtcttggaaattgtcctgtcctccaggaaaagaaaaaatatgtagtttaacagcaattgcccttcaaaacaattactaattataacatctataaagaaaaataccctcgataccattactcctaataaagccaggcgaatctatagaaaggaattagctggcatgtctaaaatctgacaggagagctgttggggatgggtcagaagaggagtgagctccaaccagcttaaaaacctggatccaaagctttaggaggcttaccacctggagcaagcctctcttagcaaattggcaagattagcacaagaaatcaggccaggacaattacaaattgagaacccaagtcatttttcctgactttccttccactctatcccatcccagctttctccatgaacctcttaacctcctcttcaagcagatgtcacggtacctggaactcatgccttacagctcaccatcttcccttcaccacagtcctcttaaagacatatgcccaggtagggttacaccaagcccctgagcccttggattgaatttgactgtcagatcctaactgtttgaaacaacatatgtcatggaggaaggatcttggaggaaagaaagagagaaaggggccacagaaaagagaagttggtggcagtgctgaagatagacaaatggaaaaagtccattctgatttcaaattctccatcacttccctgctgtgaaggctgtgtcaagttgatttgaactctctgatcctctcacctcagtttctcaaagtgaggggaaaatatacctgaaagcctactttttaaatgagtgttcagttgcagacaatggaaaccactccagctaccttacgcagaagggaagtgattaccagatgtaagctgacttaggaaaccattggaaggacccaaagagttggagcttccaagaacaattccctggtcccccaaatcactctgcctctgctatgatggtgaaaactgctacctgcactacgagaagtcaccacatcaggaagctaatggctgcagaactacccagactctgcagagatccacaggagcaaagtgaatggcattatgccattttcccctcttaactcagttataaattcaagacgcaaagagtatctgatttgcagaacctgagtcatagtcagaatcctagctgcaagggagtccagtatattgaccttttagcaacccagcctctgcagtatagaatgacacagttgacagaggctggaatggaaactgaaggagcccatgcacaaagggcaccacccacatgattcagggctgtcaagagaatcaaatgagatggtgtttacaaagcacctaatatgctgcctgatcattagtagcttctcaataagcactagttttccttcactttcccaaaattttgctgcagcttggccctctgaatcatcctaaaagaacagaagaaaaaacctggaagcagccaaatgaccttcctaacttaaatgtgagggttttttgggcatctttcatttagcaaccttaccaaacatcagttatctctatttaaggcattcccctacctccacagaaagaatgaatcattttaagcagtagtttaagcttttactctatccaaacaaaattggcgaaagatcctctccctggataattacattaacattatttatctaaccactatttttctttttctgagatggggtctcgttctgttgcccggaactggagtgcagtagtgtgatatcagctcactgcagcctccacctccctggctccaataatcctcctgcctcagcctcctgagtagctggggccacaggcatgcaacaccacatttggttaactttttgtatttttggtagagacagggtttgtccatttgcccaggctggtctcgaactcctgacctcaaacaatccatgcacctcggcctcctgaaattacaggtgtgagccactgcacctggccaatctaatcattatttactggtcacctactagttgcctggcagatgtgattcctctccttcaaggagttaacagtctaggcagggtaattgtgcaaaacttgtaagattaaaattctgataaaacattaagagaagagatcagagtgccataagccagaataaagagggtgaaactgattctactcagggagtcaggaaaaatctccctgaggaagtaatgtctacactaaaacctgaaggataaggaaaagttaacctagtaaagagtgggagggaagagaatttctggcagagaaaacagcacatgcaaaggctgagtatttaggaaaccagaagaatacctgtgtggctggagtatgttaagtgagaaggagagagaaacgataattactttggctatggaactccaggctattatctggggtgacattttccctcaggttggaatccagatatgtgagacaattaacatttcataaaaataacttttgaagcaatgtttgtccacctttctgtatctcagttgtctcctctgtagaatagtgttaacccttcactggatgatcatgagtgttaaataggataacaagtatacgattatgacaagaaggctgggcccttttgagcacagcagcgacatcctcatcatcttcttcagtgtttagccataccactccagagagctccaccaagaaccagagaggtgcttccctacctgcatgacttctctgagatgctctctagcccacacacagcagaggcacccacctgacaccttcacctggccacatctgattggaccagagtgtacacctcctactacccggacctatcatattcctacacctgggaaactcttacattcagatagaggcgcaattgatcagagtgcattagaagctggagctgtaaggtcatgaagaagaagtcccagggccctgggcaagtagaaactgggaaacagcaaaccctgagattccaacggcaggcgccagtctgcagagaagagaatggagcagatgtgcagaggtaagctccagagagtgaaatggagaaagcggctgattaacaacattccaagtcccatgaggtccagctgcatacgtcggatttccagagagccttgtgtgtccagacagtaaaatttcatatccactttaatctctttgaatgggtttctattccttgcaattgaattatcactgtctcagaggcccatcaaagtggagagctgaggccacccttccttaaatcagacctaaaatgtaaccctatcttgctaacaggacataataccggaactgaggaccccaccaccatctcaaggccttcacacaggctattccctttgcatagaaagctcttccacccgctccttttgcaaaactaaatctcacttatcttccaggctgccccctttgagcatcgcttgtaaagactcccactccaaagtggacccttgctgtggtttccatagctctcaggacttccctttgcattgtgtaactcactttggatcactcgtaagatggctgccaccctaccatatgtgacattccacacttgcatcctgtttcttgcttattccccagggtttgagtgggggacacatagtagctgcacaataaacatctgattaatgcatgatggatagtctaaaaggatcaaattgacattctactgaaaaagaagagtttcactttagcctactaggtgctctactctatgcaaggtgttggaaacacaaagatgaattagacatcatccctgtgtttaggtcttgaaaagcctaagggaacaggtggataggtagataaatacgtttatgacaatgtaacaacgtgagtgttaggagagagagagactacaataggtgtatttctgaaggttttttggatgacaggggaagagagagagatgttgtagagggtcctagtggcccccacaccatcactcctcagaatttttgcagaaaacaaatgtagtgagcatctgattgttggctgctcagcatctactctctaattctgaatatagcacttcatttttccttttggtaaagcaccttcctgccctctcagcccaccagcacactggtgtaactggtatcaattcaacacctctgtccccagagtcaaggatggatgtgtgtcccaagcctagtcaatcagaatactccatcctcacaaggagtggttcagggatgatcatgtgacagtttagttaaatgagagtcaatctgggagtgtaaattagttcaactattgtggaagacagtgtagtgattcctctaagacctagaggcagaaatgccattagacccagcaatcccattactgggtatatatcccaaaggaatataaatcattctattataaagatacaggcacttgtatgttcactgcagcactattcacaatagcaaagacacggaatccatctaaatgcccatcaatgatagactggataaagaaaatgtggtacatatacaccatggaatactatgcagccataaaaatggatgagatcatgttctttgcagggacatgaatggagttgaaagtcactatcctcagcaaactaatgtaagaacagaatatcaaacactgcattttctcacttataagcaagagctgaaaaatgagaacacaaggatacctggggggaaaaatgcacactggggcctgtcagtcagagtggtgggggacagagagcatcaagaagaatagctaagggatgttgggcttaatacttaggtgatgggataacctgtgcagcaaaccaccatggcacatgtttacctatgtaacaaacctacacaacctgcacgtgtacccctgaacttaaaaggtgaaaaaaaaaaagataagagtatatctcagaattcctagggagaagcaaggagaaagataagctcttctgtcactagaacccctaacctggcagcagccttcagctgagctgctgaagcctgtcttgggactacaaggggaaaaaaactccccaaaaataaatcttacaaggaaagtagcaggcctgagagaaaaagccacttctgatgtcagtttgaacatctggatccaaatagattcatcctggatttttcagttgtgaatcaacaaattctactttttctgtttaagcttgagttcctgaacctcaacactattgatagtgtttggctggatgggggctggcttgtacattgcaggatgtttagcaatgttcctggcttctagagccattctcacccacgagtcatggccaccaaaaacagctgcaatcattgccaactgtcccaaggggcaaaatcacctcctattgagaaccactggtttaaaccagttttcaggttcctattgcttgcaaccaaaagtcacgagcatacagtaacctatcaaataattccctacccaatttccaggaataattctcactcctacatgcttttactttccgtggtacctggaacatctttctatgggctttgctttccaaagccagtctgttgattttacattttttaaatattggtgtcaatgaaagtaagtcaatcagatcaagaacagcttagctctcagtcccagcagtacttgtacaagtgacatatttggggacattgattatactttttcttcctcttaaaaatttaaacatcttccctcatttactttctttattttagaattctcagcagtcaattttcttttatctacaggccttcccttcgatgggaaactaatcaataagaaattagatttttgccaaggtattttaaagtaatgtaaccagcatatttttctctcattcatgactttattattgtgaaatgaaaacagaaataccacatccttgaaaccctcattttattaagctccatcacagctaccttcattcatcggagccatctcttccaacgtcattgttttgggtgaagcttgtgtttgatcaccaacctcatattttaaattgaaactcagctggagtagagttcttccctctgaatgagggatagcagtctggtaattagcagcaaagctcaagcagacaggctgcatccacttattctatctgaaattcttttccttttctttttttttttggccagtaattactcttatcttggtgaagctgacccacctcttggcccctcaattggagtctccctttcaagaaaatatcacattgtgttgaataagaaaatcaaaatggaaatgaagcttcaagaggagtctagctaccatcttttcaattgccttttgaaacatcagctgggtggactttcaagacgcaggcacagttagatatgtggatctgtttcttagattgcacttgtgtatctgaagacatccattatgcctaagagggaaggaaatgagcaaggacttcccaatgcatacaggtgcttcgtaacacctggtgatcttgttactgaaacaccagaggttcagtctaggttctaatgcttgctgcacagaaagccaatcactgagacaatgagtattgccagggaagaaggcttcaattggatcctgcagccaagaagatgggagatcagcatcaaatccattcccctagctgactaaaattaggtatttttatagcagggaagaaatgtaaccatttgtgagaaaacaggaattagggagaggaaaggaagaggagtttgtcaacaagaagcaagtggttgcttaggcagtcatgatggatgaagggtcgggtgctttcactgtccagattcagagatctggtgagtttcagctccttgattctatctgggaagcctgatggttggaggcctgagaaaggaactcagataagacaaatgtaacttttgcaagtttcaagactgggatggccaatttctatgtgtatttaaaagaaaccataaacatcagttctatgggacaattgggccagtttcagttcggctcagttttttggcatggaaaggaggaagagactatcaataatattaacagtatagctatattgatcctttattagagggggagaaatctatttatttgggagagtagcttcaaagtgtgccaagtcagggaatcaaaggcacattgggaacaagctgaccaaacatcaaccagcatgaacggtcttgagccctcaagaccaagatgagccaagaacccacttcaagtttgaccaaagcagacagtaaataagacctccctgtaggaactccgctcttgttgcctaagctacattccaccttccacactgataattttatcacaaaaacaagcaaatgcaaaggaagaaagtagtgatatgataggatgacacatgatctagccaattccatctagaaggcaaataaaggacggaggcttggtgagattaatgcatttattctttccagaaattatagagcccttactctttgtctggtactgttctaggcttggaatacaagcaaagatccctgcagttgtggggtataccctgtaacaggtgaagagtgacatatcagaggaaggtcagtgactacagatgaaagggattgcattgtaggacatttcccatgtcctacaagcctcctcctgcctttggtagaggtgagtgtaaataaacaaaatgtttcctgcactcaaatgccctcctctattttatttgttatgggagcaaacttccatctccaggacagcagagtgtagagcatcttctggtgtggtagctgtggtgagttagcttgagctgaagccaatgtgggcaactgtctacttaaataactcacctattcacctattcctggctgccatcaacaaagttggagcctccaagaagcagttaggattaacatattaacacagaagatggtcttttttttgtttttttttttttttgagacggagtctcgctctgtccctcaggctggagtgcagtggcgcaaactcggctcactgcaagctccgcctcctgggttcacgccattctcctgcctcagcctcccgagtagctgggactacaggcgcacaccaccacgcccggctaatttttgttgtattttttagtagagacagggtttcaccatgttagccaggatggtctcaatctcctgacctcatgatcagagggcggtgtcttagtccatcttgcgttgctataaacaaatacctgaggttgggtaatttataaacaaacaaaggtttatttagctactggttctgcaggctgtccatgaagcacggtgccagtatctgcatctggtgagggcctcaggctgcttccactcatggtggaaggtgaagaggagctcgcatatgcagagatcacatggcgagaggggaagcaagagaaagagggggaggtatcaagcctttttaacaatcagctctcacaggaactaatacagcagtaactcacttataaacatgaggagggcaccaagccattcatgagggatctgcctccatgaccccaacccctcccatgagtctgccacctccaacattgggatcaaacttcaacatgagctttagggggacaaatactgagacgatagcaggcagtcagcaaaaacaagaactagcatgtgttgagtctgcttgattcatcctttcacatatatcatgtctcatttcacttccacaacaattctatgaggtatgtatgtattagccccatctcacagatgaagaaactgaggctgagagagactaaatggcttgcacaagatctgtctgactccaagttctacaggctttctgcattgttgtgctgcctatttcacccaataaagtccaacccatccgcatgagagtgttaataaatcaataacctgagtacttcctggggctggctctgtgtctatccctagattgggcactgtgaggggtatgaaattaaggtacagtctttgttctcctgagactaagttagctaaggaaacaaagggaaaagcattcattcaatatttaacgaaccataccaacactccacccacattcaccctatcttacgcaaatacttgtggatcccaaaacgtgccatgcctttgcacaagtctgcaatgccctttcctctctcctctctgcttcaacctacatcatcttcatctcgcaagagttagatcatccagaaagcccctctaaacccacaggctagttggtggactttcttctatgaattccatggaccctggtgctcctctccgccataaaactctctggaaaaaaaatcagtgagagcttcagaagttagggaaccctgtaagtgagatgactggggagaaaacaaaagcctgagatggggaaatggctaaagacaaaagaggaaggaatatgtatgtggcccaaggtggtatcatctacaacagaaaactgacagccaggtaagggactgtatagagctagggatgttgtcacagtaagaaatagaagatatcattactcaaagccaagttaattacgatgttctgctttcacttattttttctaagtgcttccacctctggaagcatttctgatcagcacaactgtgaggttggtagtaggtattatcattcccatttagtggaaggagaaactgagatgctcagagaggttaggtgagctgcccaaggacacacagcatgaagacactaaggcagcagaatggttgagatcagactttctggtgtcaggcctacagctctcaaccacctggccatgtgaccttggacaagagacttaacttctccaagactcagtttccacacctaataaaaggggactaaagaatctctacttcgtagagatgttgtatggtgacataatcatacgagacctttgtcagtccttgacatatctgtaacaataaatctttgttccactcatcaccactgcttttgtttcgctgggatcatctgcaaaaccgcttgtgtgaaactctggtcccagctgctctccagggacaccagggcttccttgcaaaatatagcagccaagatggctttgggcccccaagtttctgagctcttgtttgactgcacatccccttccttagaaagccagcatcttcacgtttcctttctaagctgccaggaataaatgccaggttctggctttatggaacagtttgggaaataattagtttgccttccacagaggccagagttcacttctaagatatttaaaactctactgatggcttaaaataaatatcacaatggagatgtcaaaatatctatgtgttcttacacatgacattggaggggaggggagactaaaaaaatgtaaatggatttaccaaaataatctcgaggtaagacctttgaggcttgataccacagaagtgccatattgtttttaagtttctttttttttcttttgtaagtttatttttctcctcggagggcactgaaagttttgttgtgagaagcaataaagttctgttttccaaaagaaaataaaagcatgattgtatttttaaaaatcaatcttaataatttccagccattactttatgagcttaatgcaactcccaaacactgataactgatttctccaactggaagatgcgaagcgcacccaacggatgccaagttccgggctgagtactttaaatatttattgaattattaatcctcataagtgctcagtgaggcaggaatgatattcctcattctgtaggggaggtaatggagaccctcaggtacttgcctaaaaacatggggataataaagcagaaagtcaggattgaagcctaagtgtccttatcctgactccatgctctttccagtgagttcttcgccccatccagatctaggagtgctgaacactcaacaacattatcaggcaagacaacaaacacacccgtgtcaactggagtttgtggctagtataaagcaatatagagtaaatctcaaagagaagtaggtcaaagaaatacctacaacctcaagaatgtgtccttttctggctgggagcagtgcctcatgcccgtaatcctagcactttgggaggctaaggcaggaggatcacttgagcccaggagttcgagactggcctgggcagcacagcgaggtctcgactctattattttttaaaaaatagaatatgtcctttcccccttgcctgcctggataaaaccttcttttttatctcttgctgcttcccacttcgcattttctgctctgttaaacatcaaaccgcttctgttgcccagaactatgtctcaggttccacgcaactgtgcctctgcaatgctgtgcctttttcccaaatgctgttcctctacaatccacttagcaaactcctgttcatccatcaaaaccctgataaaacataaccttttaaaagaagtcatcttcatccctctcccacttctagacccaatggaattcacacgttcctcttagtcttctctccatagcatgtacatgcttacatttttataattattgcaacgtctgggatttgggtctctgggttagttgattggtttggctgatatatcagtctccctcacccgactggctttcctataggcaggggctatgcctgaatccacctttgtatcctctatgcccagccctgtgcccaagtcaaaacaagcatcgaattgaattgaatcaaaattgaaaatgaaaacaaatatcttggagaactagaatatagggaaacaagtgttaatgttgtaagagtctattgcagagcaatcaaccagaccatgtttccctaataccgattacaaagctggcacagaggcaagacggagcagcagtggggatttatgctctctggacatctgttgggcgtctcttctgataaatcctcgccttgccctgctgatgatctcatctttcagaagacagaggaagcgacagaggaaacggttacttgccactaaatcctggcaacgaggaaacactggttaatgagaaaagtggaatcgttaggagaaaaaaaaatgggcacataatcctagagttaatgatggtgcaagaaaggaagaaagaaaataagcacccattaaaaacctacagtgtgccgcctactttacgtgtgttactacatttaattctcacaacaaccctgggaggtgggtttcagtcacttccattcacagaaaagaaagccagaaaatggagaaagtaacttgcccaagctcataaaaggcaagtctatctgcctgcaaacccccagttctaacctcacaccaggctgctgagcaaaaaaagcaaggcattgcctgacttcaaacctagagttgatgaataaggcagcgtcaatctgtataggctaggtaatgatacagtaacaaaacacacacacacacacacacacacatatacatacacacacactgaaatccaaatcacggtcatgtgacacgatcaagctatttcttccagccttggcagctttctaggacaggcagccaccctcctttgtgtgctggctcagttctccactttgcttccacctcatgaggctccatctcaacagatgcttcagagcttgcctcattcagggggaaaaaaaaagccccggaggatctcaccccagtaattaaatgctgccacccagaagtcacatatgccacttccactcgtgtggcacaactcaaggccaaggggcagagaagtgcaattctccacccagaaggaaaacaagccagaaatggttgtgcaacgaaaattccaaccacagtagctttttgaaagatgagaaagcaagcttccatatgcagcaatgaacactggccaagcccggcctctgtgtactaccaggggagagaggagaaacatgaaaacaaaaattaatatgtagaaggcaatgatcaaaaagagagagacaaagggagtgatgttgatgggagaactgggttatggaaaaggatttcacaagaatcaccaagcacatgtggaaggtcagtgccatgaacaaggtccccggacacaacccaagaaggaaatattgtgcaaaatagattggagtgccttcgtcagttcaggctcctataacaaaataccacagcctggggcttaaacaacagaagtttctttctcggagctttggaagctggaagtccaagatcagggtgccagcatggttggttccagtgagggttcattttacggtgtgtagacagcaactttcttgctgtgtcctcacttggcagagagggagagagcaccagcctctttctcttcttatagggacactaatcccattgataagggctccacccttgtgatttaattacctcccaaaggccctacctaatatcatcccagtgagatatcatcccgttggaggttagggtttcaacacatgaatttgtgtgggggacacaaacatagctccatagaaaagagtctcagaaattgtgtctacccattcaatttttaccattcaattccattcccgggaattaggaagaagcaattaataggactaataagagctgtctggaggctcttattgacaaggctgtgagcaaaggatacaaggtgggacacaaaactgctttgaaaatggaagcaagatagcctgatagaaaaggcactgggcctttgccactgtcctctgtggctttataaagttacttaacctctctgagccttggtttgcttctatgtgcaacgggaataatatactatctgcctcaaaaggtagttgtgaggattgagaagatcctgcaggtaatatacacatcaaagtgcccagcaagatgttagaacaaggaaaacaatcataagaaggatgagcatgacaataaactctccaattggataaattcaagttggttgtctcaggaaccatctgtcttgtaactctctgacttcatttcccaccaccctattattgcctgaatttgctgcattgatcttttttgttcttttttttttttctttgagacggagtcactctgttacccaggctggagtgcagtggcacaatctcggctcactgcaagttccgcctcccgggttcacgccattctcctgcctcagcctcccgagtagctgggactacaggtgtccgccaccacgcccggctaattttttgtatttttttagtagagacagggtttcaccgtgttagccaggatggtcgtgatctcctgacctcgtgatccgcccgccttggcctcccaaagtgctggaattacaggcgtgagccaccacgcccggccgaccctttttgttcttatttgatcattccaggaatgctcataccttagtgcctaggtactgtggggttctctcttcctagaacacttctcagaaaatgagagaatgtcttgttcaagtgctattatatttactcattgaaaccttccataattacctacttgaaattatagcatccactccactcctcacactctctatcctctttccttcctgtattttcacattggtaattatcatttcctaatatacaaaatcatatacacttttttattgtctatccccccttcattagaatatattctgaaacttagatgaattctccagccaagaaaaacatctgacacatagtacgcatttatcactacgcatcgtttttgttgttgttgttagagcaaccctgcatttctctactctgatccattacattttaattttatattttagcaacagggaatgccttatttctttgtggaggtttttttattttgttgtttgttcttctgttgtttgtttttttgtttgtttgtttttgagacggactcttcctctgtcgcccaggctggagtgcagtggtacaatctcggctcattgcaagctccgcctcccaggttcagccattctcctgcctcagcctcctgagtagctgggattacaggtgcccaccaccactcctggctaattttttgtatttttagtagagatggggtttcactgtgttagccaggatggtctcgatctcctgacatcatgatctgcctgcctcggtctctcaaagtgctgggattacaggtttgagccaccgtgcccggcctagggcatgtcttatttctatatactccttctacaccttttactctggcattgcaaattcctagcaaaacatcctgaagggttcatgctgaaagggcaacctactcttcccatactatcttactgaaacttgttcttacttcagtcttggagctgcccattacatgagccttgcagtggcttggacatcaacctgtgagaagtcgccagcatccaaaatatctgagactcacagaagactcagcataagctcctgtaacgactgtatttcctcaactgcaggatcaaggtgtggctgtgaatgtcactctcatcagtactcattttgtactgcttatggtttgtttgtttgtttgtttgtttgttttcagggaaatgaggttgagatcaaaaccaggacccagctcatgtgattctgtatcataaagaatatggaagtacatgtatggagctctagtgaaatttgcttggactcagttaagatgcaatggtttgcaagtagttataacacctcaattcctgggacaacttccgattacttttagaacacagagacacaatatgggcatcatttcaatatcagatcttatttgtctgaaaataccagatcactagggcaatgaaataaacaaccagctacaaaccagctacaaattatctagagggtacagcctccattctctacaggaaaagagattcacattcttagtaccaggcccagcaataaacaccttaaatattaatgttattccatttcatatccacaataagcactacggcaaggtaaattctatcggctccattttatttttaattgcccaggctggaatgtagtagtgcaatcacaactcactgcagcctcaacctcccaggctcaagccgtcctcccacctctcagcctcccgagtagctgggatgacaggtccatgccaccacacccggctaatctttgtattttttgtagggacagggtttcaccatgttgcccagtctgctctcgaactcctgggctcaagcggtcctcccgcctcggcctcccaaagtgctaagattacaggcgtgagtcactgtgcccggaggccccatttttcaggcaaggaaattaaggctcagaaacactaatatcattgcccaacttcatgcatatagcaaaagacagggttagaagtcatagctatgtcttcctgactctagactgtgctttttccactacaagggatgaaattggggaaaataaactgctcaaatgaataaaatgctcaaataaaaaaatacaaataaataaataattttatattttagcaacagggaatgccttctttgtgggtttttttttattttgttgttgttttttttttttgagacggagtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatccaattaaccttgggactagctcacccttgatctcaatgctcatccagatggagagaagtcctctgggccaagattgggaaactgagcccccctttctcaaagctggcagctttttaaaggccaccaactccatttcacaagagatgaggagagacagatggtgaatagagtacctgcaaaaactcaaagatacacaggaccagtgtagcaacttgcacacttgcaacttgtatttccccctttttcctcccaagtagtctcagtctcccaacctgattgtcttataagccaaaacagcttttgcgcagcttgatagcctcagccttgatttttaaatgactagaaattcaggaggcaaaagagcgatagtcttagctcaaaagtcaaccggacctgggtttgaatcccagatccacagcacaacagctgcaaaaccttgagcaattagtgatatctctaagcctcggtttcttcatctctagaagggaaatacaaacatagtgtcttcctttcattaggttgtggctgtgaagtgaagaaattacaggtaaagccttcgacatggggctcagcacacagcaagtactcaataaatgttggttatttattctaaaaaggaaaaaagttagctagtctataaattttataggtcaacatcagtactgaaaatgactattcaccatactctgaatcttctcttgatccgtgcgcttgtaatttctgaattttaagcttctcttaagtccttattggggagtcccttgggatagttaatgttctcccaagactatctgcattgcaccccgcttatgttccttctagaaatataatcaggatgagcctggaaaatctcatccacatcatggttttagccatcgaatcattccctcaataaatacgtattaatcatctattgatcaccaattactgtgctctgtacacagagctgggcactgcatatccagctcatctccactttggtggccaagatactggaaactcaaactgtccaaagcttgatgccatgggctaaactgtatctctaaaaattcatatgttgaagcactaacacattggagaatgtgatggtatttggagacggggcttttgggaggtacacaggtttaagattaggccatcaggatgatccttatgacgggattagtacccttgtaagaaggcactagacagcttgctcactctctcttgaccaagtgaggacagaggagaaaactatcatctgcaatccaggaagagcccctccccaagaaccgaatcagcaggcaccatgatctcagacttcccagtctctagatctgtgagaaataaatgcttgctgtttaagccatttgatccatggtattttgttaaagcagccagaactaaaacacttggtttccaacttcatcttaaaacatgcttctcccctgtctcctttcttggttacaggctccactgaccaacccaaactgaaatcatttgagactttccctccctcactctcatatccagtcagtccccaactcttatttgtgggttctagatttgaaaaaaaaataaaaataagaagctcttccatctttataaacagagctttttctccattcatgactgatttctactcatcctcagggctcatggtgtctcctctaaatcctccagcagtcttcaaggcggtcttattactttcactcttccctagtagagtccctgccgaaaagccattttctgaaacacaatcctgaatctgccccttttctgcttaaaaaccttcaagaattcacaaaacctccaggatatagtctctgctcctcagctgggaaatcctaccataactgagccctggcccccgcccagccatttctcaacaagcccccttcactttagattcctcagcctaattgcaacatccccaaatggtccaggtgctttcaaacctccacgcctttgcaggtgctgttccttctgctccaaccccctctccattccttgactgctgatcctatactttatcctcatctttcataggttcaaatccccccatgggccattactgagcccccttcccaggctgtataaggctactactttcctctctgttccaatatattcccactataataaatatgacacagtctattgtaacttgttctttccctctttctctgtccctcctccgcataaccagatggtcactcctttgagaatagagagatcctgtcttatttattttcaatgccatgcaggttttaaggataaaaatcaagaaaaaataaagttttggcaactgtgctaaagccagagatttctgaaaatgactgtttaatgcataccatggggataattataacgataataacaatatcaactattttaagtgctaaatatgactaaacattttataggcatagctcatttaatccttttaaccaccccaggaagaagtattatttttgctctcttgttttttggatggggtaaatgaagcacagatctctctttctctctctctctctctctctctcacaaacaaacacacacacacacacacacacacacacacaatgggtttgggattcagaaaggcacagttcctaaactggctctgtcatttatcatctatgtgacctgaaggcaattcacttaatctccatttgtttcctcatctctggaataagaaaagacttgttgtggtaatttaaaaagactatttacaaaagtattgaaccaggagcagtggcatgcacttgtagtcccagctactctggaggctaaggcaggaggattgcctgagcccaggagtttgaatcctgcctgagcaacatcatgaaactgtctcataaaaaaaataaagtttaaaaaaacaaaattaaattgacacatagtaggtactcagtgatattgtctctttctccaaacacttacccagacctgtatgcttcaggaatagtattaatgtcttaaaccgggtaactagtctgctgactggctgagattcaggcatgtcagtatcgcttggctccagcttacctaatagactagctctgagtctgtctccatccatgtctcccacccacacaactctagcctcatggataaggtgaggctcagggagtgtgacctgggacgaggttagaatgagcatgactgccatgcagtttgcttgataacttcgaaaaagctgaaagcttagcagtttggttttgaggttgtgatgcaaacgtgtaagtgttcgatgtgtatttctgtcaaccacacctgaaaggccgtgtgcaacaccacgtgcccaggtgcggaagctcagagacttgacgtaggcgggaatttgccgtgatagcatttaagcagccatctgttttccaggagattctggagccaccttccccatcaagcccccctttcccgtcctcacgcacccccagctcctcactcaggaatacattgacatttccagatgtattgattacaggggcagactagcttttggcgggagaagggagagaaatggattgactttattatttgtgggtggaaaaaaagaataaacaagggtgcttttgtttgaaggacaaaaccaaaattatcggttgaatggggctgaattaagcacttaaagttcaatccttccagagtgctgacagtgcacaggcggagatcaatacagaaactatttgggccgtggggaacctgggccctgcttattaaccgctaattataccaagttttctgccgaaatgggttagttcccttgaagattacgatacaacagaactggttggcactgtcggacccgggtctgggatccaacccctggagcaggaagtccaaggttcaggataaactcccaaaggccttctatttatggagcccacttcccaatttgccacttgcaaatcagggtgtagacagcccaccactttcttattagaattttaaaataagactgccaacggcaagacggatatttcactagggctttcagtacggccacaccagttgttcaaaacagggacactctcccacgccagtcgctcagcaacctcccctgctacctcacatgcccctcactctcattatccaggcttaacacctggccgagcaagggcctgcggggcccgctccagcatccactctggtgaatctgtgctcatgccctcccggtgctcaaacattttgagcacgaccctgaccacaggcaacaactttccataatccgttagtcaccagccagtctacaaacccagatgccttcccgtggggagggggatattgattgtacatacacaatgtcacacacacacacacacacacacacacacacacacacactatataaatacacaactgcatgtatatgtatgtagttatgtatatatacagttatatataaccatataaaatatggaaaatttatatttcatattatattccattaactatatattaaatatgtatatatactatatatagttttatacacttaatatttaacgtactaaacatttaggactaaaactaaatatgtactatatgtatgtaactatagttacatatagtacatatttagtactaaatatactatatatactaagtatttacatatctagtatacataaatactatatataccatatatatttatatataataatatataaatattgatataattacatataatatatatttggcactaaatatactatatatgtatagatagtatgtgtatatataatatatactatatatgtgtgtatatacgatatactatatataatactatatatactatagatactgtatttagtatatactaaatttactaaatatatattcagtatatactaaatttactaaatacatatttagtatatttagtatacataaatatttatagttacatatagtacatatttagtactaaatatatactatatttatatatttagtaaatatataaatgaacatgtactatatgtaaacacatgtaaatatataaatgtatatattaaatatataaatatatagttacatatagtacatagtatatatgtagttatatagagtatatatagactataaactataactatatatatatatatgaactatacacagccatccctcggtatacacaggggactggttccaggacccccaggtgtaccaaaatctgtgcctacccgagacctgcagtcaaccttgcagaactcaaggacaggaaaagtaacccttcatctacacaggggttttgaagcagttcacatctgtattgttcaagagtcaaatatagatagatagataggtagatagacagacagatagatagatagatacacacacgtatatagatgcacacacatagtttatgtaaagttggtgtgcttgggagatatttccatgttgccacttatcaatttatcttatctttttaacagctacatggcgcccagtagtacggatataccataatttagccactccctagttgatgaatatttaggttatcccacattttctctatcacaaaacatactgcaatgaacaccttgaacatatattattctgcacatatatgaatatttccataggatggattccaagaagtggaattgttgcgtgtttttaattttggcagatcttgacaaaccattcctactttctctcatacaaaaatgatggtgacatgtgcccccatttatctggatggtttgcaggaatgagccccctcaaagtggtctctggtcaacacaatgggtctctgtgatgtacccacctgcatttagcaatcagagttcacagagcactttccagtctgcttggcacacattcgttcacaaagaagctgagggaagcttcattgctgcttctaaaaagcagattattccagatccccgcaaagcttccagtctgttgagctacctgaaaatgacaagcagcaacttccctgcagagacctggagtcagagtttggccatcaattgccacccagaccttgaagccactctgcttgtctctagggcaatgtgaactcctggccatcatgccttgcttaggatgtcaccaagtgtcccctgaaaaacagctgtcagtctgtccctctaatcataggacctcaaacccagcacagagagccaaatagaaagcagatcctattccattccctttatctccctgtttccattaaaaataaaagcctcggagcatgcaagcaggcagaggagagggaagtattgtccacagtcaaagcatctcgacctccagatcagtcagccagaatgtcctgctacacaagcatttttattcgttccaggatgttcttgaggcagcttccaaaaatgcacataacataacaaaattggaaagtgcaattaacagacaaagtgagaaaaatgaaaaatatatatgagacaagatataaagacccaacctaaatgcctaccaatgatagactggattaaaaaaaaaaagtgttatatatacaccatggaatactgtgcagccattaagaaagaacgagctcacatcctttgtggggacatagatggagctggagaccactgtccttagcaaactaacacaggaacagaaaaccaaatactgcatgttctcacttagaagcgggagctaaacgatgagaatacatagaggggaacaacacacactggggcctatcaaagggtggagggtgggaggaggaagactcaggaaaaataactaatgggtactaggtttaacacctggatgatgaaataatctgaacaacaaacccccatgacacaagtttacctatggaacaaaccttcacatgtactcctgaactaaaaataaaagttaaaaacaaaaaaagaagaagaagaaagaaagaaagaccgaggagaaagaaacctatatgaggcattaagctctgcacaatttttaggcatttggactccaacaacagcaacaaaaaaaggcggatagagggttcgggagatggaattacatttagtgtctatatctacaatgtgcatgaaaataattcccacattttgactttaatcacagaggctgggcatggtggcttacgcctgtaatcccaacactttgggaggctgaggcgggtgaatcacctgaggtcaggagtttgagaccagcctgaccaacatgatgaaaccctgtctctactaaattaaaaaaaattagccaggcatggtggtgcatgcctgtaatcccagctacttgggagactgtggcaggagaatcgcttgaacctgggaagcagaggttgcagtgagctgagatcgcaccactgcactccagcctgggcaacaagagtgagactctgtcttaaaaaaaaaaaaaaaaaaaaatcacagagtggaaaataggaaataaagatggcacaactttcaatttctcagaatgggtctgtttctcatttgaacagcataaaatccagccaggcctcctctccaaccagcaggccaagactcttccaaactgacctgacaccccgccatacccaatcttggcaccccacccacttccccctcctcagggtgctgcccaaaccagacaaaaagcaggcgccaagatgctcccacaggactaaggctcatagtgaccttcttaaaaaaaacaaaaaaaaaacttagttggcaactgttaaacattgggaaattgtacataaaaaatcctgatctctcactttttaaaaaaacaagtggaaaagaaaaataggcaacataacatctccccatagctggagctggggccgccttggaggagaaaaggtacctcccattttgtgcacgcagcccactttcctgactcatgcccatgcaaaccccagctaggcaacaaatacttaaattttttgtttttattattatttttttttagtagaaacggggtttcgccatattagccaggctgatctcgaactcctcgcctcaaaccatcctcccacgtaggcttccaaaagtgctgggatgacaggcgtgagccaccacccctggcctaacttttcaatttttttaacagagagaaaacttaacggggtgagtaaaatggcaccaaaagacctgaacttggacccatgacttggccgtccattttctgaatccaccaaatgaggggtccgacactgaatgacgattctttgcacctctgacaatgttctttcttttgactgacggaggtcccactttccagggtaggggattttgctggtatctacgaaccatgccaacttggcttaaacggtcaagaaagaggggggtctccataatggggccatttcactctaatttcttcttgaaatgcttacccgactggtcccctccctcgccccttacctatccctttcctctctagggttttgctaggatgttagccggatgtaaggtacacggacgaactgcaagcttagaggtagtgattggctttgcaagcagaaacaaaaacaaaacaatgaccaaaaaaaacccctcaaaaccaacaaaataaaacaaagcacctcttcctttccttaaaatacattttgcgttaaaccagtagcctaccaaaggcagcctggagccttaagtgtgttctggaagctgagccttgagcgccatctgggagcagagggcggcactgcagcctcccgccctggagcttcgcctccaggtccttgcagactttccccttcatgatccatctcttctcccgttgccccaaggtctcagaagaggggatgtgctacaatggggagttatgggttttgcaatcagaccctgacacttcactagctgtggggtcttgggcaattcattgcctttctgcaacatgaggacaatcacacccaccttactgggagactggaagattaaaaaagaaaaatgacataaacgggcttatagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggcgggttcagaaacagcagagaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcttcctgaggtcggctcgatcccaacttcatgtctgtcccatccgccctcttcaattccactctcctctctccagttatgacccctggatgcctgaagaagccttctaactgtgctctccactgttcagctctgctccctccaatctgccctgcatgagcccctgagggatctcaccctttcagcaggtccacctacaagtataacccctctaggtgacataccttccttcgggaagcttctcccagcaaccactgacccacaagaatctctgctttcctcaaacacaagtagacttcgcaactctgcctacctgttagaataacctgaagaagcttcataccacactgttcaccaacaagcacacaaaaagatgctcgatgtcattagccatcagggaaatgcaaattcaatcaacaatgagagaccactccacacccacaaggatagctataattaaaaagacgaacaacgacaagtattgacgaaaatatggagaaattggaaccttataataccgctggtagaaatgtaaaatggtacagtcacttgggaaacaaggctggcagttagttcctcaaagggttaaacagagttatcatatgacccagcaactccactcctaggtatatatatgtaagagaattgatagtttctgtatccacacaaaaaacttatatacaaatgttcataatagcagtattcatggatatccaaaaagtggaaaccaccgaagtgtccatcaactgatgaatggatgaacaaaatgtggtctaggaatgatgtgctgatccacactgcaacacagatgggtctttaaaagctatgtaagtgaaagaagccagtcacaaagaaacatatgttatttcattccatttatatgaaatgtccagactaggcaaatccatagacacgtaaagtagattaatggttgccaggggttgggggaggggaaatgggaggaaatggggagtttctggtagtgactacagggtttcttttcgaggaaatgaaaatgttcggactgtaggctgagtgtggtggctcatgcctgtaatctcagcactttgggaggcttaggtgggagggtcacttgagctcaggagttcaagaccagcctgggcaatgtagctagatcccatttctacaaacaaaattttttttaattagctgggtgtgatggtgcatgcctgtggtcccaactactcaggaggctgaggcaggaggatcctttgagcctaggaatttgaagcggcagtgagccatgatctcatcactgcactccagcctgggtgacaatgtgagaccctgtctctaaaaaataaaaaaagtcgattgtggtgatggttgcacaattctgtgaatatacgacaaactattaaattgtgtactttaaatgggtgaattgtatggaatgtgaattatgtatctgaataaaacttatatttttaaaaaaataaacctcccattcctatcacttcctcattgttcaatatggcttcatatatttcttcataaataaatatactgatttaatacgtgtttattcgcttattgtctaccacaacagtaaaggtaatttcaatgagagcagagcctgtggcgcgttcacttctatattcccagtgctttgagcatggcacaaaaggctactgaataagtaagtgccagtgtgtgaatatatgagtacctgtaagaatcagcaaaaataaaatactgtttccagggccccacccccagagattcagacgcaattgatctgagggagagcctgacaaaggtctggctcaagactcctcgagtgataccattgtacaaaccaagacgaagagccctgatccacagcagctgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccagaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacacgctgaaggtagggatctacagagtcacattcatgcaaggtctgtggcacaaggcctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctcctacagttgcacttaaccagggatgattgtgcttttcaagggacatgtggcaattctggggattttaattgtcatattgggggggtcactactgccacctactgggtagaggctaggaatgcttaaacatcctacaatgcgcaagacagcccccaccgcccccaacaagaactatctggcccaaaatatcagtgtaactgaacttgaaaaactctgctatagtctattgtcatgtgagttcctcgaaggcagggaatgtgtaacactcacctgcataacctcagataccacatacagagcctgacacaccgtatttggtaaatactagtggaatgaattatccgtaccttacatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccctttctttctttgttttttttttctttttgagatggagtctcactctcttgcccaggctggagtgcagtggcgcaatctcggctcactgcaacctccacctccctggttcaagtgattctcctgcctcagcctcccaagtagctgggaccacaggcgtgtgccaccacgcccggctaatttttatatttttagtagagaaggggtttcaccatgttggtcaggctagtcttgaactcctgagctcaaatgatccacccgcctcagcttcccaaagtgctgggattacaggcatgaaccaccacacccatctggacaaccctttcaacagcaccaatacaccaggagtctttcacaactagttgttataacttcctctgagttcttttcctcttccagaactcattctctttctctttcccatgtaatttgatagtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcattcaacttaacccacagacctgtagcctacagcagaaccacacagctgagcccagcctagctcagcacaccccctgctgacctgcagttgcataagcaagcccagctgggttcagccaccccccagtcgcagatgcatgagctaaatatatgttcactgttgcatgccacagagtttggggaagattcactatgccccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatccgatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgttgtattagttcttgcactgctatgaagaaatatctgaagctgggaaatttacaaagaaaagaggtttaataggctcatgattccgcaggctgtacaggaagcatggctggggaggtctcaggaaacttacaatcatggcagaaggcagaggagaagcaggcatgtcttacatcaccagagcagaaggaagagagagaagaggaaggtgctacacacttttaaacaaccagatctcatgagaactcactcactatcacaagaacagcaagggagaaatctgcccccatgatccaatcacctcccacctggcccctttttcaacactgggaattacaattcgacatgagatttaggcagggacacaaatccaaaccatgtcaggagtgaaccatggagtcaagcagtcctggtttctatcacagctctgccacttatatgctgtgtgaccttgggaaagcacttagcctctctgagcctcggttgttctaactatacaatggacataatatttacctactttaagactgttcttaggactgagaaaggtaaggtctataaagtacttagcacagcccctgacacgtagttggtgcttaattaatgctcttatcacttgattttgaattcagagagtagacccatcacagcagagctacagtggggtggaaaggggaggtaacggaggtaacaggacccactatgagcacctactgtgtgctagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatcacacatccccagtttgccctgcatgatcccaatttatacctgttgtcttaacatatctattaataacttctcattccctttcatactcagaacagtccaaatctgagcaacaaattatatggtcacctgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagaggaagccagagatacagatgagaggctatccaaggagccactaaatgaggggcttggggccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacacaaagagaggaatgggagatgcataaagagctaaacatgcccttcgcacgcacctcttcaggtccctgccatggggaagagagataacgtttgtttgtttgtttgtttgtttgttttttagatgcagtttcgttctttttgcccaggctggagtgcaatggcccgatctgggctcactgcaacctctgcctcctaggttcaagtgattctcctgcctcagcctcccaagtagctgggattacaggtgcccgccaccacgcccagctgattttgtatttttagtagagacggggtttcactatgttggccaggctggtcttgaactcctgacctcagatgatccgcctgcctcagcctcccaaaatgctggaattacaagcatgagccaccgcatctggccagaagtgaacttttcattggatctgaaattggagatttaagtcagactgaactaagttttttaatagctgaaagtggccagaaagttaagggacctagcacccactggggtagaaagactgaacatacaactgataataatatttaagaaaaaaaacaaaactagttcatgcttgtaccccatggagttgaaacttctccccaaactaattactgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttatattccctgtaagggcagaaattcagctcatgtaaacctcacagcaatccttatgcccatctaacagagatggaaatggagactcaaagaggtaaagaaactcacccaaagaaccccagctaaaacatttagcagagtagggatttgaacccaggcctgtccacctgcacatcccttgcttgtttgccttattgagctgtctcctcaatttcatcttcaccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaagcctcaactgtagaatctcttgattatcaccaagtatatgggcttccaagcctacctaccttcaaagtcaaggtcatcacaaagggataatccctcaggcaaaaagaaagatgagttttaggggtcccctggtttccatagaaaaggcactccaggccaggtgccatgactcacgcctatagtcgcagcactttgggaggctgagtcaggaggatggtttgaacctgggagttcgagaccagtgtgggcaatatggtgagatcccatctctgcaaataatacaaaacaaaactcgtaagcatagtggcacacacctgtaatctcagctattcaggagactgaggtgggaggataacttgagccaggaaagttgaggctgcagtgaactgagatcacgccatggcactccagcctgggcagagtgagaccctatctcaaaagaaaaagaaaaaagaaagaaagaaaaagaaaaggcactccagttccattctattctttatggaactattcataatttacagattaatgtcacttttctccctcccaccctcatctttctccctaagaaaaccacgactgatttgttgcagtattataacacccaatgagtagaaacaacccaaatgtccatcaataggggaatggttgaataaagcatgatatagccacccagcagagtactatgaaacatactaaaagaatgagaaggacctctatatccccagtatggaggagtttccagttcattcaaatgaaattagcaaggtttcagaaaagagtatgttgttttgtataaggaagtgaaagggattagaatatatatttgcttatattagcgaaataaaataataaaaggctaaaaccacaaaaaaaaaagtttcctttggtggagagagaagaagaagggtaataggaatgaaaatgggacctctctaaggctgagaagaggggagaaccaagaaagaggagtgtgggagtgctttgttctgccaggtgcagtcaataggtgccttgtctgtagagaatttaaaaaacagtaatacaatcaactattaaatgcaattggtatctaaatcaaattttggatccaggaaaaaaggacattggtggaaaaactgatgaaatttgagtaaagtctatagttaatagcattatattaatattaatttcttttgacaaatgtaccatggtgatgtaagatgctaacattagggggaactggatgaagggtaactacaagaattatctgtgctatttttgcaacttctgcaaatctaaaattattccaaaacaacgtggtgatttctaaaaatatatgaatttcatacacgagtattatgacatgaacaaaaagcaattaaaggtcatccatttttattattactggcaattctaaacaatattggtgatagaactctcccactcctccaaccagggcaactaaccactctgtacctactctgaggatggcttttttatttagttattagtttgggacattgttaatgttctgtaaagacaaatataaaacaaaatttgaaaacaaaaacagaaagagccacaatattgggcatgaataatccaaatctgagcactgtcaccacgtgctcctctcaaattcagggttttaattttttattctttattacagacaggatctccctatgttgcccagcctagccttgaactcctgagttcaaatgatcctcctgtctcggcctcccaaagtgctgagattacaggcatgaaccaccaggcctggcctcaagttcaggtttgagcagctctcaccaaaatcccactgcagtaaaattcgcagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctccccatataaaccccctagaaagaagtcattgctgcctcaaatgcatgtattcagctgcaaggcttctattgctacatgctttctgattatagccaccatttctaagccctgcaggtgtttgcccatcttggatcctttgaaacagctccttcccctgccccatttgcttccagatatctgcacggctcagcccctccatttatttgggcgtttgctcaaagccaccttttcagagaggccttcactcaccaccctattgaaacggggtcacacctcccatctctctccattctctatacctactttatctccttaatgctcactacctcttaacatttattcatgtgttgacttgtcttccctctctgaaagctccataaaagcagggtctgttgcatctccagagcctactattttttttcggtgtaaacagtaggtggctcacgcctgtaatcccagcactttgggaggccgaggtgggcagatcacgaggtcaggagattgagacgatcttggctaacacggtgaaaccccatctctactaaaaaaatacaaaaaaattagccgggcacgggggcgggcgcctgtagtcccagctactcgggaggctgaggcaggagcatggtgtgaactctggaggcggagcatgcagtgagccgagatggcgccactgcacaccaggctgggtgacagagcgagacttcgtttcaaaaaataataataataataaagaattccaaaatcaagtacaaaatcaaaaggcagattttcaaacaaaatctttgaaaagtggttctggccgggcacagtggctcacgactataatcccagcactttcggaggccaaagcgggcggatcacgaggtcaggagatggagaccaccctggctaacacggtgaaaccccgtctctagtaaaaatacaaaaaaaaaaaaaaaaaaaaaaaatcagcggggcgtggtggcgggcgcctgtagtcccaggtactcgggaggctgaggcaggagaatggcgtgaccccgggaggcggagcttgcagtgagccgagatggtgccactgcactccagcctgggcgacagagcgagactccatctcaaaaaaatatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcttgctatgctgcctggggtaactgcacaaggccccataattagacgaccccactgtgatgctggcattttgaaattcctataatttttttttttttttttttttttgagacaaggtctttctctgtcacccaggctacaatgcagtggcatgaggctcactgcagcctcaacctcctaggctcaagcggtcctcctgccttagcctcccgagtaactaggaccacagatgtataccaccattcccggctgatttatttatttattttttttaattaattaatttatttttttttgtagagatgcagttttgccatgttgcccaggctggtctcaaactcctggactcaaagcaactccccagcctcagcctccgaaagtattgggattacaggtgtgagcccctgcacccagccagaattcctataattttcataacaagaatcaccacattttcgttttgtgctgggccctgaaaactatgcagccagttctgcccaagatgcttattttatttcattttcccagctttacaggggtaaaattgacaaataaaaatggaatacatttacagtgtacaatgtgatctttggagatatatgtatacacaaattgtgaaatgatcaccatgaaccagctaattaccctattcattacctcccatagttgtctttggatgtttatgtgatgagaacacctaagatctggtctcttagtgaaaggatggtgattaccagaggctgggaagggtagtgggctggggaatgtagggatggttaatgggtacaagaaaaatagttacaaagaatgagtaacacttactacttggtcaggtgtggtggctcacacctgtaagcccagctctttaggaggccaaggcggacagatcacttaaggccaggatttcaagactagccgggcaacatggcaataccccatctctactaaaaatacaaaaaatagccaggcattgtggggcacacctgtagtcccagctactcaggaggctgaagtgggaggatcacttgagcccaggaagtcgaggctgcagtgagctgtcatcatgccactgcactctagcctgggtaacagaaatgagatcttcactccaaaaaaaaaaaaaaaaagacctactacttgatagcacaacagagtgactatagtcaataatttaattgcacttttttttttttttttgagacagagccttgctctgtcaccaggctggagtacagtggcgcgatctgggctcactgcaacctctgcctcctgggttcaagcaattctcctgcctcagcctcccgagtagctgggactacaggcatatgccaccatgcctggctcattttttgtatttttagtagagacggggtttcatcatgttggccaggatggtctcaaactctagacctcgtgatccacctgcttcggcctcccaaagtgtggggattacaggcgtgagccaccacgcctggcctaattgtacattttaaaataactgaaagagtgtatttggattgcttgtaacacaaaggataaatatttgagggtatagataccccattcttcatgatgtgattattacacaccacatacctgtatcagaacatctcatgtacccataaatatatacatttattatatacccacaaaaagtaaaaaaaaaaatttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttcaacgtttttaaattccacaaataagtgagatcacacagcatttgtctttctctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaatagaggaggagagatttctctctaaaaatgtaagggattccaattaaaaatcacctctcattgtacatgcagaaaatgtacagtgagacacaaagttgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacattaccagttagattttccaagcacagttcatactgcagaattcacctaacttgatttaggtttctcctttataatcagtttccacttgaacttcaactaccacgaaaaagtaagtaagtaaagcaaagacgtaaattcttgggaactttgttatgagaggaactttctagactgcacttagttgtcttatttaattagctaccagggaaacaaaacatatagtatgtccaaggagttgactcaatggaatgctgtcatgctaaacagatctaacgtcatgctgggtgagacacacagtctattttagaaagccaaacagggccggatgcgatagctcatgcctgtaatccccagcactttgggaggcctaggcgagtagattacctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgccagaagtttattccaagcctctgacagtaggagtcctgaaatccacctggtggatgaaggaggaaacaaaatttagaggacttggcagaatcacagaatgtggggagatgtttccaaaggggacctcatctcatgctgcaaacgttttgtctggagaataccaaaaaaaaaaaaaaaaaaaaaagttttgtctgtgtcttgtgtcttgggttgttttgttgttgttgttttttaacgtcatcaatgaggcgttccttgttctgctgaggccctagaagcattcaggaaaggaaatgcagaggtgggaactggagagaaataatgtgctcaataaaaggagtaaggttttggagccagacaagaaaaaaaatgagaagcagagctggggaaagaatagagggttctagaagcctgaatgtgccagaaaatcatcccctccagaatcccccagtcttcagtgaagccctatgaactcactagctgagtaggtttcctgcaggcaatgggagacgcaaagttctgcacttaagctcctgtaggggaaaaagcagagccagcgtgggttggggccaccagggccagaggcagatacgaccttgagaaggtcgccctccccagattagcaggaagtagcctgcatagaagatcttacctagatctttgaggattcaggggaccccagctgacatgtcggttattctacttaattataaaatgtttgagcagggcacagtgactcacacctgtaatcccaagcactttgagaggcggggataggaggaatgcttcagcccaagagtttgagaccagcctgggcaacacagtgagactctgtctctacacactttatttttttttgttttttttttttgtttgttttttaaattagccaggtaggatgctacaggcctgtggttccagctacatgggaggctgaagtgggaggatcacttgagcacaggattttgaggctgcagtgagctatgactgtgccactgtactccagcctgggcaacagagtgagaccctgtctcacaaaataaaaataaaggccaggtgcgattgctcacacctgtaatcccagcactttgggaggctgaagtgggtggatcacttgagatcaggagttcaaaaccagcctggccaacatggtgaaaccccatctctataaaaatgcaaaaaattagccggcatgatggcaggtccctgtaatcccagctacttgggaggctgaggagggaaaatcacttgaacctgggaggcggaggttgcagggagccgagatcattccattgcactccagcctgggtgacagagtgagattccatctcaaaaaaaataaaaataaaaatgtttggccatttccaaccttgccttcagactatgggttcctggaggacaggtgcacttctcagccatctctggatgcactgatgtggccatctctgttagtgtactggtatggaccagtagggtccatacttgcacaaatcccaacaatcggtatttacatctctttgcttggccagggcccacaatgcctgtgcacaggacaggtcggaagtcctggagaattaacatacctcctgcattaggtcttcaccagtgactaacaggagggacgtataaatatcccagctccttcactcctccagggggtgattctgagctacatgctcaacactagggttggcaaacttcttgaaaaagggtcatatagtaaatattttatgttttgcaggtcatattgtctctcacagatgctcaactctgctgctgttgtataaaagctgccatgggctatacataaatgaaagggtgtgactgtattccaggaacattttattgaaataacaggtggcagaacaggtttgccatgggccaatagtttgcaaatccctgctctgtgtcattttccagagttccccagagagattaaactgtgattccccacactggtaactgacatgataatgcatctttcttgccacttccctcccttgcctgtcccctttcccccacctcctcaagcttaataaactattggcactcaaatccttgcctcagagtctacttcagtgagcatccaaactaaaacagttgattaggactttttttgtttttttgcaagagatggagtctcgccctgtcacccaggctagagtgcagtggcgggatcttagttcactgcaacctccgcttcccaggttcaagcgattctcctgcctcagcctcctgagtagctgggattacaggtacgtgtcaccacgcctagctaattttttatttttagtagagacagggtttcactatatgttggccaagctagtctcaaactcctgacctcaggtgatccgcctgtatcagcctcccaaaatgctgggattacaggcgtgagccactgtgcccagcctgataaggatacttttgactgcaagcaacacagagttgaactacaggtgatttaaatattaattttgcaccaacctataatccagatttattgtatctcccacacaaaatccaggcgtaggtggtccagacaggttaattcaataatgtcatggctttgcggtttttctgatccttactagctcactactgagaaccaggtcatgtgcccaaggctaaaccagtcagcagtgagagaaacaagatgagcatgcctggcttgggccaactgagttccatgcctaagagcatgaggaaggaaggggctccatttctctgggcatattgccaactgatgcatgaatgaaaatgggatggtctcagcaaagaagaagagaaaagggttgctgggcaggtaaccaatacatacccagcagctggtgcttagaaaatgctgctgcagtctatgaatgcatgagccactggatgtaaacaatggatagcaactttctagaagaaagataaagttgaaggagtcatcctggacacacaagagtggtgcaaaataagcactgagtggccaggatgctcaggggaaatctcagaggctttagggagcatggttacctaactcagaaccatcagtgccaactaaggaagacacaaggtacattggttaaagtcaaggacaatcatgttcttcccctagttaataacagacacggcattttacagttcataaagctcttgtccattcattagtctcaccattcagtcaatgaaataaacccaggtaataatcaggtcaggtattattcttttaaaataattttatccccatttactgtgaaaaaaacttcttgagacagcttgcaataaaaggtacacccaaagggaaaccaaaagaaaaattatttatttatcaaatacataagaaaactcatttaatatggttattttgattgcatgtgctcttgggttttagctccctaatagccagagcaaaagaaaaagaaaacataaaggacacatgaatatcatcatttaacaaagggaagtatagctgttcacaggaaaggaaatgatttttcttagaatagaattcaaaaaaaattccacttggatccttacataaggcaaatgtaactaaatgatggataatgtctcccatgatggttttgcagaagatatgagaatgtcctcattcatcatgacatttgaagtagtccattctcacactgctaataaagacatacctgaaactgggtaatttataaagaaaaagaggtggactcacaaatggactcacaattccacatgtctagggaggcctcacaatcacggcagaaggcaaaggagtagcaaagtcacatcttacatggcagcaggcaagagagggcttattatttttagtagagacacggtttcacaatatgttgggcaggctgacaactggccaagaatagcatggaaaagaccccccatcttgattcaattacctcccactgggtccctcccatgacacatgggaattatgggagctacaattcaagttgagatttgggtggggacacagacaaaccatatcaatatccctacccatcagcttttcatacaaagccaaaggtttctccctgtggatggtatcatagcactgatacccataagcctcacttccattccacattgtcctggatatcctagctagtgcagttagacaggggggaaatgtccagaaaggaagaaatgaaacagtcatcattcctaggtgacttgatcgtatacataaaaatccaaggaaaattgttatggactgaatgtctttgtctttctccaccaaatccacacgttgaagccctagcccccagtgcaatggcatttggaggaggtaatttgggttagacgaggtcatgagggtattacccccatgatgggcctagtgtctttccccagaaaaacaatatcctttaccatatcccgaaaattataacaataccagttttaagtacttactatgcatgcaccaagtgtttacaggttttgatttactcattgaaacctcacagcagcctataaacccagctagtatgtggcagagttgagacgcaaacagaaaagcagtactccagatccccttggatccttacataagggaaatgtaaccaaatgatggataatgtcttccatgatggttttgtggaagatatgagaatgtcctcattcatcataatatttgtattagtccattctcacactgctaataaagacatgcctgagactgggtaatttgtaaagaaaaagaagtttaatggattcaagttccacatgttgtcatatgccacacttcttagggatgaatgaacatcaccatgatgccacacttcctagggatgaatcaacgtcagaattttttttttttttaagttctgggatacaagtgcagaatgtgtaggtttcttacgtaggtatacatgtgtcatggtggtttgctgcacctatcaacccatcatctgggttttaagcaccacaagcattagctatttgtcctaatgctctcccacccctcaccccccactctccaactgtccccagtgtgtgtcgtttccctccgtgtgtccatgtgttctcatttgaacatcagagcttaaagaagcattcctgctttcttctctcccagctgggctgggcttcaggtgcctcctatatgcttcctccatatcacctccacccttgcttgtcattgtctgggtttgtattcatttcctgagacttttgtaacaatgatctcaaactaaatggcttcaaacaacaggaatttcttctctcccaggtctggaggtcagaagactgaaatcggttgcaataaactgaaatcaaggtgtcagtagggctcgttccctatagaagtgctaggggacagtctgttccttgcctcttccagcttctggtggctgccagcattaccttgcttggagtggcatcaccccaatctctgcctccatctggatatatcaccttcttgtcttctgggtgtaatatctctccacctttctcttataagacacttgcaatcaaatttagggcccacctagataatccagaataatctccccatgtcaacatccttaatttaatcatacctgcaaagactccttttccttataatttaacatatacaggttccgcggactagaacctgctatctttgagtggccatgattcagcctactataggtttcatcactatctctttatcaactctgaagtccttgacagcagagaccacctgtggccattttcaaatggctgtacatttttacatcaaagcaatcccttagggccaggcacggtggctcacatcagtaatctcagcaatttgggaggccaaggcaggcagatcacctgaggtcaggagttccagacccacctggccaacacagtgaaaccccgtctccactaaaaatacaaaaattagctgatgtggtggtgggcgcctgtagtcccagctgctcgggaggctgaggcacgagaatcacttgaatccaggaggcggaggttgcagtcagccgaggtcacaccactgcactccagcctgggtgacagaggcagactccgtctcaaaaaaaatacaaaaaacaaacaaacaaaaacacacaacaatctcttgggatctacaccctctcccttgactttaatgacctccatgattgctttgacgtattgaatatggtggaaatcatactgtgcccttttccagtccatgttttaaaagactatcaagcgctacttcctatatcttggaatactcacttttggaactcagacaccactatgctacgagaagcccaaaccacatagaaaggccacatgaaagtgctccaggcgacagcaccaactgagctcctaaccagtagccaatatcatgccagccatgtgtctcagccatcttggatggccagcctagtcaagccttcagatgactccagccccagtcattatctgactacaactgcataggacttgaaatgagaaccacgtaggtgagcccaatcaacacagagtcatgagcaataataccaaatatttgtttccagccactgtgggatcaggctcttttttatgcagcaagagattatctgaacatcatatttgttgctgcataccaggtgcctggaactatgcctggaggtcttgatattcaatgaaagtggaataaatcaaataaataaaaatggaataaataaacaaaactctagaagctatggattctagggagttgagctggagatcaggaggaatggatattaggtctcaaagaaatgacaaggtaataaggtagaagaagaaggctgtggataaacaaattttctggagccttaatggtggtgagaagtgggcaagttcaatgttgagcaggaccaaattcaacagaccctcagcaaatgtttgctgacttagcagtacacagattctgcacacatcttccttccttttaaccattcctttaattgtataagcaatatattgagtatctactgagagccaggctttgagttgggtgaagactattcagcagttaagtccctttaacgcttatacactgttgatgggaatgtatattagtccagtcactggaaagcagtttggagatttctcaagtaacttaaaatagaactaaggttgaatccagcaatcccattcatgggtataaatcccaaaagaataatcattctaccttaaagatgcatgcacacatatgttcattgcagcactatttacaatagcaaagacacgaatcaacctagatgcccatcaattgcagactagataaagaaagtatggtacatatacaccatggaatatactatgcagccataaaaaagaatgaaatcatgacctttgcagcaacatggatggagctggatgccattatcttaagcaaattaacacaggaaaagaaaaccaaatattgcacattctcacttaggaggtaaacactgacttcacatgaacacaaagaagggaacaatagacactgggtcctacttgaaggtagaggatgggaggagggtgaggattgaaaaactacttaccaggtactacattcattacctgggtgatgaaataatctggacaccaagccccataacatgcaatttatccatgaaacaaatctgcgcacgtaccccccaaacctaaaataaaagttggaaagaaaataaaaatgaaaaacaagtccctttcttatggaacttaacaaccatagagtatttggggaaacctcaaaaccacaggcaggtggttcaagcccccatctctgaccttcattaccctgctgtatagccatgattacaaaaaaaaaaaaaaaagccagaccattcaatgctattgcttctctcttccaaatgggatgaagtgcaggcagtaaacaaaggaagatgaacttggccaagtccttctattcattttgtggcagtgatgacaatttcccattgtggggagctggaggggcagtctccttctgttcaaatgactcagtacacttttgagggggcataagaaccagaaagtgcaggtgctagtaaagcaggcctgtatttacagggagaatcagtccacagacttcagcttctcaaaaccattgttaatgtgcttttacaaaatgcaaaatgctgctagacagttcactgggtggccttgggcctacccagttcttccctcttttcccaactcatggttcttaagaataactgaagaatgtgctagaaatgcaacatcttgagatagagagggactggccagaacgacccaacctctgtttcagtccacccctagaaacaaaatgtcttaaacactttagcccagcaaatcacacatcctggggtataaaacacagaaccagctgctttctggggtatctgagcttctgtgcaagtaaggcatgcacagatatgactctacttaccctcagcaggtttccggggacttggaggaatagctcacaatgaatcctaggcttctaccatctcttgctgcctatctgtaagtaataaacctacctcaggtaacttgttgtgtgggagtgttctgtctcactggacaagttggtagccagtgaacagtgaacctgcttcacaaattcctctgctgtaaagtgcaccagaagctctcagtcatggaagttctgtgctcaaatcttccttcaaggtgaactgctctggaagcagagctaactgacaacctctagctgctgtaccttttgacccaccgaggtgttcatgctaggctgcacttccctggggattttcccagccagtgactgggcacagtggaagtaacggaattaggtgattctaacccaactgggagttgtccaacagagagagttgccttaggaactattacactggctgatacattctcagagttgtgccgaagcctttctctttctaactatctctcttccttcccactctgctttcagaggtgtcagacctgcattacggtctgaaatctctccctgctccctccccatttcccttcacaggcattttcttcaatgaatttcctgcacaattaatacttggttttctttcatgttgtaaaccactgtaggatgactacagttaacaatatgtagttttggccaggcgcagtggctcgtgcctgtgatcccagcactttgggactctgaagtgagcagaccacttgaggtcaggagttcgaaaccagcctggcaaacatggtgaaaccccatctctactaaaaaaatattagtcgggcgtggtggagcatgcctgtaatcccagctactcggcaggctgaggcagaagaatcgcttgaacctgagaggcagaggttgcattgagcagagatcatgctactacaaatcagtctgggtgacagagcaagattctgtctaaataaaatataatgataatagtaataataatgcagtttcaaatagctagaaggaagatactgaatgttaccatcacaaagaaatgagaaacgtttgagatgatggatatgctaattaccctgatcaaatcactatacattatatatatcaaaacatcactacgtactccatcaataggtaccattatttttcaattaaaaaataatttttttaaaaaaaagaaatatagaatgttatacttgtaaaaagaagaaaatggaaactgaggaatcaaattatgtaagagtgatcttccttctcatcagctatcattttagaaatttgtaggaaaagaaaaggagataaaggaagacagcaagaggaagcaaataagcagagggaggaaaagagcagaaagtaaagaaagaattagaaagtaaggagacacaacagatcagatcagctaccataattcaaatgctcgccaaaatcacttcctatatttgcaatacagaagctgcaggagacatgttatttaaaattagtaagagggccgggcacagtggctcatgcctgtaatcccagcactttgggaggccgaggtgggtggatcacaagatcaagagatcgagaccatcctggctaacatggtgaaaccccgtctctactaaaaatacaaaaattagctggacatggtggcatgcgcctgtaatcccagctacctgggaggctgaggcaggaaatcacttgaacccgggaggcgcaggttacggtgagccgagatcgcgccactacactcaagcctggcaacagagtgagactccgcctcaaaaaaaaaaaaaaaaattagtaagagaatgagaacttcatacagaagttgaaaagtggatttgaaatcagtggagactgggaccttgtacaattaattctgttttgccttctgctactcagaggacctgaactgactcacctaccatctagagacagctactattttgtatttcttttttagtttcatgcatttaatttgcatgattatcattttgctttatttctccattttacattataatatgtgccacctcatgttactgtgcttcatgtctattatcgatgccccataacattctattgtatggaagtatcataaatatcaactatttccctttagttggacattcagggtctttccagatttttttcctaattaaatgatgctgcaataaatgccttgtttcgctccttcagaacaggtcattgcagtaagggcctctccattggagtggtggattttagtcgtctgggacttagggttttggttctgattctgctacatcctaacagcatgaccctgagcaagttacttggtttctcaggactcctgtttcctcacccatcaaatggaggtaacaccagacaaggatcctttgtgactatcagatttaatccatggcatcattttgaaaatattttcttttttctttcttttctgtttttttttttttttttttgacacagagtcttactccatcacccaggctggagtgcagtggcatgatctcagttcactgcaaccttcacttcatgggttcaagcaattctcatgcctcagcctcccaaaagatttccatggaaggtgcttgcaaagggaaaaataacttgtgtggtcaaaaagtttagaaacccctggtctaaacggcgctagcaggacttatcagagcctttattataacagcacacagtcccaaaggtagatccttatggtattatcttagtctattcagactgctataagagaatgccataggttgtgtggcttacaaacagcagacatttatttctcacggttctctccagaagatctgggaagtcccaggcagattcagtgtctggggaaggccttcttcctagttcatagacagccctcttttcactgtgtcttcccatcatggaagggcaaaggggctctctgggaccccttttaaaagggcattggccaggcgcagtggctcacgcctgtaaacctagcactttgggaggccaagatgggcagatcacttggatcaggagttcaagacagcctggccaacgtggtggaacctcatctctctaaaaatacaaaaaaaaaaaaaattatccaggtgtggtagataattatccagtagtctcagctactcagaggatgaggcaggagaatcacttaaacccagaggcagaggttgcagtgagcctagatggtactactgcactctagcctgggaacagggtgagactcttgtctcaaataaataaataaataggcatgaatcccacttgtggagtccccaccatcatgtcctaatcacctcccaaaggccccaccccctaataccatccatcacactggggattaggtttcaacacatggtgggaacacatttagtggatagcaagcatgaagcattaatcaagcttatttgcccatcatgcccatgaaattctgaagtctgacaagcagcctgtgagaagaaagacatacaacaaggaggtaggactatggtgctttggggtggaggccactgatgaaaaactcacccctcgaaagcatctcctactttgatacctacggatgcaacatccaggtagaaccagcctcgatgtcttctggagcccaggacctgatctccaagctggcccaagacaacgctcagagtgccactgttcaagctcctcttgctccataatcactttaaagaggctgcccccacccccggggctcagagggcttcctgtgtcctgacactatgatcgtgagcgagcgccgcgctctgttcccaactatgcttcctcatctgtcatccacggcttttcttttaaggagttatttacgaagaggtgaagcaatttgcttttaaaaatgaaaaacaacagaactagtattttttgtaagtcagcttgataggcagtaaacaatcctgccaaagcaaagcagaaaatgctgaaaaggttcatgtctcttcaacgactctgaccaagacttcagaggatgctccaaggggagaaacatgctcagggctacagaagcgagaatcatggataccctaagctggtctttcccaggagcaattttaccatgcaattttccctggatcctttctctatcgccccataacacctctcccatttggaaacaaaaatataatctttgaaagaaaaatagaaatcactgtctaaataaaaataatacattcctagcattcattcaccctcttcatcctcctccctgcccctgcgggggggaaaaatctcatgtatcatgttgaatttctcatctcttgtgaatgccatgcaattgggtaaataagttctgtgttcaatcttttgtttttttgtttgtttattgctttattcattcacaatggaaagaaagactaaacttcaggtagagataaaagaatataagatgtatttttaactgtccaagatcatgggatccccgaattctattcatgatagaatgtttgagcatctgtggaccccagtttgtgaactcttgccctgaaacaaagcctgccagttatctgtgttcagtcttttaacaggggttattcaatttactcaagccaacatgagaggtttccatgacaacctctcagcacattcagtcttcatataaatgagttattgcttttatgttctcatactctaagacaatggggaaattaacataatgtggtcatacaaaaaaaaaaaaaaatcaaaacaatcaaaatcctcatatcctccccagaaactcacagatagcattcggtgaaaaagaaccaaagagaaatgaagccttcacatctgacaacactgttaacattagagatttcatttcagatgcatttaaatgaagccagaccataatggggttcaaaaaaaagtgtatagacataattaaactgcagaggaaagagacttaaagtcagggacccaaattcactttcaggccatatatcctccaaagataaccaccattctctgcctctctttctgcaccccatccacactagcattcctgccccaggaccttcgcacatgctcttccctatgcttggaatgttcttcccctgctgttcttccactgctgctttgcttagctaactcctacccatcctcaggtctcagctcagcaaagtcacttcctcagggcagtcaagctttgccactcatcaagactaggtaaaattttcttgttaaatctatttatggattttcctggttctttgtatttttcatcatcttagataggttaggtttccccagaaacaaatcctaagagaaggtgagacggtttggctgcgtccctacccagatctcaccttgaattgtaacaatctccatgtgtcaagggcgggggcaggtggagataattgaatcataggggtggtttcccccatactgttctcctgatagtaagtctcatgagatctgatggttttataaatgggagttcccctgcacaagcctcttgcctgctgccgtgtaagatgtggctttgctccttcttgtcttccaccatgattgtgaggcctttccagccatgcagaactgtgagtccattaaacctctttcctttataaatgacccagtctcaggcatgtctttattagcagcatgagaacagactaatacagaaggacttgaagataagtgggttgatttggaaagtgagcccaggaaacactgggatgacaatagggaaatgagacagagaagggaaaggagctaatccaggtcatgtttataagcaggctgctactatgggcaactggggttcaatcccactggggacatctgggagacagcatagcgcctgcctcaccctaaggtatggaaggcagggcaactgccctcagcagctggctgggggagatgtgcctgtgttggtttctctgcacttccagcctgccccacaagagcctaggttatggcagtgagacaaagccccaggcagtattgcagatgcttgcagtaggaatggtgagttcctatgccagaggacataggcaaggcaacaactacatctgccaccttccccaatgcaaacagcataattattgctggagactggagatcagtggaatagaagacagaagatttaattcaaagccattagacaaaaaataatagtcccattgaagacaaaggcatgggaatacggggaaggtataaatccacatgaatagacaattttcaaaagaagataaacaaatggccaacaaacatgtgaaaaaatgctcaacatcactaatgatcagggaaacgcaaatcaaaaccacaatgcgataccgccttactcctgcaagaatgaccagaatcaaaaaatcaaaacataatagatgttggcatggaggtggtgaaaagggaacacttctacactgctggcgggaatgtaaactagtacaaccaccttggaagacagtgtggagattccttaaagaaaagtagcaccaccatttgatctggcaatcccactactgggtatctaccctgaggaaaagaaatcattatatgagaaagatacttgcacatgcatgtttatagcagcacaattcacaactgcaaaaatatgaaaccagctcaaatgcctatcaatcaacgagtggataaagaaactgtggtatatatatgccatataccagcagtatatttatactactcagccataataaggaatgaattaatggcattcacagcaacctggatggaactggagattattattctaggtgaagtaactcaggaatggaaaaccaaacgtcgtatgttctcactcacaagtgggagctaagctatgaggatgcaaaggcataagaatgatacaatggactctggggactcgggggaaagggtgggagggggtgagggataaaagactacaaattgggttcagtgtgtactgctcagataatggctgcaccaaaatctcacaaatcactattaaagaacttactcacataaccaaataccacctgttccccaaaaccctatggaaataaaaaattttaaaaataaaaaataaatttacatgatataaaagaccttgactctaggcctgggtgactgattatatactggggtacaggttttagtcaaagagctggagactatatggaagaggggtgtctaaggccctctctgacattctaacaacccccatcatctcttttgctggccaggggcccacctggtaggacagtccaatccagggtaattctggctcacaggtcacgcaataccaatctttggtcccaaggttaggagtggctgctctcacaatggactttataataacctctccaacctctgtttgttgagcttagattcttaagcctctaagcttctgatgactcttactagagaaagtaatataattacccatcaatagagaaatggctcattcagcaaggatatatctgttcaatcaaatatatttgttcaatcaaatcactaaaaacaatggccgtttaagagtacatatacaaaaggtacgtgtgcaacagtataataagagcaaacctaaattatgcttgttgttcactgattgtctccccacagtagcatggaagttcagcaagagcagggatctttgtttttgttcaatgctaggtcctcagcacctaggactgtgccaggcacaaaaacatccagcacccaccaaggtaaaatttacaatgtctgacatcccataaaagttactttaaaaatagaggctgggccaggtgccatggcccacgcctgtaatcccagcactttgggaggccaaggtgggtggatcatgaggtcaggagatcgagaccatcctgccaacatggtgaaacctgtctctactgaaaatacaaaaattagctgggcgtggcggtgcgtgcctgtaatcccagctactcgggaggctgaggctggagaatctcttgaacttgagaggttgcagtgagccgagatcgcgccactgaaccccagcctgggcaacaagagctagactccgtctcaaaaaataaaaaaatagaagccagtggccaggagctgtgaccgacacctgttatcctagcacttcgggaggccgaggcaggtggatacttgaggtcaggagttcaagaccaacctggccaacatggcgaaaccccatctctactaaaaacacaaaaattagccagtcatgatggcacacacctgtagtcccagctactcggaggctgaggcacaagaattgtttgaacccaggaggcagaggttgcagtgagccaagactgcaccgatgtactccagcctgggcaacagagtgagactctgtctcaaaataataataatagaggccaggcatagtggcttatgcctgtaatctcagcaatttgagaggctgaagcaggaggatctcttgaggtcaagagtttgagactagcctgggaaacaaagcaaaaccccatccctccaaaaaaactttttaaaaactagccatgcatggtggtgcatacctgtagtcccagctactcaggaggctgaggcaggaggatcacatgagcccagtagtttgaggttgcagtgagctatgactgtgccactgtactccagcctgggcaacagagcacgatcctgtctcaaaaaaaattaccttaaaataataagtaaataaatatcaattttacaataaaataaaagtgactcagcctaccctgggtggggttaagggctggcctctatcacacctatcagctcccagaggtcctggatcccccagaagctgctaggaggggctgagggccattactcagaagtgcagagtggagcaagctttgaccaataagagacaggaaacagcaggagctggcagatgactgactccagagttatcccatgcttgtgtttctgggaaactgcaactccactaggcaatatgcacttctttggttttgctcttcctctttctctctttcccttatccctgctttcttgagattgcgtgacccaatgaaacattcacatatttgtatcaggcactgttggtaggctaagataacctccatccccaaaacctatgacacatggggtatctcctgaaggatgccattcaagttaatccccaaacattatggcttaaagccacaactgtttttattatagatcatgattttgagggtcaggaattcaagcaggacccagctgggcagttcttctgctcacacagtatcatctgaggtcactcagtagtattcagagggcttcggggctgctctgaagggtctagtgcagttttagtgatgtgccaggcaccttggtgggtgtattagtccattttcatgctcttaataaagacatacctgagactgggtcatttttacaggaaagaggtttaatggactcagagttccacatggctggggagcctcgcaatcatggtggaaggcaaggaggagcaagtcacgtcttacatggatggcagcaggcaaaaagagagcttgtgcagggaaactccctgttataaaaccatcagatctcatgagacttactatcatgagaatagcatgagaaagacccacccccatgattcaattacctcccaccgggtccctctcacaacatgtgagaattcaagatgagatttggatggggacacagccaaatcatatcagtgggacaggatggaagctgggctcagagcaacttctctccctttccatgtcatctcagagtctctccaggtttccctccagcaaaagccctcagatttctcacacagtggctcaggggtttaaaaccaagagttccaagaggtgtaaggcagaaactgcatgatcccttaaatgccaggaccagaaccatcatggtgtcacttctatggcaatctattcgtcaaagcagtcacaggccagcccaggctcaggaaaagggaaatagaccccatttctgaatgcatggggtatcaaacagtttgcactcatctttgacctgccacagatacacaagaaactgggaggaggggtgggtggaagactgaagcattagagtaagaggggctccttcatcctccggtcatcatttgccatgtgcacgtctgacttttttcaaataaaaactggggaaggacaaaaagtggggaggaaccatgtcaataagctgaatcctcatcttctatggcacagagtcaatagaaaatgtcttaaattgataaatcaagaaacagccacataagcatcttatttggagttacagagataaataaccgaagacctaaaaatggaaacaacatttcaagcacttgcctccgggaaataagacttaaggaggggagagaggagagaaggggccaggaaccgctgctttcattagcagctcctctgtactttaactttgtacgatgtgctcatattactatgatttttttttttaaattcaaaagggaaaaaaataagaacaaaatgatgatggttatttttaaaactatgtaattaaacctggaaaaatctcattttgctaaacggaaaaaaagtagcaggatactaaactatattaatagtatggtcataagtatgtttaataaagaaagagaaaaacatatatgggaggagaaaaatctgaagaaatttactaccaaatgatagtgggtgggtttctctacttttctaggtttcccacattttcagcaacgtgattctcatactttcctaatgaaaagaaatacattcattacataaaataaattaactgggccaggcgtggtggctcatgcctgtaatcccagcacttcgagaggccaaggtgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaaaataaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctgaggcagagaattgcttgaacctgggaggcagaggttgcagtgagccgagattgcgccactgcactccagcctgagtgacagagcaagactccgtctcaaaaaaaaaataaaaaaattaaaaaataaaaataaaataataaaataaatgagccgagcatcaattaaataaaatgccagaagggtctctgaagaactttccacaatagaagtgtattttaagtccctgagccttcatctcatgcctatggacaggggactctttgcactggttctggaacgctccagtccaccatgcccacggatttagttaggaaaccttcccagaaagaacttagtccatgtcatttcaaaatgaattaattcaactcaacaggaacttttgtaagcctccaatgtatgcggttctgaacttttgtaagcctccaatgtttccagttctgaatctggaatgctcattcagccacaaaataaacatttattgagtacctactatgtgccagacaaatgctacttgcaggggtgacaatgatagagacaggcaaaatattcaattctttggagccatagactaatgggagaggcagacaagtgactaggcaagtgtaatacatcctaacagacactttggggaacagacaaggggctgtggaaggaggcaacctggagggcttcctggaaaaggccaaacatgggccaagcgccgtggctcatacctgtaatcccagcactttgggaggttgaggcaggcagatcacttgatcctgagagttcgaggccagcctgggtaatatgacgaaacctcatctctacaaaaagtacacaagttagctgggcatggtagcatgcaattgtagtcccagctactcgggaggctgaggtgggaggatcacttgagcctgggaggttgaggctgcagtgagtcacgattgcaccactgcactccagcctgggtgacagggtgagaccttgtctcaaaaaaaaaaaaaaaaaggccaaatatgagctcagagctcagtctcaagggatgaaccagggcagatcaggttaaagcggaaaagctgttgccagcacagagaatagaatatacaaagacccagaaacaacagagaagatggatacattcaaggaactgagagtgatctcaaaaaaaagatttgtcatgatcagaagagacagtcccaaaccagcactcacttgggggctctgggactggactccctaaattggaatctcagccccatcatgtgagctcaaagtgcttcacctcactgtgcctcagtttccatgtctgtaaaacagggtagaagtagaacttatctcagaagagttataagaattaaactagagaagaagtgagcattgtttatatgtgcttgttgctatggatccaaaactgccagtaataacaataataataataataataatagcttatgctttcgttgagcccttgctttgcacctggccagtgacaggcacattatcagtaacacaaatgcaagtatctcatctaacccttgcatcaacgctcagagatgggttttatcagcatccccattttacagatgaggaaaactgaggcagagcagttgcacaacgtcgcagctgttcctggtgcttcacccagatcctcattgccagtaaaccactcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcaaggcagaatacactccagagacccacgtgagatcaaggctagcctcagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccccacgtgaaaccaccaagctgcaccaggctcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtttatttgttctcacgctgctaataaagacctacccgagactgagtaatttacaaaggaaagaggttgaatggactcacagttccacaaggctgaggaggtctcacaatcatggtggaaggccagagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccccgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcggccgggcgcggtggctcacgcctgtaatcccagcactttgggaggccgaggcgggcggctcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcactgttgcacaccagcctgggcaacatagcaagactccgtctcaaacaaacaaaaaaagggggaggggcggggctttagacagatccaagctcaaccctgcaagttgccgagactccgtttctttatctgtaacatggagatcacgatgttcacctcgcagagtagattaagcagctggcatgtgtgaagtgcccagcactgtgtctagcatatgctaggtacttggcatgtgtttctttctttccctcccttgttcaaggccacatagtccatgactggcagagctagaagccttctcatttatccaaaatcaaagaacttctacaaaatagaaacagccccctgccccctcctgcccccgcccgcctgctaccttaataggttgtttcccagttattcaatgcaagagacttagcccagctaaagttattcaaaatcgaccttgagatcaggaacaaattggctacagcagtcagcgattggcaaatgcaatctaaatgccccaggcggcattagagccttccacgttgacaggaagagtcaatgtgcatcttggaaaaatctgagaaaaaaaaattaaaggtcaccgcgtttgtaggcagaatgggttttcttgagaccattacaaacagactgcctaaattgcaaagattccaggcttgacagctcccggaggactccagatggaaagaacaccacccccatctcttatacatccaggctgctgtctgtggatgtccgaaggttttcccaccacccatgctattgttgaaattccacaatcaacctgcaatgccccagtgaaccattttgctgggatgggaggaccaacttagggccaaccctgtgttccaaggggctgaccaggcaggacagccaaggaggcacaagtctgtaagatgggtccaaacatttctgtaggaagggggtcttgagccaaagcaggaaaaatcaaaccccaacacaaagtgtagagagagtcggatcataaatcacacacagacagggtccgagaaacatgggctggggaccagcagacgacaggctaggataattgatcattagaacatctgtgctgtttttgttgtaagaatagtatcaatattaataacaacagcaaatatatattgagtggcttctggagccaggcactgtggtaaacttttgcacgtatcctctcacttaatcctcacagtgctctacaaagtgggtactggtttcatgcccatttcacagagaacatatctgaggctcagagaggcatctacaaggtcaaccaggtaatcaggaaagccagatttcaagggcttgtccacatcactctatgacatgtggggaactcaagtgtgtgttggcttaactcaaataaatagtacaagttaggctgggcacggtggctcatgcctgtaatcccagcactttgggaggccaaggcaggtggatcacctgaggccaggagtctgagaccagtctggccaaagtggcaaaaccctgtctctactaaaaatacaaaaaattagccaggtatggtggtgggcatctgtaatgccagctactcaggaggctgagacaggagaattgcttgaaccccgggagacagaaattgcagtaagccaagatcgtgccactgcactccagcctgggcaacaagagcgaaactccgtctcaaaaaaaaaaaacaaaaaccaaccaaccaacaaacaaaaaacaaataaatagtaaaagttacttctcaacacgagccagtcattttttaaagtatcttacatttttcttttcctttacttattactttttgaattgacaaacaaaaattgtctataattattgtgtacaacctgatgttttgaaatatgtatacattgcggactggtgaaatcaagctaattaacaagtggtggggatgcttcaaatttactctcttagcaatttgcaagaatacaaacacttttattaattatagtcactattttccaaacaaggaaacgaatgcccagtaaaagtacaaagtaacagaactcctcactgaagctggggtcatgggtgaaaaagataaatataggctgggcgccgaggcttatgcctgtaatcccagcactttgggaggcagaggcaggtggatcacctgaggtcaggagttcaagaccagcctggccaacatggtgaaacctcatctctagtaaaaaaaaaaatacaaaaaaaaaaaaaaaaaaaaaaaaaagctgggtatggtggcaggtgcctgtaatcccagctactcgggaggctgaggcaggagaattgcttgaacccaggaggtagaggttgcagtgagccgtgaacgtgccattgcactccagcctgggtgacaagtgcgaaactccatctcaaaaaaaaagataaaatacaaatacatccatatataattaaaatatgatagtggtatgttttcctgtttaacaaatatttacttccctctcattcccttcaccatgggaagaacagaatcctctgccctgttagtgatgggtttgttttggccaatggaacatgagcagagctgacggtgcaccagttcccagcttaggccttaaaaggcattgagtatttctgctcactcctctctggaagctgccaaccttcaccaggtaccactgcttctccaatctggacctcagaaataaatgtaagaatcagacttgaactcaacccacagcctaaagcagaatctctccagctaaaccacagacctatgagcaaaaaataagtgtttatttttataaccatgagggtggtgttacttgttacacagctacaggtaactgatacatttacacgtgaatatgtgcacatactatacatgtgcatattatataggatacatatgtgtggccgtgttacatggaaatagatacgtataaatccttaaaatgtatctccatatgtgggatatttatacatatctatttgggagatagtaaatggggtagaatttggagactgctaaatttgcattcttgcgttgacacaagctgtgcattttgggggaaattacttgacatctctgagcacattttctcctttgtaacatggagataaagatgaagcttatctcataggattactgtgagagttgagtaaaataatacacgtaatgggcttagcagggagcctaacacacactcgctcacacccattcattcaataaatgttattgagtaaccacatttgccaggccctcttattggtgtttagaacacagttactagctgtggagaaaaaagcaaaaataaaaaggataaggagagccagcagccccggaggaggagggagggaggcataggatgtgcctgtgcctggcacgtagtaagtgctcaattattggtagccatttttattctcaaagtgattaacgtgagaacaagggggtcaactggagatttaaaaaataataatcagtctctctgctccgcagcagacccctgagacccttggcaaaccccagcaatagatcaaggaccttcagtaggtgaatacagtcgcaggaactgctagagctgacacatagtccctgcaactccagccagacgccagcaccagctgccactgggagatgtgagcttggcttctccatgaaagagaaagattcctggggcctcagccgtgcctcaaacccactgataacatcaaacacacattgctggggggagccggccaggtgctcagaagctgcagggtgaccctgcgtgtaggtgtcgggaagtcagcagcgactcgggggtggagaaacacccacacctttgcaaacactcttaatgtaatgcactgcccttgaggccacctcccgtttttttggccctaattggcatgtttttctatctcctcagaaacagccacgggagacaacattccatagcagttaaaagtgtggtctctgggtttgcaaccagactattccccaccagctgcaaccttgggcgagacacttaaccccaggagcttcccctcccgtggttgtgatgattaaatgagataaccagataaccccttagatggcaaacactcagcacagtgcctgatgctcatcattgtggcttttattacggactcattttataaacgaggacatcaaggcccagacagcttaagccatttgctcaaggtcagaaggtcactctaaccttgccatcaaaccttgggattttctttttcctccatcacaccatccccaactgatctactcctcaagtgaatttcagaaatcctccaaagatgaattttgatctacctagagctgtgctgacttaactggagcatagcacatattttcaaaacaggaggaaacttgaccacagctttgagccatgtggatgataaagtcatcgtaggtgaacttgagactgggattcggcccttgtgtcgattgtgattagcacagagtgaagcagcgtcattctctcgggggtaatacccgagattcgttgcctcataccaaaaacattaaggacacagacacacacaaagagtgagtttaaaagcagaggtttaataggcaaaagaatgagaaaggagaacgctgtctctcttccgagaggggggcacccagtgggacttctggcccaagtcagagtgcaccagattttacacggttggggaggcggtgcctgatttactagggcccaaagattggttgcaccaggtgtgacatttacatagcgcatggggaagttggccgccccaccctagtgttattatgcaaatggggtctttgcctggctggctccttgttgcctgctccttactgtacacatggctggcaaagagaagggaagatggagctgccgtgttggacgtgcctagccccagctagccttttcttatgggcggagctgccggcattcacccgtgcaagcttccagcttgcttgcctatgtctgcagcttgattttacaggatgctctccgttagaaaagaaaaatgatttggggactgcttttcattaaaaggaaaaccttactgaggacttccttaccctcactatctgcctaaataatttcttcttaactcttacatcagtaatatgaactcaacagactgaaagtaacaatcagatcacaaacacagatgtctacagagtctggaggtttctagggtgactatccatcctggcttgagcactgcaagtcccacactctgggaatccgctcgggcctgggcaaaccaagacagctggtcaccctcgccgtaacataagtgagtgaaggtataaaaagctgtgcctgtctcagcgttttccacttctgagaagcaatcatgtatggtggttaaaagcaaggactctagagccagactcacttggtctataccccacctccgttgcctaccagctgcaggacctcacacaggattacccaacctcaccatgcttccgtttcctcacatataaaatagagatattagagccccctaccctaggtcagcctcaacaccactgacattttggacctgatcgtcctttactggggagtctggggacagccctgtgccttgtaggatgtttagcagcatccatggcctctacgtactggatgacagtagcacagtatgccctagttgtgacaatcaaaaatgtctccagacattgccaaatgtcccttatggggatagaagtgtccccagttgagaaccagtgttgtaggcagtgttgtgaggataagggaggtggtacatgcaaaatgctgagaaaaagccatgacttggagagtctgtttctacaggaacagccaataaagccttagagatggagcaggaaggtggcaagccaagagctgagcaagcaggaccttggagggaccaagggcagggcagccaagccactgtgaaatggaacaagctctgcaaacggaggccagcccggccaccctccccctcacctctcacacaagattggacttctatttcaccccaggtgcggaaagtggagtgaattactcctcagtttctggcatggcaccacggtgcagtgcaaaaccccctcagctgaggtattcctcttctcttgaatgtgtgcgcattcttgtgaagtgcatttgctcatcaaatattgagtgttcagaatgtggcacgaagacagcggtgaacaaaatagacagaaatccctgccctcttgtagctttaagcatactgtcttgtgtacaaatacatttttaaccaataaaaattgtgtcatactatggtctagatatggtttgttttggcccctgccaagtctcatgttgaaatgtgatccccagtgttggaggtggggcctggtgggaggtgttttggtcgtgggggcagatccctcaggaatggctgggtgccattctctcaagagtgagtgatttcccactcttagtttctgcaagaactgattgtgtgtgcgtgtgtgtgtgtgtttcaagatgtaatctcgctctgttgcccagactggagtgcagtggcacgatttcagctcactgcaacctctgcctcccggattcaagagattctcctgcctcagcctcccgagtagctgggattacaggcacccgccactacatccagctaatttttgtgtttttatttttttctatttatttatttatttatttatttattttgggacacagtctcgctctgtcagccaggctggagtgcaatggcaagatctcggctcattgcaacctccacctcctgggttcaagtaattctcccacctcagcctcccaagtagctggagttacaggcaagagccaccatgcctggctaatgtttgtatttttagtgcagagagggtttcgacatgttggccaggctggtctcgaactcctgacctcaagtgatccacccacttcggcctcccaaagtgctgggattacaggcatccagtcgagaactgatagttaaaaataacctggaaccctcctctgtctcctattcttccctgtctccttcttccttctctcatcctccttcctcatacccctcttctctccctctctctctctctctatcttaccatgtgatctacacacaccagttcctcttcacttctgccatgagtggaagcttcctgaagccctcatcagaagcagatattgatgccatgattcttgcagaatgatgagccaaataaactttttttctttgtaaattatccagcctcaggtgttcctttatagcagcacaaacaaagacacttgctataaattgattctattgctcactttttttccccttgtgctttgtttttaagatccatccaggccgggcacagtggctcacgcatgtaatcccagcactttgggaggctgcggtgggcggatcacctgtggtcaggagttcgagaccagcctggccagtatggtgaaaccctgtctctactaaaaatacaacattagccaggtatggtggcgggcgcctgtaatcccagctactcgggaggctgaggcagaattgctggaacccaggaggcggaggttgcagtgagccgagattgcaccattgcaccccagcctgggcaacagagtgagactccatctcaaaataaataaataaataaataaaataaaagatccatccatactggcatgtgaagatcagacctgtttttctaactaccgcagtcatatcccacagtgagtatctgtcatgctttgcttatctatccccttctgatgcgcacagcagtggcttccaataccccgctaccacaaacccacctccttgaacatgcttgggtgaaactttctctggggtataaatccaggaggggaattgctgctgctcagtctttaatatgcacaggactcacccagggatcttgttaaaaggcagattttgactcaagaagtctggaaggagactcgagaatttccatttctaacaagctcccaggtgatgctgatgctgctggtctgggaccacagagaatatgcagccttcatttgctttagtatcagatctctctagaatgaccgcgccagtccacagtcccagggcttgcttttaaagggggccaaaccccactggcccccctaacacggtgtagacttgcagggctctgctgagagccaccattaaccacaagcatcatgtctgtattgctaccgttcgtcaatacccttgaccatcttgccttaaggaaccctcaatttccaagcacatctccaaatcagagccccaccccctccacaatgcaaagtgggacaatctaggagaacatccagcccaacctcctggctttataaagggagaaaccaagactgagagacttgcaagaaatcacaagaaattcccgtttctttgcatcttactcctccagagccctctttgagtgatcagtaattcgtccacaatttataggacttagttcactttacccatctttttccatctccctgccccaccccactccaccctccccatcccatatcccccagcccaccctgctttttaatccttgctagaatcatccattttgcgaccaagtattgacttcaaatgatatatgagacaattgacatttcaaatattccaggcaggatacagaattctgatcacggcccagtctgaaacatctcctccacatctctttccttattccttctgggcaataattgtccccccaccagcccacccccctcccaacctcgacattaatttcccctgattcatttttcatgcctttgaattctgccttttcaaagcagaatatgtttctgtagctgtttctcatacctcccttcccctcatgaatatttcaaatgcaatagtgatatgatcgttcaaccttaagaggcacaccaactttatcttatttatcttaccgagctgcttccgatcccgggattaagtccaaaacatcctttgagagtttgtttgggttgttttcccccaggctgttgctgctgtgtatgtaaattacaaagagaagcagcctccccctcccctcagccccagccccgggcaccagcccccggcccgagacgcccgccctccctctgccaatccttcctgggagatgcaagacgcgctcctctcaaagccaattggcaggcctccggacgggtccctgccagggcatgtctccctgacttcctccagtggtctcttagaagcccaaaactcaccatgcgaccttgggtagggcgttccgccactcaggcaagtttccccatctacaaacaaggggattagacacggcgaccctaaagtcctttcagctctgagactccatgtgacgtgatgtaatgtaacagacacagcccttcctggttccaatccaagctctactactaaacgagtgatgagatggctcaccaactgtacctaccactgactagctgtgtgacccttaactaactgtacctaccactgactagccgtgtgacccttaactaactatacctaccactgactagccgtgtgacccttaactaactacacctaccactgactagccgtgtgacccttaactaactgtacctaccactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagctttgtgacccttaactagctgtacctaccactgactagctttgtgacctttaactaaatatacctgcctctgactagatgtgtggcccttaactaactgtatctaccactaaactatccatgtgtcttaaactatccgtgtgtcttttaactgtctaccattgactagctgtgtggcccttaactgtgtctaccactaactagctgtgtaacccttaactaactgtatctaccactaactagctgtgtaacccttaaatctatcactaactgtgtgacccttaactgtgtccaccactgactacctatgtgacccttaactaacagtatctaccactgactagctgcacaacccttaactatgtcaaccactgactagctgtgtgactcttaactgtttctacaactgactgactgtgggacccttaattgtgtccaccaccgagtcggtatgtaacttgtttctaccactaactagctgtgtgaccatgatgcgagttacagaagttctcagggtctcagtttcctcccctgcagcatgcattggttaatagcagctgcctctggggctgtagtagggtgaccagccatcctctttggtttatctaggaccgaagtggttccaggtatagggaacgctcagtgtcaaatccagtaaagtgctaaagcaaacacaagtttgtcacccaaggttgtagtgagaactaaaggtgaatgaggtgacatggataaaatctagcacatcaatataagttagtatcattgctattgctattgctattgctttttgtttgtttgtttagagatagagtttcactcctgtcacccaggctggagtacaatggagcactctcggctcactgcaacctccgcctcctggattcaagtgtttctccatactcagtctcctgagtagctggcattacaggcacccaccaccacgcctggcaatttttgtatttttagtagagacggggttttgccatgttggccaggctggccttgaactcctgacctcaggtgatccacccacctcggcctcccaaagtgctgagattacaggcgtgagccaccatacccggctgctattgttaacggttctgctcatggctataaaggaattttttttcacttctaattttttctagaatttcagatttctctttatcaaagcagtacaagcaaatgatacaaatgacttgaaatggaaaacaaagctgtcttaccccagcccttctcccatcaaatccctctccccaaaggcaggcagttgaagtcctttttagcgactgatcttttaaggctgactctgcctcagtcacgctctgttcccactacttcaggccctcaccacattggccaggctggtcttgaactcctgacctcgtgatcctcccacctcagactcccaaagtgttaggattacaggtgttgagccaccgcaccaggtccatcggttttcattaccaccacctgacaggtgagcaggctggttcacactctggtcacctggcatggcttgtcacatactggtgaagctgtcacccgcaaaatccagacctgggactgaggaaagagctaagcgatcctaaagagatacagtctctcaggtggcccttgatgggggcaaagagaggaagggacagttcctcttttatttgtccattcacacatgttgggagccaggcattaaatttgcaagccagaaaaggcaggaaaaaccaagtttatggcttttcaagttggttcagaaattactgtacgggccctccaaaaggtttaatgtctctgtggtgtcatcccaaagagaagcacagagaagcaagaggatctgcagctggagagcccagaggcaatgaacactcaccttgactctcttctcatttctgaggctctatcagttaaggttcttagtttgcaagcaacagaaccaaatctttttttttttttttttttttttttttgagacaaagtctcactctgtcgcccaggctggagagtagtgcatgatctcggctcactgcaagctctgcctcttgggttcaagcgattcttctccctcagcctcctgagtagctgggagtacaggcacacgccaccatgcccagctaatttttgtatttttagtagagacagagtttcaccatattggccaggctggtctcaaactcctgacctcgtgatctgcccaccttggcctcccaaagtgctgggattacaggcgtgagccaccatgcccagccaacagaaccaaatctttacattaaaaagcggggagcttataggatcagagaaagaatagagttcccagacttgagggggttccagttggaccatctttgtatggtggtggatctcaaccctcactgcagccaacagtcaaccaaagagacttttagaaaccactgatgctgggccctcaccctcagaaattgagatttaagccgggcacggtggcttatgcctgtaattccaacagtgtgggaggccaaggcaggcagatcacttgagcccgggagttcaagaccagcctgggaaacatggcgaaacctcgtctctactaaaaatacaaaaattagctggatgtggtggcgcatgcctgtagtcccagctactcaggagactgatgcaaaaggatagcttgagcccaggaggtggagattgcagtgagccgagattgtaccactgcactccagcctagatgacagagtgagaccctggcagggcaaggcagggcaaggcagagcaaggcaaggcaaaaaggaaagaaactgagatttaactggctcaggtctgtcttgtttcacacctcccctaggtgattctaagatgaggttgaaaaatgagattcactactctcgggatgcaactgcaccgtgagtccagaaaccagcagtactggcatcaccatctccagtagagctcgtcagaaatgcagactctctctcagaaccaccccagacctttcgagtcagaatctgcccgcgaacaagatcctccagttagcgttaagcagattaaaggttgagaagcactaggctgcagggtcgtggaatgactggactctaatcactctacatccttgatgatctctccttaagatgcaaattcccagaaggcaagcatgtgatgggccatgcttttgtcacaccatgatagaagatctgggcataagaaattctgcagagtggtcccaccagacccacaggcaggagaagggccatccctgaacggagtgggatgcggggctgataaatactacataggttaagcacagcgaccttcacagttcagagatagtgatgccaactaccacttattaagcacctactgtatgccaagcacagtgccaaggactcaaattactcatggaattccccctataaccatgaagccaatattattattactgctacagctactactactattattttataaaggaagaaactaaggtttagagcagtagatccaagtttagcacggatcagaatcacctggaagatttgtaaactcacagacttctggaacctaccctcagagttgccggttctgtaagtctagggtaaagcctgagaatttttatttctagcaagttcccagatgatgctgatgctgtttgtccattcacacatgttgggagccaggcattaaatttgcaagccagaaaaggcagtaaaaaccaagttaatggcctttcaagtcagttcagaaatcactgtacgtgcccccaaaaagggaatgccaaacattagggaagtccccatcttcacaatgagaacttacccacctcagagagatggtttccccaggaaacaagtgcagatggcattttgcagaaagtgcacattgaaagaaagcaaactggcttagaaatatggttaatgggaattctttggaattcatagcatcaggagagagtcgtttccttctaccacacacctggctgggagggtgacaatgtctttaggagggagagactgggaaacattaataccagagccctggctattatttgcaatgtatagcaatgtttttcctcaaggtagatctttggtgagccgtacacagtaaagctagccattcaggtggaattacatccaactagtcatctctgtcatactaaaaacagtaaacaatgcttgaagaagtcagatgcctggcatcaaatctaagatccaccatttactggctgtggtcattaggcaagatgcttaacgtctttgtaccttattatcctattttgtaaatgggggaattataataatacctaatctctaggttactggatggactaaatgaaataatgtgtgaaatttttagtaacatagctagaatattacaagctcccaataagtctattgtattagtccatcctcacactgctataaacaactggccaagaatgggtaattgataaagaaaaggggtttaattgactcacaacaggtctgcatggctggggaggcctcaggaaacttacaatcatgacagaaggagaagcagacatcttcacaaggcgataggagggagaagtgagagcacgggaaaaaactgccacgtttaaaaccatcagatctcatgagaactcactcactatcatgagaccagcatgggagaagccgcccccatgagccaatcacatccctccttcgacacgtggggcttacagctccctccctcgacgcaacacctggtgattataattcaagatgagatttgggtggagacacacagccaaaccatatcacctattttatttatcataccattagtgttattattattattggtggatgtgctggtggcgttaatattgttggcaaaactggaactagctggatctttatcaataattgcaatcatgattctgacatctgacccttccatgccactggtaggcatgtaaacaggcacaatttttctggaaggtcatttggcaatatgtatcaagagccttacaaatactcacccattttgacccagaaggtccactcctagaaatttattttaggggagtacatccagttgaggacaaagatgtatgcccaaggaagccatcacattattgcaaatggtaaaaaatgaagtgtcaaccaacagaaaaatgtttttgaaattacactatgttcgtacaatgaaatcttcttccaattattaaaataatgttcatgccttttaattggggtgattgtataattttatatctttataaaaatatatgtatgtaagacttcatatagatgatgaactcagttatgtaaacatatgatagaaaaagagaagggaataatccaaaagccatctgctctgggtcttggaatgggaattcttatggttttgtgcatttttgcagctatttctcaatagtcccctttataatcagagcaggctgggtagaatctggtacaggagattgtggcaaactagataattaacccagagaacattatttctgtctgggtatgccattaagttacaaagaccttttgtaaatgtgggtaataatgaaaagagggctatagtgttggaaaggaagacaggagataaggaggaatgaaaaggagtaggtattatttctacagagtcttgaaagattaagaaaaatgaggcagccagatgcagtggctcacacctgtaatcctaacacttcgggagatcaaggtgggaggattgctggagcccaggagtttgagaccagcctgaatgattgagtaagactcccctctctacaaacaaaatttaaaaaactagccaggcatggtggtgtgcacctatgctcaggaggctgaggtgggaggatcacttgagcccaggaggttgaggctgcagtaagccgtgatcacaccactgcacttcagcctgggtgacagagcaagtccctgcctcagaaaaaaaaaaaagaaagaaagaaacaaaagaaaagaaaagaaaaaatgaagcaaaagataccagcagcattggctgagccctagaggtaatgggaagggttgatggggcaagatcagagacttctgtgatgtttccatttgatgagacaaaactcagcattagcagaattaaagttacctaatctctagattaggaaagggaacagagaaatacctcatggcaacacatggcctttttgagttgcaagttgacagaaactcaagtcaaactggcttcactgagaaattcactctaggtgagatctgtcatcaggttggaggggatacaggctgttaggcagtgtgatcggctttccttctcctctctcagctcggctctcctgtgatttccttctcaggcaggctctcccccagggtgatgagatgaccaccagcagctcccggtttccaccctaccaggtttgcaaccccagcaaaaagagaacccctctttccctatccacctaacagaagtcctgccactgatgctctttgaaccaccttaaaggcaggtttctgaatcaatcacaacagccaggagaatggcattctcccatctgccaaacccagtctctcgagtcacccaaaacacatgggctgagaatggaggagaggtcccacctctcccccaaaaaagtgagatactggtctaagaaacagaaaaacgaagcttacataggctaaatgaacccagaagcactatgtggagtttttccttccagaacatgaaccaagtactcaagttacccccagatggtatcagaaggaaggattcaacagtgcccttaaaaaagggccatggttctcaaccaggggtgattcctcctcctcccctcaggggacatttggcaatgacaatggggcagggggttgtgctactggcatctagtgggcagagcctagggatgctgctacacaccttacagtgcacaggacaaccctcacccaaaggattatctagcccaaaatgtccacagtgctgagactgtgaaacccagaattaggatgaccttataagttattgcccaaaccagaatgctttcgagacaggcaaaaccaggaaagcagtcgtaacagggactgttgcagcaaatgaggacatatggttaccctactctcaacacaccgtccaaacagaaggcaaagccattctcactgaaggctgtgattcaagggaaacgtttcaatgctccccaccccaatcatcaattacaggaccacaaagatgctcttcccagccgaggcttgtctttgaccccttctgctctctcccacttccggcatggctgacagtccctcccatctacttctaagaggtcactaaaaatcgaccagggcttgccagcctagtggggttgcccaaatgtctgcccacagatgctgcttcgaaaagctgtctctggcatggcccctactgcagcggcgcgtgacagactgccttgcttggtggaaggaatcccaccccgattaaattgctggagccctgctgggaaggaggtggaggcaggaggagaaggagagtagggagccaggcaagccactcctgcctctcctttttcatcttggaagagccaatttcaagcttgcctcgggtcataaaagaaattaatttgattctctcagccttgctcagagtggacacacgtcttcggctggagcatctgctgctgctggatccagagcaaggagaccatcccctcgaaacgattccatttctgttgcaaggcagggccagaatcatctgcctggagctggagaagcagctgcctggaataccctgggctgtcatttttgctggtaagttccaaaaacggttctcacagctaaggtgactcccaagtctcaggaggtttacccagagagatacgcacgggtggggctggttcttggaaaactcccaaccagaatttagcactggcagctgcctaacccacttcatattgatcagcttgatcacactgagtcctcttaactgtcaggcacggcccctgggctgtattcctgattgcacacagctaaggtgactcccttgtacaagcctccccgcctgagagaggatggaatttgtgacctgcttctaatcaacagaatatggcaaaggtgccgaatgtcactctcttgatcatgtttccaaataagatttccccttaggagacttagggactcccttgctggctaggaggaagtaagctaccatgttgtgacagggccatgtcaaagaatgcaggtggcctctagaagctgatagaggtccccagctgacagccagcaagaaaacaaggcctcagccaggtgcagtggctcacacctatcatcccagcaatttgggaggctgaggcaggaggatcgattgagcacaggagttagagaccagcctgggcaacatacagaaacctcatctctaccaacaatttaaaaattagccgggcgtgaaggcacctgcctgtggtcccagctacttggcaggctgagatgggatgatcccttgaatctaggagttaaaggctgcagtgagctacgacttaccactgcactccagcccgggtaacagaacaagaggctgtctcaaaataataataataataataataataataataataataataataatttcatttaaaagaaaaagaaaacaagaacccagctttacaactacaaggtaagtcaccagcaactgccatgaggacccattgtctaaatcttttaatgtaaaataaaactacattagaaaccacacaaaccaaatgtgtagcttcttcagcctttccttatttttctaaggttgtacaaaactattgtatttacaaaaatggcacaaaagtgaattcagcagtcaattcacatgcatacttccttcacatcttcaacaacaaaaggtattctaactccaactctacagagcttggcagttttcaggagtactggggacggattttgcaggatatatctctgtattagtccattttcatgctgctgataaagacatacctgagactgggcaatttacaaaagaaagaggtttattggacttacagttccatgtggctgtggaggcctcacaaatatggtggaaggcaaggaggagcaagtcacatctgatgtggatggcagcaggcaaaaagagcttgtgcagggaaattcccatttttaaaaaccatcagatctcataagactaattcactatcacgagaacagcacgggaaaaacctgtccccatgattcaatcatctcccaccaggtccctcccacaacacgtgggaattatgggagccacaagatgagatttggaacacagagccaaaccgtattagcctccatttgagtttgtctgatttttttcttttttcatgattagactcaggtcatgagtttttgcaaagaataccacagaggtgaagtgcccttcttttccaagcttgtcactcatccatggtgtggttcaaactttcccttgtctgtgatgttcctgcaactagttctagatttttagactgcaataatctcattataaggtacagagctcattcaagaaggataaggggcatattgatttcctaaggatgattaacaaaacagcacaaacgaggtggcttgaaacaagagaaatttattctctcacaattcttgagggaagaagtccaaaatcaaggggttcacagagctgtaccccgagcctctggggaagatcccatcctttcctttcctggcttctggtaaccataggcattcctgggcttgtagcagcttcacttcaatctctaccttgtgctcgcttcggcagcacgtacattaaaatggaacttcaatcgctatccccattgtcacaagggggtcttccctgtgggtctgtgtccaaatttcctacttcttctaaggacaatctcgtattagattaagggcccaccctactccagtatcacatcttcgtaattacatctgcaatgaccctgtttccaacagaggtcacattctggggtactgagatgttagggctttcaacatatctctttggagaacacagttcaacctattaaataaagcatcccacaaaaccaaagtcagaaagcacagcagggttttgggatagaaagatagcaggagtcaacacagcctgtctctgtctttctgggagctcccggtctgtccttcctaagtctgtattgtgttctcaatctcttctttctttctctctctctctctctctcactctctctcccccatcttctcgctccccatctccctctctccctctctgtctctccgcccccccatgtattagtctgttttcacaatgctaataaagacatacccaagactgagtaatttataaagaaaaagagcggtcacggactcccagttccacatggctttggagatctcacaattatggcagaagacgaatgaggagcaaagtcacgtcttacatggtggcaggcaagagagtgtgtgcaggggaactcccctttttaaagccatcagatctcatgagacctattcactatcacgagaacagcatgggaaaaacccgccccatgattcaattacctcccaccatgtccctccgatgacatgtggaaattatgggagctacagtttgagatttaggtggggacacagccaaaccatatcaccctgcatatcagttttttctattgcaattgtccacaggccaaacatgactatattgtcaccaactttctatccccctctagtttcaagcaccttccagagataagctcagagattttcaactccaaatttctgggagagagtccacatggcctggctgtaatcccatatccaaccccttggtacacagccatggccagagccaaaagaatcctatggggttctggatctcctagggctctgggaagggcaagtttccgaaggaggaatgggggtggacaaaaattattggctgagaaaatagctggtgaatgagacattatttctggtagggaatgaatgcaagaggccactatgttctggagcacagagaaaactcccactggattctcaggaccgtctgagaggagaggaatttgaaagcagctgaattatcacaggagaaacagaatggagtcagaaaaattctgctttgtggcacttagatcaattctacgtctcatatctttgggagcatgggtggtttcccccaccctccattttcctcttctctctgaacaaaagttttagtttgtgaagtcaaatctcatctttttttttttttttttttttttttttgagacagtctcactctgtcacccaggctggagtacaagtggtatgatctcggctcactgcaacttccgtctccaaggttcaagtgattctcctgcctcaacctccagagtactgggattacaggtgtgcaccaccacatcttgctaatttttatatttttagtaaagacagggtttcaccatgttggccaggctggtcttgaactcctggcctcaggtgatccacccaccttggcctcccaaagtgctgggattacaggaatgagccaccacaccctgcccaaaccttgtcatttctgaaatagagtgtcagggtagtgtcttagttagcttgagctgctataacaaattataatagactgtgaagcttaaacaacagcaatttatttctcacagttctgggggctgggaagtctgagatcagggtgctggcatggtcagggtctggtgaggactctctcctggcttgcagatggctgccttctcactgtgtcctcatgtggtggagagacgggtatcatctctctcatatctcttcttacaagggcactaatcctattcatgagggctccaccctcatgatctcattactttccaaaggcctcacctcctgataccatcacattgggggttagacttcagcctatgaatctgagggcaacacaaccaatgtctgttagttcacggcagacagtgaaatagtggaaaggagggtgtgattgattctgggaagggctggtgttgaactctgactgcaggataaagccctcattggttctctgggccccggtaactgcccatctccccaagagggttcccacatccatttcctcccactctgggagtgagcccagcccagcatttcatcaacaactgatctcaggagccaaaagacacagggagaatatggtgatcagggagctgaggaagagggtgaaaaaaggcaaggggtgccaagcaactcaaccagcacttcccctccatcttctgctggatttgctcctttgtctccccagcaggtaggagggattgtccaagacaaagcattggttaccatctttctgtgccaaggctctgggagacaagactggattgcggtcctccttccttattgtacttattgtctaaccttaaggtacttccttatggtaccattttcacacgctgataaagacatacccccacaccccagactgagtaatttataaggaaaaataggtttaatggattcacagttccacatggctggggaagccttacagtcatagcggaagacaaaaggcacatcttacatggcagcaggcaagagagaatgagagccaagcagaaggggaaaccccttataaaaccatcagctcttatcagacttatttactaccatgagaacagtatgggggaactgcccccatgattcaattatctcccactgggtccctcccatgacacatgggaattatgggagctagaattcaagatgagatttgggtggggacacagcaaaaccatatcacttattctgtaggaagaaatgacttccaaggcattctccacccctgtctacatctgacagatagaattatatttaactatatattagtatattactatgacaataataactcatttattcctcacaccaaccctgtgctatccccgtttaaagatgagaaaacagaggcacagaaggtttgagtattatgcccaagatcattcagctgataaatgccatatccatctaactccaaatcccttgtggttgtacagtcagctgagctggcttttggataaaattggttggaggtgaatagagagaatgggttgggggaaagtggtggatgcccccagcaggtgtctcagaaataatgtgttgtcattttcactgtgaatatctcaggctcaagaataaaatcacttttctatataatgatttgcaatagtcatgattctttatgatgaaaatataacccaaatcaaacttgcctaagcaaaaaaatatatatataacataaaattcaccttcaagggatggggctggagttacccccggaagcaagaagaaaaattatgcagagcgcctggtatatccatcagagaccaccaatgtgttcctgtcaccccaacaggaagcagagaacccaaggctgtgttggcaagtagaagaccctagggacccagagggcccagagagcccagggattcccagtgcaaaccctcagatgccttggtgccttaaggaaaaacacaccagcctcatgctgcctaacttcagcaagaaaaaaaaggaccattcccttaatacaagcctcaattgccctgatgccttatggctgttattttagagaattataatgccacctatgattaataccgcaatgtggtcacacagcaaacgctcataagtaacctcccagcataaataccaagaaaatccagacttaccacggcttcatatacattttagatttttgctaaattggcccttgataaagcgtgtggccaccttcatcacagaaatcagcttcctccccaggcctaaaattagaagccccaactgccagtcgttaggtacagagctcaatgcctgctgagattcccctctcatttatcttctgcggggagcatttcaagttatcgccagctctcgtatcagctggcccggggaagggcagcaggcagcgagaggggcagctaacataggaagaggtcagcaggtgaggggtggctctggaggcggtggaactggctggtccctggaaagcttcccgctgcaggtctagagtggagaactcggactccaacagggaagattgtggctgggaagaattacagaccagatccagggctggattctgaatttagatggggcccgtaacaatttgcctaaatgatttatttcaacaatcaacacatccatatgctcagccactcagaatgatgactgaaataaaaatgaaaggtaacaggctgggcatggtggctcacacctgtaatcccagcactttaggaggccgaggtgggaggattgcttgagcccaggaattcaagaccagccctggcaatatagtgagactgcatctctacaaaaaaaaaaaaaaaaaaaaaaaaaaaagagcaatagaaagagagaattggatgcatgctataacagcctatgatggtagatccagctggtctggggaaaaaggagagtatccaactaggcttccccaaggtcatgaatttttttttttttgagacagtctcactctgtcacccaggatgaggtgcaatggtgcaattacagttcactgcagcctcgaccttccaggctcacatgattctcccacgtcaacatcctaagtagctgggactacaggcatgcagcaccacatgcagctaattttttgtttttttttttcttttggtagagatggggtctcacttcattgcccaggctggtctctaactcctgggctcaagcgaacctcccacctcggcctcccaaagtgctgggattacaggtgtcagccatcatgcctggccagatgatgacatttaagctaagactaggacaatgaggagttatccaggtgtcaagtgagaggaatgcatttatacagagatagtaacatgtgcaaaggccctggggtgagaaggagttccatgtgttgaaggaattggaatgttgggaggaatgaaaagggtgtggcaaaatatgtgggctggggagggaggcaggggctagctcaggcaggatgagataaactctggtaagggttgtatgtgctcacagaaactcattaacacttcactgaatgctaatatttatttatcaggtttcagagtctgtttgttcgtgaggggagggttttccatcttctccacttgaatataaactccttgaaggcaatgacctttggttcacagttctatcaccagcacctagaacaagaactagaacaaaggtaaataaagacacccttatcaggcacaatgttgcaaagacttagtggttatcttccaggagccagtgaagggccagacctttcttaggaatgtgcaggatttgaactccccagacctgctgagtcaactctactgcaggggaccatacagagatgagaaagatgcgacattctttcacttctgggtagcagagtcaacaaatggaaccagggtgcccccaacgcccattacctatgacatcttcctctgaaataagctcaacagatgatggtccctggctacagtgacttttgtcagggatctccaagaccgccctcaggcccattgatttgccagaaggacccacagaatcaggaaagccattgtcctcatgaacattgtttattgcactaaaaggatacagattaaaatcaaccaaggtacaagatgcataggtctctccaagagagaccaggggtaagtttccaatagttttctcccagtggagttagaaggatagctcctaatgctctgtattagtctgttttcatgctgctgataaagacacacccgagactgggtaatttatgaaaaaaaaaagaggtttaatggactcgcagttccatgtgactagggaggcctcacaatcatggcagaagagcaagggagagcaaagggatgtcttacatggcggctggcaaagagagaatgagagccaagtgaaaggggttctccttataaaaccatcagatcttgtgagacttattcactgccatgaaaacagtatgggggaaaccactcctgtgattcaattacttcccactgggtccctctcacgacacgtaggaattgtgggggctacaattcaagatgagatttgggtggggacacagccaagctataagagacaattagcaatgtatacaaagtactgccagccacagcagctcccccaagccttggtgtccaggggttttatcagcatttcatcacccaggcatggagcacctgcatgggtgacttttgttactcagtctccagcccctctagaggtcaaactgacacatacaaaaacaggcactcaccataaattgcattgttagcatggactagctagctcagcctgaggccataggtaaacaaagacactcttatcaggcagaatgttccaaagacttggcggttatctcccaggagccagtcaagggccagagctttctttggaatgtgcaggatttgaactccccagaccggctgagtcaactccttactgcatggggaccatatagagatgagaaagatgccatattctttcacttgtgggtagcagagtcaacaaatggacgaggctgaacgaagacagtcaggtagaaccagaaaccacctccacctgcacccctgcataggacctaaaaaaatgtcataggaccatgacaacttttttgagacagggtctcagtctgccacccaggatgaagagcagtggtgcaatcatagctcactgcagcctcaacctcctgggctaatgctatcctcccatctcagcctcccaagtagctgggggcatgcaccacatctggctaattttttgacttttttttttttttttttttggagagatggggtctcacttcgttgcccaggccggtctctaactcctgggctcatcaggagttagatgatcacccagatgaacaacagggacctcatccctccccaggggtcctggggtaggaccctcagcagatgagaggagtagctctcctggcccatacccatgccctgttgtggtgtttataagcctgtcataggtcaggtttctagagagacaagctgtgggatggagatctgggtgcagggggtttactgggaggagcacctgctggaaagcaaggaagcagcattgggcagagaggggagtggcactgtggaacagtcgccaggacccctgagacaccccctgtgatggttaatactgagtgtcaacttaattggattgaaggatacaaagtattgtttctggatgtgtctgtgagggtgttgccaaaaaagattaatatttgagtcagtggactaggaaaagcagacccaccctcaatctgggtgggcaccatctaatcagctgccagcataggtagaatataagcaggcagagcagcatagaagggcttgactggctgagtcttccagccttcatctttctctcgtgctggatgcttcctgccctcgaacgtcggactctgagttcttcagctttgggactcttggacttttgaccacagactgaaggctgcactgttagcgtccctacttttgaggctttgggatttggactggcttccttgctcctcagcttggagatggcctactgtgagacctcacctggtgatcgtgtgagtcaatactccttaataaactccgctttttatatacatctatcctattagttctgtccctctagagaacgctgactaatacactcccatacggaggggcaagggacagagcctttgtaaccctccaggattatgggatgcctaggaggggaggaggatttcccagcactaggtggcttcctgcaggtgccttcttgccagaggcaggactttgctatgagctgttagcagctaggtctcccagcagctggggggacagagggcctcggtggtcctgcacagaggtctgagtggtgcagcacccacagcgaagccagtgaccaaagtggaaagataaagatatgaaaatctttcaactaattaagatttaaaactcagattgatgtgaggatcctgaattgactgtttaccaaagagactaggttttaaatgagaagggtctgggtttacattgacttggcaagactgagtgtcctatcactggagtgacaagggaggctggtggggatggatccagggaaaagaagcaaagtatggaacaaagaagtttagaataaagaaagtggccaaggctgggcgccacggttcacacctgtaatcccagggtggccaaggcaggaagattgcttgagcccagaagttcaaggctgcagtgagctatgatcatgccactgcactccagcctgggtaacaaagcaagaaaaaaaaaaagcaagaaaggaagggagggatggaggaaggaaggaagggagagagggaaagagagagagaaagaggaaagaaagaaaaagaaagaagaaggaaaaaagaaagaagaacgaaagaaagaaaggaaggaaggaaggaaggaagaaagaaagaaagaaagaaagaaagaaagaaagaaaaaaagacagagagagacagaaagaaagaaagaaagaaagaaagaaagaaagaaagaaagaaagaaagaaagaaagaaagaaagaaagaggcatcaaacctcacaggttgaggtaactgtaaatacacggtagtttatccctgagcacaaaatctcaatggcacagtcaaagccccaaagaagtaagaaacaaacatcatttccaccttttgggcctgaagaagcaggtacattagagaagggcagccacaatatctgtgaacagtcattaagctctcagacacagcatcccaccttcaccaatctgatctccttgacgggggtgatgctccctccaagataacaaagaaaacctggccaggcacagtggcccacgtctgtaatcccagcattttggaaggctgaggcaggaggattgctagagcccaggagttcaagaccagcctgggcaacatagtgagacccctgtctcttaataaaataagaaaaaagaaaaggaaaccttccctttacatgaaggcatcataccttaaatgcacatcccatctgcccaggaggctcacctctagatttgtatcctactgatgaacacacaccaagatggacatactagcataaattgtggagaatgacagaaaatatcctgaatgtccaccatgagggaactgattaatttatacacatccgtatactggaatactacacagctgataaaaagaataaggaatgtctatatggactgctatgcaaaaacctcaaagatatattgttgaatgaagtcaagatgcagtgtaatatgtacaatgggctatcatttataaaaccgggaggagacatatatacatatgtttttctatataaagattgtatctctggaaagtttcaagagaagccagcaacacttttgaccttggagaagaagaactggtggttgggatggaaaacaaacttaattttcactgtatactttttctggtactgtttaattttttttttttaccatatgcacacgtttcctattcaaaagagaatttttttgaataggaaacaatgaaaaatcttataggcatacaaactaaattaattagccatccctatagcttcaacatgcatttcaatttgcaagcaccctggcctccaagattgattgattggctgtaaattgagaacctcagcaatttcctttcacagggacagatgttgacattattcctgtgatttttcacagatgtttcccttccagcatctttaaaatcgagttttctgtcaatttggaaatcccaaatttctcatatcaaatcgagatgacaggaaaatcaaaaccgttatcacattttgaaagagtttatggatggcaaatgacactgggaagggagatgtttaaggagcagccgacgtctcttaaccctttctcatcacttcctgcctcagtttacctaagccagcaaaaggggaaatttgattcaatatacagacaagggctttagagtctgcgtagcggtgcgatctcactttggctccaactctctagctgtgatactttgaaccagttcattaacttgcccagcctcctctctctcatctgtaaaatggggataatatccccagccttgcagtgtgattttacaattcactgatgcaaaaatggaaaatgcgtggcacttagcaccacctaaatgttttttcctttttttttccctttccctcctccttcaccaatcctccaagcagcttttcttccttcttcatgtccccattttgctcacgagattccaagatttacccactgaagctctcatgagattcccagatttacccattgttgagaaatcagaaacatcccccaccccctagaattctcctgacctgtgtcccctccccttaggactctgctctccctcagtgacaacaggcaggaatatgatctactcatacaaaccaaacctctgctgtttgtacatcttagctaataatgcccaacacacagccaacatttactaagtcaggctcttgagagccacttcatctgcatgacgccacaaaatcctctcagcaacaaaaaggcactgttattatttctgttttagagatgtggaaatgagcaccagaagtagatgtaacttgacaaatatctgggtggtagatctggaaatcaaagaaccctgaaccccaaccacagacacatcttcagttcaggctgggtctctacgctttgttatttttaacggggcattacgctccctggatggctatgatgctgcagttaactctgctcttgtggatgaatgcaattatctggggagctcgcacttataagatgtacagctatgggcaacctaaggcacatcgtggagtcttaatttcctcatctgtcaaatgagaatagcaaggatggcagggagggattaaggagcatttttggaaaaggaagtgctatgaaatgaacgtttgtgcctccacccccaaactgatatgtcgaagctgacaccctaattaccagtgttacggtatttgggtatttgaagatgcggctttggtgattatgtttagatgagatcataagcctaaggtcctggagatgtgatgtgtccatattagaagagacaccagagatacctttctctctctctcactcttgcttgatctctccctctctctcttgcactctctctcatgcttgcgtgctctctctctcccctgtgaggatacaacaagaaggcttccaactgaaagccacaaagagggccctcactggagaaacaaatcacccagcaccttgatcttcgaattcccagcccccagaatagtgaacaataaatgtctcctgtttaagccacgtagtatgtggtattttgtatggcagcctgagcagactgccacagtagatggttggtctttcctccaaccaataatagatggcttgtcctttccatcgcccaccttgggcaaggcaaacaggacagtgaaggcaagcacatctcacagacaccagcattcatgtgctaatgaggctcactactagtattgcaaagatgggaagtcaaacagaattatgtccttgcgaacatacaataacttggaaaattttattgaaagacattaagtttgcatacacacaaaaatgagtgaagagttttttgttccattgaataatttagaggacatctaagagaacacaagtttgaaatcttattatattttgtataatgatacataataatttccatgataaagctgatgtgtattgaggagatcatatgtgccaagcactcactgtgtgttaagcatattctattcattgtatcatttaatcctcaaaatattatcaccgcctgtattgattggggttttccagagaaacagaaccaatgtctaaacagagagagagatttcacgcaattatggaggctaacaagtgctgtcatctgcagggtgaggcagcaaactggagaccccagagaactgatggtgttagttccagtcctaaggccagcaggctcgaaacccggaaagagcagtgtttcagtctgagtacaaaggcagaaaaaagccaatggtgcagtttaaaaaccttcaggcaggaggaattctctcttacttcggaaaggaccgacttttgctctattcaggtcttccgtggattggatgaagtccacccacattaggaggggcaactgctttcctcaatctgccaatttaaatgacaatcatcccaaaacgccctcacgaacacacccaaaatgatgtttaggcaactagctgtgcacctgtatccctaagagttaacacataaaacctaccatcccatcactctttccaaatagaaaaagtgaggctcagagaggttaagtcacttccccaaagtcacagagcttcttataagtggtggagggtttgactgaggacccatgctctattgtaatcatagaaaatcctagtggaattttccaatagaataaaacgcctgcccagctgcagccaaacgttccatagacaatgtctctgggccttttgtggcagaaaaaccaacataaggaaaagaaggctggagatgccagttttatcaaactcccataaggtaaagggaaatatctttctggggaaaggagactaaaggagaaaattaacagccacttttcagggagagagaaagagcagggacccagcccctctgagactgtgggctgggtgtggcctgagctgattggcagctccattgtaactatactgtaaaggaatgactctacccaaactgagctaaaggagagtttgaagcatttttaaaaactctgcccaggccaggcgtggtggctcatgcctgtaatctcagcactttgggaagctgaggcaggcagatcatttgagatcaggagttcaagaccagcctggacaacatggtgaaacctcatctctactaaaaatacaaaaatcagctgggtgtggtggtgcacacctgtaatcccagctctttgggaggccaagacaggtgaatcacctgaggtcgggagtttgagaccagccaggccaacatggtgaagtcccatctctactaaaaacacaaaaattagctgaacatggtggtggacacctgtaatcccagctacttgggaggctgaggcaggagaatcacttgaacccaagaggcagaggttgcagtgagccaagactgcgccactgcactccagcctgggtgacagagcgagactctgtccaaaaaaaaaaaaaaaaaaattctcagacaaccagcagtgatacaagagataaaaggcatctggctttacgctgcaaacaaaagggaaacaggaagtgagagagcagttggcctctaagaagcatccatttgttttaccctgccaggtgcctacaaggtgatggttttgcctcccaaatataatcaggggcccaatctctgcattcagagaagtatatttcagcaacccataagtaatccaaaagcagttccccacacatcagctcaaacagtgttacaggacaggcattcttggtgccatcagatccaatgtcccatgttttaaccaacaattgaaaagccctcttttttttttgagacagggtcttactctatagtccaggctggagggcagtggtgggatcttggctcattgcaacctccacctcctgagttcaagcgattctcgtgcctcagcctcccgagtagctgggattacagatgcgtgccaccatgcccggtacattgttttttttgtatttttggtagagacagggtttcaccatgttggccaggctggtctcgaactcctgacctcaaatgatccaccagcctcagcctcccaaagtgctgggattataggcgtgagccaccatgcccagctgaaaagctctcttttctaccctgaaaaaaaaaaaaatgtgctgatcctataacccatctactcttctaaccaatcacaattgtgccctaattataataaaaaggagaaatgaaatgatgaggatttctaatgaaataatatatagagaaatgatatgggtttccaccaggaaagacggagcgaagcagtcaagtgctcacacacgtgtgtgtagaataaccagtgacagtcacaaacgcagacagcgtggtgtgttgtcgcatcggctttactgagagtgccatgttcttcaaaagagtggctctttcttgataaattcccataccaaacagagtcaaatcttctcttgatttacaccatagctgctacattcttggaaacatcagtgttcattcaacacttacatgtaaaatagaacatgtaaacatataaaatagaataggcagataaaatagaagaaggttggaccgggcgtggtggctcacacctgtaatcctagcactttgggaggccaaggtgggccgatcacaagatcaagagagcaagaccatcctggccaacagggtgaaaccccgtctctactaaaaatacaaaaattagctggacgtggtagtacccgcctgtagtcccagctactcgggaggctggggcaggagaatcgctggaaccagggaggcagaggttgcagtgagccgagatggcaccactgcactccagcctgggtgacagagtgagactctgtttcaaaaaaaaaaaaaaaaatagaacaaggttatagactctgataatcatggttcttctaacccatatgaatttgggatctacacatatatatattcaaaaaactaccccacaccgtaatgactcccccatccctatcattagggcaaccaaaagctctctgcagatttaaaacacacacacacaaacacacacacacacacacacacacacaaacacacacacacacacacacacaaacacacacacacacaaacacacacacacgggacaattcagtccccagtgagaacctctgtaataaaaggtccaattcctaacccgcaataatattcttttttttttttttttgagacagagtctcgctgtcgcccgggctggagtgcagtggtgcgacctcagctcactgcaagctccgcctcccaggttcacgccattctcctgcctcagcctcccgagtagctgggactacaggcatccgccaccatggccggctacttttttgtatttttagtagagacggggtttcactgcgttagccaggatggtctcgatctactgacctcgtgatctgcccgcctcagcctccaaagtgctgggattacaggcgtgagccaccacgcctggcccacaataatattcttaaagtcccctttcccgcctcctcagttctcccacaattcccagtttccccagaacaaaccccaagagatttctctgcccttccccccacccccaggcagagatgtcttccaactcttccccagcactgtaactctccactctggtcaagtggactccaccttggggaaagaatgtttgtaccgggcaccaaactagactttggagatacactagttcttagtatctgctagtgtgataattaaggtaattatttagaccaggaatctgcaaaatacagcctgaaggccaaatccgagctgcttgttttcctatggcctgaaagctaagaaagaatggttcttacattttatattattattattattattattattattattattattattattactattttgagatggagtctcgctctgtcgcccaggctggagtgcagtggcaccatctcagctcactgcaacatctgcctgccaggttcaagcgattctactgcctcagcctcctgagtagctggaattacaggcacctgccaccacacccggctaatttttgtatttttagtagagacagggctttaccatgttgtccaggctggtctcgaactcctgacctcaggtcatccgcccacctcggcctcccaaagtactgggattacaggcatgagccactgcgcccagctagttcttacattttaaatagttagtgggaaaaagacaaaaggaataatacgtcattacatgacaattatatgaaattccaatttcagagtttataaataaagtattgtctgtggctgcttttgtactacaatggcagggttgcatggttgcaagagagcacatggcccccaaagcctcaaataatccactatctgggcctttacagtaaggttgtcagcccctggcttaggcactaaacaagtgctttcaagcacctactatatgccagacactaaggtaatagagaggggagacaatcaacaagaagcattctttctcaaaagttttaggctaggcacagtggctaaagcctataatcccagtactttgggaggtcgcggcaggagggtcaattgaatgcaggagtccaagaccagcctaggcaacatagtaagaccccgtctcctcaaaaaatgcaaaaaaaaaaaaaaaaattagttgagcatggcagtgtgtgcctgtagtcccaggtagttgggaggctgaggtgggaggatcacttgagcccaggaggtcaaggctgcagtgagccaagccatgatggtgcaatggcactgcagcctgggagacagagtgagaccctgtctcaaataaataaataagttaattaattaattaattaaattaaaagcatgttattcagaatcacatagacttgggctcagctcttcagccataagcatgtttcttttctctttttctttttttttttttttgttgagacagagccttgctctgtcacccaggttggagtgcagtggcacaatcttggctgactgcaacctccacctcgtgaggtcaagcgattctcctacctcagcttcctgagtagctgggattacaggcacgtgccacgatgctcggctaatatttgttttccttttttttttttttttttgagacggagtttcgctctttttgcccaggctggagtgcaatggtgcaatctcagctcactgcaacctcctgccttccgggttcattcgattctcctgtctcagcttcccgagtaactgggattacaggtgcatgccaccacacctggcctaatgtttgtatttttagtagagacagggtttcaccatgttggccaggctgatctcgaatgctgaacctcatgatctgcccacctcagcctcccaaagtgctgggattacaagcgtgagccaccgcgcccggcccatgagcatgtttcttgacctcagtttccccttctgtaaagcatggtgtggattgttcacctcgcatgggcatgtgaatatcaaatgagacatcctgtgcaatgtgcctcagacaaagaaaggagatcagcaaataatatttcctttctagttcatcctctcttcccatgtatgccaagaaagcaggcgagattgagtgagggaggtcatatcctctttgtctaaatgttttcttgttagagaacatctttcttcttaacatcccttcctacataaagaatctctgtcagaggaatattaaaaggccctaacctacagttagatggaaggcgagactccgatctcacagctgaatcactttagtctacctctctacccatctaatgctacccccttcaaaaataataataataatatgaaagttgggaagtggaaaaccatcctctggagttttcaaaaactaattccattgtaatcatagaagactgaaggcaggattcatgacacatttctcttcctcctgggcagatgaatctacaatttgtatttgattttaaatgtgattctcctgcatcttcagtgggtttgattgatagagcacatggggccactcagtaaaatgatacagtggagatcaaagccggaaagataatttttgccaaaatgtctgcagccgacagtgagttataagcctttgtctcccactttacggaacacaattttatttaaagccgaaatctgtcactttggtattgtttattgaaatgcatcccataccacggtcccgtgaagaacaacgtcaagtcaaaaggtaaaaaaatccaatggttacaaacagcccaggaccaaataaaggagggagaatgcttccaatctgcgtaaatattacccaccagtgatgcatttggggcaagcaatgaagtcattcatctgcaaagtaaatatctggcattgtcagaggtgcctgacacagccccataaacccagtgagttctgttccattcagcagctcacacatctctatttgataactttgctttatttatgggtccacaatgggagtcataactgggtttttatctttgcacaacttttttactttattttttgagacagggtctcactctgtcacccaggctggaagtgcagtggtgtgatcacagctcactgcagcctcgacctcctgtgcccaagcaatcctcccacctcagcctcccaagtagatgggattacagaaatgcacttccacaccttgctaatttatattagtttttgtagagacgggctctccctaggttgctcaggctggtcttgaactcctgggctcaagtgatcctcccacctaggccttccaagtagctgggactacagatgcacaccaccatacccagctaatttttaaattttttatagaaaaggagtctcactatgttgcccaggctagtctcaaactcctggcctcaagacattctcccaccctggcctcccaaattgctgagattacaggtgtgagccactgtgcccagcttgcacagcttttttaaaccttttttttttttttgcattcattcacgcttttcatacatcatgattgaggatctaccctgcagactgtatggagttatctagaaggcaggaaggcagagaactaaaacctttggttaaaatatctggggttgagctcagtgtttcctgctctccagctatgtgaccttgatcgggtctcttcacctgtctgaacctcagtttccccactgcaaagtggagagcaaatgagaccatggacttggaaatgcttcatacatttctgagtgcctcacagatatgaagcccaaagatagcaccattctaggctctgtcaggacaatgaggccaaagttgtcactgatgccataaagttgtctctacagcgaaaggtccctggaattagcaggaggcttttgtggagcaaatgcctccttttctgcgtagaaagtgagatgcctcaatcactctgcctagatgcctctagatgcctcaattcctctgccaccaacagactctgtgacattgggtcacttttgagattcctgggtcctgcctacttcaccagaatgtcatgttctggaaccttctcagtctccaacctcatcactcacaagcttttcttatgctttgatagatgctacaattgcttgtcaaaaaaagagcctcatcttctccgttgctaagagaaccccaatttttaaagtattgaacagtcacatgctttaggagaagttgcccttctgagcctcaaggagtgaatcttgactgacctaaactaatcatagtaatactgaccccctgtctagtgattgctttcgaataggcacgtgacccattgtgaccaatgagagttgatggaaatttcctccttgctgtcaacaatggacacaaggaagacacattttctcctctgacctttggacattgaacgttattgtgttaggatgtgatgtaaggcactgtggcacccattttgtgctcattagaggaaaagactggaattaagcccttgctctgtaagtcagagcacaaagatggcaagagcccaggtctttgatgatacaactgaactactgaataaaccaaccctagactcacctacccccaaattccttttaatgtgagagaataatgtcccatcttgtttaagcaatttcaggtttccattacttactaatgaatatatttggattccaagttgttatttccttgcatggaatgcttctgacacaactcacccttgctagcctcaagggtggtggccgaactggggagggtccaagaggaattgcaaaaaacagagctgcaaggagcagccttatctctgaccgctgtggtgagccctccactttgtataccctcccccaaccgtgtgactctggatcagccaatcaggtgatctctcttggcaccttgactcatgatgcaagaacacaggccctattgggtttccatgaattctctgcagggagagcaggggtccccagatcagcctatccctaacgcatgcccttggaggagttgccactataaagctatctggagtcaccttgtatggggtgttttccaaggctgggccttcagcagtgccttcggcatgttctctttctttggtaagagtcagtttctggggtgaacaactgagaactcagggacatagacaagaaatcatgtctcattcttaaaagcctcagcacaagtcctggcatagagtaagtgttgatgggaggttggatgaatgaataaaggagtgagaaagttaattgcttcccttctctgggctgctgtatcaatcaaggttgtggcaggaaatacatagtaaactgaaatggggtaactaaaaagagtttagcaaagggctatatatagctgtataagtgggattaaaaaaaacaaaaacaaaaagggaggttgcagtagccctaactagcagcagtgaggagccatttctacccctagacctggaggggaaatagttatggaacccaaggagagtagccacagtcttcagggaaagacagctgcctggcaggagcttccaacctatggcaacccaacaggaaggagccacagaaataaatatccgaatccctctctcctcccaccttctagtattctatgatccccaccccattggccaaacccaagcagccacaagaggatgggagaccacatgtgatgtagtccatagaagtcagcctcctggggtacaaagcaggaaatgggggtggacagtggatgtaaaggagcaaatacaaaatatccggcacagatattgctatggtttgcatgtgttccccaaagttcgagtgctggaaacttaatccctgatgcaaccgtgttgagaggtgaggccttcaagaggtgtttggatcatggggacatcatctttctgaatggattaatgcctttatcatgggagcgggctggttttcacaggagtaggtgctctctctcaccctctctctcacccatgtgatgccttgggtcacaccatgatgcagcaagaaggccttcaccagatgtaagctctcaacctcggacttcccagcctccagaactgtgagccaagtaaatttctattcattgtaaattacctggtctgtggtattctgttatagcagcacaaaatggactaagacagatagtatctagtgataggatagactacaagaatctctttcacccagatcctgcagccacaaaagggccaacgctctttggagagtttatctctcacccaagcagccaccagcatcatcagcaaacagcaatgttcctctacacgcttgtgtgtttccttcattggtacaagtttccaccattgttttgctcataagagaaaccattctccaaagcccagagtaattatagagcccataagtcttggggctttctgaatttgaagcagattcagggctcaagagagccaagaagtcatatcaatgccaggaatctggaccccaggcagacagcgtggataacctaccccaacagaggtgcaggctctcttcctttcacccaaaaaatagcaaacacatttattgatcaccgtgggccttttccttccacctggaggttagcaggaactttcaaaggtttagtgtcatccatatcccattgtcttcttcatgcacagaaaagacaaacttcttcatctctggaaaggagacatggactcacactccccttattctgaatttttgcccactaagccatttcacaggaagttagccatggtttgtggatttttaaatgcttctgggaggagaaggatttactagtgataagaaataaaaatgcaaatgttttactgatgagatatgcatgtaaagtgcttgatataatgcctgacatggaaaaaacactcaataaacgttagtcatcagtatttatatcatcattccttttaatacacgccatcgactgggtgcagtggctcacgcctgttatcccagcactttgggaagcagaggcgggaggatcacttgagcccaggagtttgagacgagcctgggcaacataagaagaccccatctctataaaagaatctttaaaaattacctaggtatggtggcatgtgcatacagtcccagctactcaggaggctggggtgggaggatcaattgagcccaggaggtcaaaatgaggctgcagtgaaccatgatagtacaaaaaaatagttagaaagaatgaataaggccgggcgcggtggcttactcctgtaatcccaacactttgggaggccaaggtgggtggatcatgaggtcaggacttcgagaccagcccggtcaatatggtgaaaccccatctctactaaaaaatacaaaagttagccgggcgtggtgacaggcgcctgtagtcccagctacccaggaggctgaggcaggagaattcctggaacctgggaggcagaggttgcagtgagccaagatcgcaccactgcactccagcctgggcgacagagcaagactccatctcaaaaaaaaaaaaaaaaaaagaatgaataagacctactatttgctagcacaatggggtgactataatcaaaaacaatttaatcgtacattttagaataactaaaagagaataattagattgtaacacaaaggaaaacgcttgagatgatggataccccatttagcctgatgtgataattacacattgcatgcctataatatctcacgtaacccataaatatatacacctacgatgtagtcacaaaaactaaaactaaatataaaacaacaagcatttatcatctaattgtctggatttggaacccacaagccaactcagctaagtgctctggcttagggtctccaatgaggctgcaggtaagatgtcagccaggactgcagtcatctgagcgtttctggggctgaagactaggcttccaggctcactgtgtggttgtctctattccttactggctcttagacagaaacctcaattcctcaccacgtgggcctctccataaagtgccttagtgtcctcaaaacatggcagctggcttcctccaaagcgactgatccaagaaagagaaagaaagagccaacaatggaagctgcagtctttcatgacgtaatcgcggaagtgacataacatcacttctgcggcattggtcacacacgagccccaacatggatctttccagcgtgggaggggactaaacaaggtgtgaatggcagcaggcagggattgttgcgggccatcttgaaaactggttccctcagaggagagctggaaggctggggacaaggacacaagagaggcttttttatttttttatttttttgagaccgaatctcgctctcgctgcccaggctgaagtgcaatggcgcgatctcagctcactgcaacctccgcctcccgggttccgggaattctcctgcctcagcctcagcagagttccccaagggtacctgttggcctagtttgagactcttggctctgttagtgggagtctcaaactatgctccaggctgctgattgttctgagggatttctctctctttctttctaacactaagaaataggaacttggcctcccagagtgctgggattacaggcgtgagccaccacgcctggcctgtctgtaatctttaaaagtaatagcatattagctctgagggtcggttggattttcttttttaaacagttggcagtcatttgtagccaagtcaggtgaaaagggtaggtgatcaagctcattacaatttttattgaaataaaatttatctttagtaacgagattgattttttgtgtgtgactccggagggcagtttgcccagagcagtggttttcaaactcttaacaaactatccctgagaggaaaagagaatgaattcatactctgtggagtgtagcccaaaataacctctgcaaaggtgaaattttctttgaagtcttattttaccttaggtatttgtgaactctgcgttctattttgtgccacatgtgttttaagttactattactctactaaagtttattcatcctccaggaagatgatgatgtttgtactgtagttttttatgtcccagggatacagcagggttccccaagggtatctgttggcctagtttgagactcttggctctgttagtgggagtctcaaactatgctccaggctgctgattgttctgagggatttctctttctttctaacactaagaaataggaaacacagttttcagtttaaaaataacataattacaaagtgtagaaaagtctctcttggccgggcacggtggctcatgcctgtaataccagcactttggaaggccgaggcgggtggatcacgaggttaggagtttgagaccagcctcgccaacatggcaaaatcccatctctactaaaaatacaaaaattagctgggtgtggaggcaggcagctgtaatcccagctactcgggaggctgaggcaggagaatcccttgaacccaggaggtggaggttgcagtgagctgagaatgcactactgcactccagcctgggcgacagagcgagactgtctcaaaaaaaaaaaaaaaaattacaggcaaaagaggttgcccatgttctcatcattggcagcagcagcatcaaaatatggcacccactccagtgatgcctttccagaaggagcaacactcatgtgaaaccaccagctttgctttgtttttgtttttgttgttgttgttttttcagagagagtctcactctgttgctcaggctggagtgcagtggtgggatcatagctcactgcagccttgaactcctgggctcaagcgatcctcctacttcagcctccccagtagctgtggctacaggtgcacaccagcacgccttgctaattcaaaaaaagaaaaaaaagaaaagaattgtagagatggggtctcgctatattgcccaggctggtctcaaacttctgacctcaattgatcctcctgccttggcctcccaaagtggcaggattacaggcataatccagccattgtccctggcctggctttttttttttttttttttttaatgtagctcatgaccacaaacggagtttggtttccttgctctctctttttcccatttggtacttttctttctctcccatgcactcctcttcaaaccaaaagtgaatcttgttatttcttgaaaaatgtgtagatgttgaagggatgaaaaacctgaactctaacgtctgactatctgaacccaaattctagccgccccactcagttgctgtgtgaccgtgagtaagttcttaccctctctgagcctgtttcttcacttggaaaataaaagtatacacatatacagctgttagccagaactcagcctagggtaacctttcaataaatattagcatcatcaaggaaatcgcttgacaaattaattttcattaagcaatgagggtctataacagtgatgacttctgaccaaccaaccagcccaatggctgacaaaggactgataacactttacatttttataatttccctagatttcaaattctccataaggagcaagtacagtttttataatcagacatagaactcgcgttcactctgctcatcctgaccctagccactggccaccaatttctgggttggctgctccaacctgagaacacagctactggaatcagaggcagaggagctcctcttgcgttcgttgttggtttcccttggttttgtaaaaataaataaataataaaatagggatacacccttcagacagcaggtaacttcctaagctaagatgaacaggaggaaatttaaatgtctttccccggttcaaatcccctaccctctcccatctgcctaccctgggctccaacactcgggagaaagaccataagtcgttcagatgatgctttggagctggacaatcaatcgtgatcaaaaacaggggcatgggagcctggctaacgtggagggatgggagaaaatcaggctgaattagagaagggtacattgtggagtgtgttttacaacgccattagttctaagcacataaggatttcaaatcaaggagcatccacacacacacaaactcttggattccttaagagataaggcggatccaaaattagcatatagatcagaggcatgcagttgagtgctgctaaagtgggctataaatgcttgggggaaaatagttgtttttctgaagaaactttacaacattccaaaatcttgtccaggaagtgtgaactctaagtccaatggactgaactgtgtcccctcaaaattgatatgttgaagccttaacttccattatgatggtattaggaggtgggcttttttggaagactattagtttagatgagatcatgaggatgaggtcttcgtgatggaattagcatccttacaagaaaagacaccagacggcttgctctcttgctctgtctctcctcttccctccctccctctctacctccgctccccccaccccccacttcctccgtcatgtgagaatgcagagagaaagcagctttctgcaagccaggaggagggtccgctgggagctacatcagccagattgtggcacttctcagcctccaaaactgtgagaaatagatttctgttgcttaagccatccagtttatactattttgttatttgcagcctgatatggttcggatttgtgtccccacccaaatctcgtgtcgaatcgtaatccccagtgttggaggaggggcctgggggaaggggattggatcacggggacagacttgccccttgctgttctcatgacagtgagtgagttctcacaagatctggttgtttaaaagtgtgtagcactttcccctttgctctcttcctcctactccagccatgtaggacatgccagcttccctttcaccttctgccatgattgtaagtttcctgaggcttcctcagctatgcttcctgtacagcctgcaaaactgtgagccaattaaacctcttttctttataaattacccagtctcaggtatttctttataacaatgcaagaagagactaatacacagcccaaactaactaagacaaacccactctgacccattctgacacccaaactaactaagtcctggtttgaacccttcactattgtgtcaccttggggcaagtcacccaacttctccaaatgtttgtttcccaccaggaagatggaaatgacagtacctctccttcctaccccgcaaacctatcaggaggatcgaaagggacatggcaagcaaatactttctaaactgtaaagtgctgtgcaaatgcaagacagcattactctctttttatggagttatttatactctacctggttacagcagaggatttatggtagatgtcagtaagactctttattttgaattttaagagagaaataagaatctttgttatctgtagagaaacaaatataatttccatggggcactaatataatataatataatataatataatataatataatataatataatataatataaatataccttaccgaataaaccctttgctcagacgtagtgaaaaggtaaattccccttcaacctaatgaagtttcagtcgctcacattttctgaatttgccgaacagaaatgcgatcaggtgcctactaagtgcagtacccagcacgatgtctaacattgaaacatacagtgtatacaccagcacctccaccaaacccatatccagcatgcaaaacatacccttttcaagtcggaagcacatagatagattttttggagttcaaaaggtcttaatgcaaactggctccaattccttttttttttttttttttaaatctttgaaacattggttaagtcttctcagagctatcattttgcacacatggaaactttagaccatccatccttcaagtgtcttggggtaattagagatactgaaggttaaggacctagcatactactaatagattttcaacaaatggtagctactgttatttctcatcattgcagatttaagagtgccaattctcagagcacttcagataaaaaccctacctttcttaaggcaaaaaacaacggcattaacttttttttttaattaacctaagttcccattatgtttagagaagagatcacaatgataaatgcttgccctgtctctcttttttaaaaatttactgttcttacatgtgacatatactgtggtacttagtgtcaccctacaaagaataaatttaaattgaagaaacagaaacacgggagagtccttgtttgggtttaatttgtatctgactacaataaaattctatcctggaagctagagtcataaaactaaaagtcaggaaggaaaagaatggctaattaagctccaaaactaaaagctctttctttattgctatttctttaagtcctaacaattggtcaggcacagggtcttagctgtgccattctagttaatggtcggttacaaatttccaccataaactcatcttccttctagcaacttaaatctcaggcactgggatgtaataaggagagaaagctcttaggcccagggcaatctctctctcaatcccaatctcccttccccccatccctatcccaccacagtaactgttagtaagagcttttggttgcatgcccagaaatctaactctggctaaattaatcaagaaacgaatatactggtttacccagctgaggtcatttacggaaagggaatgctaaggtttgaatgtgtctcctccaaaattcatgttgaaacttaatccttattgcagtggtattaagaggtggggccttttaggaagtgattcagtcaggagggcttggcccttaaggaatgaattcatgccttataaaggggtagagggaactaacttaggcccttttgcccttccaccttccacatatgaggatacagcattcatgccctccagaggacacaaggcaccaccttagaagtaaggaacagagccccttaccagacacaaaatgtgcctgtgccttgatcctggactcctcagcctccagaacggtgagaaataagtttctgtcctttataagttatctagtcttgggtattttgttacagcagcaaaaacagactaagacaggaagagaaaagaaccagagccccagggactagaaacaggactcactgcctcaaagtacatgtatactctctctctctctctctctcgctctctctctctctctctctctctctctctgtctccatttctcttcactgtttgtctttgctcagccttattctccatctctctccatgtgggagggcaagtagaggctggcacctccagatatatatcctctctgttcaagaaccacaataagttaatccccagggaagattctgatgcctgtgccactccaaggtccaacactgctgggtggatagagcctgatgtttgaccagatatgtgccacttaccaaccatagcagacactggcaatggccacccatgtcccttggaccctccccatcccatacaagctgaaggcctccctctgcaagcacctgcaactccccacctgaaggccttttctcggcctcggcaagacaggccagaagttcaaggatgtcaaagtccctgagagaatcccttggtcaatgtcagatgagtgatgaaagataaatatctcagttttctcaacactcaggtgggacactttgaggtgtgttccatgccatcaaccaaagcccatcaaaaggaccaagccccggctgcccatagaagtaacttactcattaccttgctctattctggtttagatttccttgtctcattttgccctgtgatggttaattttatgtgtcaacctgactgggacgctgagtgcccagataattggtaaaacattattctgggtgttcccgtgaaggtgttttcagacgagattaacatttaaatcggtagacggaggaaagcaggttgcactccagatgtgcgtggtcctcatccaatcagttgaaggtctaaatagaacaaaaggccaacccttgcctgagtcagagagatctcctcctgcctgagggccttcaaactgaaacgtcaaaattttcctgcctttagactcaaactgaaacacggctctttctggatctcaagcctgctggttttcagactggaactacaccactgggtctcctgggtctccagcttactgactcattctgcagatcttaggacttgtcagcctccataattgcatacacacacacacatacacacacacacacacatatatataaaagtgcatatagatacatatatgtatgtgaatgtatgtatataaaagtgcatatagatacatatatgtatgtgtatatatatatacacacatacacacacatatatgtgtgtgtgtgtgtgtgtgtacatatacatgtgtgtatatacacacacacacacacacacacacacacacatatatatatatatatatatatggaccatagagaagtctctaagccaaagctggggacaggggaatcctgtgtctccttgggagaggtctgctttagtgtccctgccatgctcagtcattagccaggagcacctcatggaaggaagcatatggattccccatatgcttatatatgtgtgtgtgtgtgtgtgtgtgtatatgtatatgcatatgtgtgtgtgtatgtgtgtgtgctattctattggttctacttctctaaagaaccctgactaatacactcccattctcctactggtgcttcccagagtcaccctacaaataaaccattacatggaaatcctcatcacaggatctgcctctgggaaaacccagcctaagacatccatgactttcataggagaagaaagagctctagaattggcagccttactgaaccatgtggaagaggaaaggagagcacctaaacaaaagggtattaaccaattaaaataacctaaacccacacttgtccaaattgctgagcaagtgggatgggatgaaacaactttcaaccagtgtccaaatattgctgtgactcctagactggcttgacacaaaggcagtgtccaccagctctaaacatccatctcaactaagatttctccaggaaggctagaactgacaccctctgcttaggttctcagtgacttcacccagccagcaaaggagctcttaggaaggcagacaagccctgaagtctgtctgctcagactccagctacctgctctattcctgctttatcaacctctagcttagtcgctcaatctccagctttgctccttcccattagattctatggctgaacctgactgccatagtttgtttctcagatgaatttaaggcaagggttgcaaacttaaatgcacacatgggcagacaagtaacacaaatgagtgaagagtacagattagggcaactgggtctggtggagactgtggcaaactagagagcacacaccctatctaaggaggcagcgaggactcaattttgcaagatttgtggaatggactcccaatgttgccaaactgccactattttttaaagagaagcaggaaatccaggggtttttaaagatgtaaaatacacagtttgttgaatgctggcgactgatttttttttttttttttttgagacaagagtctcactctgttgcccaggctggagtgcagtggcatgatctcagctcactgcagcctcctcctcccacattcaagaaattctcctgcctcagcctcctaagtagctgggattacaggggtgcaccaccatacccagctaatttttgtatttttagtagagatgaggtttcccccttgttggccacgctggtctccagctcctaatctcaagtgatctgcctgccttggcctcccagaatgctggggttacaggtgtgagccacagcacccagccctgattttttttaatgtaaatactgtatgaacccagacaaatgttctgccaggccagtgctgcatggctcaccacgtggtggccctgagaatgggcctcatcgacctgcctctactgggagtgtaattaaccagggccccagctgctgcgctggggaatccatatgcttccttccatgaggtgctcctggctaatgactgagcatggcagggacactaaagcagacccctccccgggagacacaggattcccctgtccccggctttggcttagggacttccctatggtgttcgcaccctaacttttttctcctctctcttttactcagagtcagacttgcattactgtctcaggttctcccagctttatgtggcaccttctttgctttctctcaagggcatttcccttaataaaaatcacatatgtgtaatcctgtatgggagtttgtttctcagaactgggctgacacaccatcttgcaaactctgctttcggcattcagctcacacttacttacaccctccaaactccaactatttagggctaattccattccagctcccacccgttgaatcccttccccctccccctgcttcctcctcccattctgctttcctggaaacagcatttccacttacttttgaacaatggtccttccttcactgttcattcatggagtttggatagcaccatcttctaaagctagggctgagcacatgatcaggactgactaatcaccctcttctacttccttagccacaataattcgttcagagatgggcacctgactcttacaatgcaatgagagtcagcttcttatgccagtgcttttggcaaaggtaagttcattttcccctgggattactaagctggtaggaggtaagtcagcagctgctgatggcataagaaaagggcctgataatgaagccaacatggatgaaaagagagctgagaagtagagatcagacagatttcaaagcatatcatttaagcatctggatccagccatacttgaagtccagtctatctgtgggctttgaagttgcatggaacaatagcaagatgtagctgagagagttttggctaatataccacctcacctctcattcagtttcatggaatataacagacattgccaactaaaatttacaaacagcattgatataaaagctccgccatttaaaaaaggaaactttctattctttcactgtgtggccttgggaaatttctaatccgttctgaacttcagcttttttccctctcaaatgtagcaaatacaacataacttgcttgccatggagggaaatcagatgcccttatctaggaaagtaaagatagaggtataaaacattgttatttcaaaaaaaaaaaaaaaaatccagcacataagtctaggagcattgaacaagggtcagattgcatggattcagattccagctccattactaactggctgtgtgaccttggacaactcaattgacctctctggccctcagtttccttatcagtaagacggaaactccaatcatatctattgcacgggatagttgtagaaattaatagatacataagtgcttagtgcaacatgtggcactcaaaatatgtgtggtatgattgttattgacacaatgtttgacccatgaatgattgtgatgccaaccccctcacagttggaaatccacctataacttttgactcccccaaaacgtagctactaatagcctattgttgaccagaagtcttaccaataacacaaacaatagacacatatgttgtattttagatgattatacactgtattcttacaataaaataagccagagaaaacaatatatgattaagaaaatcataaggaagagaaaatgtatttgttattcattaagtggaagtggatcatcataaacgtcttcatcctcattgtcttcacattgaggagactgaggaagaggaggaagaggaggaattggttttgccgtctcagaggtggcaaaaacagaaaaaaatccatgtataagtggacccatgtggttcaaatccatgttgttcaagggccaactgtatttatattacaataaatgctgttaatgttgtcactgttgacccttctattccattcccaacatcacttcctatgcccagtggaaaattccatcttaaaatcacccagcccaagccctcttcagtagactcagatagatggcttgtcaagggcatgacttaacttctccaaacacaaccagcccagtttcaactgccatttggggaactttcccaattaccacatttccgcacgtcaagtatgaattactttaattgccccagaagaacgcactgttgaaacatttgacttgcccagaactaattgtctgtcaaaaagatattttgcagccaagctgatctcttaattggacatctaatttaactgaaaacctttttccctgcttgttttatgctttcttctcctgtttttgccaaattctggatgctgggcactgctttcagaaataatttatcttgttattttctattataaaagtaatacatgttcattatagaaaaactgaaaaaaaaaattccacatgaagaaaaacagtggatcctagactcattgcccagaggaggactatgaacattccacatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaagactattaacattccacatgaagaaaaacagtggctcctagactcattgcccagaggaggactatgaatattccacatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaggactatgaacattccaaatgaagaaaaacagtggattctagactcattgcccagagaaagactatgaacattccaaatgaagaaaaacagtggatcctagactcactgcccagaggaggactatgaacattccaaatgaagaaaaacagtggatcctagactcattgcccagagaaagactatgaacattccaaatgaagaaaaacagtggatcctagactcactgcccagaggaggactatgaacatcttagcaagtctcccctcaggttgtcctagaatagatgtctctacgtagttaataaaaacatacattcaagttttgcagctttttgttccactttacattttaagttgaacgtttacacttcccattccaagatcttcagaaacatgtttagaaacagaagaatatcccaacaacagtctgtttaacctcttcccctaatgctgaactattgttgctttaagcatacattttctgtgtgtgtttcagatgtagtttccttaggaaagattctctatgctgtgcaacaattccccatgtgtctcttacatttctgcacatcttgtgtcagcatttgttctagaccgtctttataaggatgtttgtatagctaatagcattggaagatagggctaatatagtagaagacagatttatttgctgattaggattataataataatatctccggaccaggcgcagtggctcatgcctgtaatcccaccaatttgtgaggctgaggcaggcagatgacctgaggttgggagttcgagaccagcctggctaatatggtgaaacccccgtctctactacaaacacttaaaaaattagctgggtgtggtggtgggtgcctgtaatcccagctacttgggagacaggtgggagaattgcttgaacccaagaggcaggggttgcaatgagctaagatcataccactgcactccaacatgggtgtgacagagcaagactctacctcaaaaaaaacaaaaaacaaaaaaagaagaagaaaaagaaaaagaaaggattataatgacaatgtctccctccatccagggtaaaggttgaaaagaccaagattcctaaacttggggttcctcaggtgtgatgcaaatccactgcaggcacagattctacctggatccatccgtgtattactcatttctcacactgctaataaaaacatacccaaggctggatgtggtgtctcacacctgtaatcctaacaccttgggaggccgaggtgggcagattgcctgagctcaggagtttgagaccagcctgggcaacatggtgaaacctcatctctactaaaatacaaaaaattagccaggcattgtggtgcacacctataatcctagctactcaggaggctgaggtgggagaatcgcttgaacccgggaggtggaggttgcagtgagccaagaatgcgccactgcactccagcctgggcgacagagtgagattctgtctcaaaaaaagaaaaaaaaaaggctaggcatggctgtaatctcagcactttgggatgctgaggtgggcagatcacctgaggtcaggagttcaagaccagcctgaccaacatggagaaatcccatctgtactaaatatacaaaattagctgggtgtggtggtacatgcctgtaatcccagctactcaggaggctgaggcaggacaattgcttgaacttgggaggcagaggttggggtgagctgagatcctgccattgcactccagcctgggcgacaagagtgaaactctgtctcaaaaaaaacaaaaaaacaaacaaacaaaaaacataccctagactgagtaatttataaaggaaagagatttaattgactcagggaggcctcgggaaacttacaatcatggcagaagggaaagcaaacatgtccttcttcacatggcggcagaaaggggaagaatgagcaaaagaagaaaaagccccgtataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtgccatgaaaaataaagtcctttatctctcaatccagagtctcatgtcttctgcccacatccataaaactcactagcctccatgtaggataatatcttagaccagcacagttcttgacactctagaagtgaatttgttggatcaaaaagcatgaacaattgctaaaactcttaatatgtcttgtcaattagctctccaaacaaatatgagtcattgcctgaaatctcttttgtcctcaggaagggatagagctgcttgactcagatctctcaggtggccttagactgtaatgtcttcctttcgtgcagagctcttaccatcctaagccactacacctacctaatattctataaaaagctttttctccctacccagtgtctccaatgagctgactttcttttctggattactcttttatgtaataaaaagtagacatgagggtcaaacagaaagggaaaaaggggaatttgtttaatttctaccaagtgccaggcatagtacaaagaacatttagataaggcagaaggcattaattatttttatctacccagaacccactgccccacctaagcaccccagcccctgacctggccacgtgggtggctatgtgacctgagctgaaccaatcagagtccttccctgggatttttttcacatcataaccacatgagaaggtctcccattatgaaacagagaagcttgttggcagccatggttctagccaaggatggaaaaaacaaccaaaaaaagaaaagaaacaaaaaaaacccaccatggtaaaaaaatacatatataaaaataaaaaagatatgaaagacagacagacatggggaatggtctctttccagttgcccctgccactcaactgctctcctaccttcctggatttggttatgagagtcaataaattatccccttttattgcctaaatgacttccatatgagtttctgctccttgcaaccaacataatcttgacaattaatagtagctagcattttgtgagtgtttactgtgccatgcccattaatacacctaatcctctctacaattggacaggtaaggtgcttttagtaacctccaatgtacaaaaaggaaaacaagttgggtgaagtgaaatgacttgctcacagtcgctgggctaacaagggggcagagtcaaagtttaaagccagagcccatactcttccctattgtataacacagacatgctgtctctgttcccagtgctggggaatgcagagaactggggactgaaggaagagcaggcgttcaggtaagcattaatcaggggaccttccacaagggaaaagggagtactggcccagttgaagtccagccagcactcagcatggtcaaggatggggtggtgctctctccagccattcaaggtgctgagaaaagaacagaactttcatctgaggaatacaagccttttaaattattaggcccagagaggcaatagaacgagatagcaatcatgtcctacataccccctttgagctcggtattcatttcttaaaactgcttgccattgccacaagtagctataaattaatctaataatgccccactggatgctataacccacacctcatagcttaacaatgtatagccaatcactcgtcaatgttatttctgaaaaccagtgagaattcctggcaaccaactgtgtaccagcccactccatgtcccccttttttgcctttataaatccacttgtaactgctgctaattggagtgtatattcagggaaacttgaatctacgctccctggctacagtcctcaagcttggcccaaacagagtctttacttatattaattttgcctcagcttcttccttttaggttgacagtgctacaggctgaattatgtccccctaaaattcaaatttgaataaatgttcaaatatgaatttgaggccaggcacagtggctcatgcctgtaatcccagtactctgggaggccgaggtgggcagatcatcttaggtcagcagtttgagaccagcctggccaacatggcgaaaccccatctctactaaaaatacaaaaattagccaggtgtggtgacgcatgcctatcatcccagctacttgggaggccaggataggagaatcacttgaacctgggaggtggaagtggcagtgagccaagatcgcaccactgcactccagcctaggcgacagaacgagactgtctctctctctctctctctctctctctctctctctctctctctctatatatatatatatatatatatatatatatatatatatatatatatatatatgaatttgaagcccttcaaccatatggatcatatcttgaagccctaaccccctagcacctcagactgtcactgtatttggagataggggcttgaaataggtgattaagtttaaacctatttagctcatttagggtgagctctaatccaaccagactcatgttgttataggaagaggagattaggacacacagagagacaccagggatggacaggcacagaggaaagaccatctgaggacacaccagaatcgaccatctgcaagccaagaggaggtctttggaggaaccaaccctgctgacaccctgatctcagacttccagcctccagaattgtgagaaaattaatctctgtcatttaagccacccagtctgtagtactttgttatggcagctccagcaaactatatctacaggaatccatcaccacttatgacaggctctgccacatagtaggtgtgtgtgcacacaccacacacaaacatgtttagaatatgaaatccgtgaaccctactcccacactgataacagttcaggaacagttgattttccctcagggaatctggtttgttttcctagtttccatcccatcaagaccccttcccacctgctgggaaatacttgcctgaacccctcgttcctttcacaacacacacctgatggtaggaagaagcttccaactctgatattgacagggtgcttgtaacctagcaccctttctcctaccttgttatggaaaaataaatcctttatcctatttcaactacagtcttggcaaaggaaaaaacaaaacaaaaaaggaaaccagcctagaaatggaaaccaaagatcatgaacagtgctatgctgagttacagctaagggttggcctttctggagctggctgccttcagatggcagggctctgagtgtgtgtgtgtgtgtgtgtgtgtgtgtgtgtgtgtgtgtgtgccagaagcacaagatgacacaccctgtggtggggtcaggcaagctgattgtgggaaaggtgggaacagaatattttacaacaatgttggaaaaatgggtttacattctctgagaggaagatacccaaagcttcaagctcacctcaagggaaaattgagctaggtttccatgctctccacttggatctcacgcacatgaacacacatacaaccttctcctcaatattcacaagaggcctctgttgtctgcttctccagagagcggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaattttttttttttgtagagatgggggtcttgccatgttgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattataaaagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgagggccataaaggctccaagctagatggatattgggggagtgggttagcagagatgtcctaaaacaatgaattacactaatgggaagaacaaaaggtaagtctaatcacagatgtcttggttttcaagctagtcagacttcagataactgtcaaatcttcagccataaatcgaaagtggaggagaattaaagatccatccttgtttgcttacagaatttacttaatttagccactctatccttaattgatagcaacaggttttttcaaaatagtcaaagtaatctatgctttgctacataatagcaaaagtaatagccaacattcatcaacacctactatgttatacccttgacagggtttcctattttagtagtcaaagcaatttcatggagtagcaattacagttgtaatttcactagtgagaatgcagagtgaggctcagagaggttaaggaacttacccaaggtcacacagctagtgagtggagagttggaatttcatctctctgattttaaagtctgggccctttcctctactgcctctctctgaactcaatgacacatcctaagtaagtaagggcttctacacaggatgtgttagactatgctgcagtaacaaacaacccctggatctcaggaacttaaaacaaaatttcaggctgggtgtggtgtctcacacctgtaatcccagcacattgggaggccaaggccagtggatcacttgaggtcaggagttcgacaccagcctggtcaacatggagaaaccccatctctactaaaaatacaaaaattagccaagcatggtggtgggtacctgtaatcccagctacttgggaggctgaggcatgagaatcacttgaacctgggaggcagaggttgcagtgagccgagatcacaccattgcactccagcctgggcgacagagcgagactctgtctcaaaaaaaaaaaaaaaaaaaaattctagaaataactccaaccttattttcttgaacacgactcatcctgaccctccagcactccattgatctgggctaaatatatggaatcctgcagatgaagacaccagcacccaaagctaatgggacacagaaaacagaggccactcaaataaatgtcagcactcctagttactgaatactctgtgtctggcaagtttcatcattagtcagttattcattcactcaatcaacaactacttactgagttaatatggcagcatggttatgagcacagactctggagcaagaggtcctaggttcaaatcccagttaccctgcttatcagctaaatgacttctcagtgccttggtttctccatccagaaaaatggggattataattaataattgcctacctcattgggttaagtggataaactaagaacagtggcatgcccatatgacatgctctataatttttattatcactgtgtgccaggcattattctatatgatggaggatgcagctatgaatagggcagacaaggtgcctgtctttacagagcttctattctagtgaaggagagaggctttattagcgagtaatccttgatcgagccatacctgaagctaatgccacatccttcaaccttccaatttccccaggcattaagttcttttttcttttctgcctaggctagcttgcactgagtttctctcccttgtgaaccaaagtgtcctgaccagtacagaggtctaaagcctaagctctttccagtctgccccttgcccctttccagctgaagccctattcatttgcacccaacatcatcattgcgtccagtgcctcaccacttggtgagacccttgaatattcaaaccagcgtgtaagcagagagttaggaactataaacagtaaattataacaagcatgaaatggaagcctgctgctgatcattcgcaagagagcaatcaaatctgtcttggtgcctacatgttttatggaaaacatgtctatgttttaaaagtgtttttgaaataaaaaataatttactaactaaattagatttccacatgttttatctagttaacccatcccttatcataagaaacgtaacttctttttttttttttttttttttttttttttgcgatggagtctcactctatcacccaggctggagtacagtggtgtgatcccggctcactgcaacctctgcctcctgaattcaagtgatgctcctgcctcagcctctcaagtagctgtgattacaggtgtgcgtcaccatgcccagctaatttttataattgtagtagagatggggtttcaccatgttgaccaggctggtcttgaactcctgacctcaagtgatcctcctgccctggcctcccaatcatggtgggattataggcttgagcccctgtgcctggcctagaaagctaacttcttaattgcaagctactttcatcaatataatgcatttgtctcactccttaaaggactcctgtcacagtggattggcaaagaacaggtcagacacaagaggcagtggagtattagtaaaatacacgtggatttggagtcagaccttcctaggtttaaatgctggttttatcgcatactagttgtatgccttcattggggtttcccaagaatcagaccctgagacaagactccaagagtaagtcatctatgtgggaggtaaatgaaacatgacacaggaaatgaaataggtcagggaggcagccagtaaagggcatattataaaacaagttactacttgggacaataactggaaaacttgctggaaaacttgctggaaaactctaggatacagtgtagaacatctctagcaatgtgctggtagatgtttaacaaccaacactgcagaaaaatattaaaagcccagatttgtagtgtctgcccatatccatggtgtaaatcctcccaccatggctgatttcacactaccttgtccctgaacaaggacttggggaaagatgcacataccagctcttgcttcatagttatctgacctaaggggtgagggagatggggtacttatccacatacaccaactctcatcagttcctggtggagggatgctcccagggcaggtgttgattcctccaagacttccaagccatcatacgggtgggcaaagacagtacaaccagaaaaagacctcagaaagagggccaggcatggtggctcacgcctgtaatcccagcactttgggaggccgaggtgggcggatcaggaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaatagctgggcatggtggtgcatgcctgtaattccagctactcaggaggctgaggcaggagaattgcttgaacctgggaggtgggagctgagatcaagccactgcacttcagcctgggcgacagagtgagactccatctcaaaaaaaaaaaagaaaagaaaaagaaaaagtcctcagaaagagaatgcaactacatttggatgggtcagtggatgcttaagaggtaaagggttagaagatacaagggaagcactgaaagcatctgttactctgtgcaattgtgaaaacgttatttcatttctctaggcttccaatattgcattggtaagatatgattcattgaatcttccaacaaatactcatggagcacttagtatatacccagcaatcttcaggccataggaaacagaatgttgagttaccatgacaaagtcactgtcacagagccagtggggaaagcagcctctaaacatgccacccagtaagtaacaaagatcatttcgggaatggtgaggactatgatgttagagagggtgatgggagggagaataatgtagcggagaggacatgaacgggaaaatctttctgaaagggtaacgtgtaaggtgaggctcaacagatgagaggaaatgtgttgtaaaaagatctgggagcagcattccaggtggaggaaactgcatgtgcaaaggcccagaggtgggaaggagcttggcttgttcatggaaaagaatggaagccagtgtgtctagatcaaaatgaatcaggcagaaggtaagcaggtaaccaggaaacagagtggaggggcaggcaggaatcagtgtctgcagtgcgtgctcagcatcataaagggtttgggtagtaacacaaccctgaagagttgttaaatgagctcccatgcatgtaactggcattactcatgttattaacctgggaaactgtcacgtctcttacttttccatttaatctcatgcccatcctctttgctcacaggagccaagaagtccagtatctcactccacatctgccttctcgtggtccaacactctgccgactcagttaatccaaagatcacttccaaacttcaggctgatggaaacctgaggagtcggatccattcataggcagccccattttcaccttcccttgtccccgaggctgccattaggttgaaaaccagtctggtactgtcagcgtgtctttgtctacagctatgaaaaagtccacatagtccagtctctacatagggcacaatgattctcctctacatctcagctaccaggtaccagcttgtcgaacacacatgcaaacattcaaacccttctcaggttcccctctagggccttcagggacttatccggcatacctgaggttggggccattgcaatctattcttagtctagtgttaagccgggtcaacagcggagatgctccttctccttgaactaattttatttccagagtttcattttccttccctgcaacattaggcatcatttggggatatttttatccatccatatggatttcaaaatctcataaagaaggagctgggagaagaatgaggaatcactgattttaatgactgtatttgttgatctcttactccattcctggacccatgttgaataacataaatatatatgcatgtacacatgctatacatggtatctggatgctatatgtgttatatataacatacatgttataatatatgttagatatgtatgtcatacatatcataatatataattatacattgtatattatatattatactattacatataatatataattatacattgtataattatactattacatagtataatatatacttatgtttatataataaaatataatgtatatgaaatatacataatacatatatgatatattatataattatatcatataatatataattatgtatatttcatataccatatattttatcatacataaatatataagttatatataatatataatgtcatatattatataaattataattattatatattatataaaacatatattatatataatacatagtttatatgttatataacatatataacaaattatatattatataacgtgttatataatataacatattatatattatataacgtgttatataacaagttatgtaatatacaatatgttattaaaaagatattacagaatatattaaataatgtatgttttatatattatattatatatgttttttatatattatataatatatatgttttatatatattatttttgttttttttgttttttgggggttttcttgagacagagtcttgctctattgtccaggctgcagtgcagtggtatgatcttggctcacagcaacctccgtctcccgggttcaagcaattctcctgtctcagcctcccaagtagctgggactacaggtgcccacaaccaggcctggctcatttttgtattttctttagaggcaaggtttcaccatgttggccggactggttctcaactcctgaccccaagtgccccgcccaccccatcctcctaaaatgccggaattacaggcatgagccactgcatccagcctatatatgttctttcatcatcaccacatcatctaattttacagatgagaacactgaggcttggggagatattaaatgtcttatccagattgcatgcatgtaagtgacataagcacgatttgaaactaagcaatccaacacgagagtcctaggtctagagcctctctgacctgctttctacctagaaattatctgagttctttatgcaaattgatgcactttttcatccctttggtctcttgaagtggcagcttttgctgcacccagttctcacaacaacttgcaaagaggatcaacacacacgactgatcacgagataaaggaagtctgaagcagtccccaccaaacatgcaaattcaatgaatgaagatccatttcttgcagctttctgctttgtataataacatttggctgtgatgatctattatgacactaatccttgcacagcccagagaagatgggcaatagttttctggatgtcagtgggactctggcacaagggccagccaattttggtgagcgcaacaggaaattctttgcaatgtccttgtgaatctgaggttacaaagactggctcaatctgtcacaggaagcatgctggaatgcctttgtccttctttctagtttttctttctttctttctaataattctcagtgtgggagaatattattctttctaataattctcggtgtgggcttacatcctttgctttgggaaaggtttctatcattagacctctcttttcccccaaccagccagctgtgaagcggttcactgcggacccaacctctggcatgactgtggatcagcagcaccaatgccatgaagactgcagacacactggagaaccaaggctaattcccttagccattgagcctccgctttccatccatgaaatgactctcaaaatgccagcttgggctattgcttgcttcagagcacctaagagcatctgaacaaaaggaatatctttttcacagatgtaaatgaggaaagcgaggattatacagtagaagaagtgctctataaggctgctgaagatcacaattttttttttttttgagacagtcttgctctgtgtcccaggctggagtgcagtggcgcgatctcggcttactgcaacctccgcctcccaggttcaaacgattctcctacctcagcctcccaagaagctgggataacaggtgtgtgccaccacacctggctaatttttgtattttttagtagaaacagaatttcatcatgttggccagacttgaggtcaggtcttgaactcctgacatcaagtgatccacccgccttggcctcccaaagtgctgggattataggtgtgagccaccgtgcccggcccgaagatcacaattcttatctaactctgctattcattggctgggccaccttgggcatgtccattagctttctggttcttaggaccctcatgtctaataacaaggtctttcctacctgccccacagggctgttgtgaggaccaaatgagatcaagaatgcaaaagctctctgtcaactgtgaaacactaccaggagtaaagattcacaaggcatgagttgccacaaggcagtatagcatggtggttaggaggttaagctcttaaaccagattacttggattccagtataaccccaggatacttaactttgttttgtggtgttgttgttttgttggtgttgttgcttggtattttgtctaattttcagaaacagggtcttgctctgttgcccaggctggagtgcagtgggcatgatcatagttcactgcagccttgaactcctgggcttaagctatcctcctgcctcagcctgtggagtagctgggactagaggtgtgcaccaccgcacctggctaatttatttaatttttgtggagacagggtcttgctttcttgcctcagcttgtctcgaactcctgacctcaagcaatcctcccatcttggcctccaaaagagctgggattataggtgtgagtcactgcgcccagccaatttaaattctttaagtctcagtttttccatttgtaaaatgggcatagtaatagtacatttgtcacagagttggtttgtgataggataaggtgatgcatgttcactagaaatgaagagagaagggttatgattcattgaaaagaaagaaaaacctaggctgggtgtattggctcacacctgtaatcccagcactttgggaggctgaggcaggaggatgaattgaggacagaagttctagaccagactaggcaacatagtgagaccctgtttctactaaataaataaataaataagccaggcatggtggcatgaaccctgcagtccaagctactcagaaggctaaggcaggaggatcacctgagctcaggaacttgaggctgcagtgagttataattgtgccactacactccagtatgggtgacagactgagatcttgtctctataaagaaaaaaagaagaagaggaggtagaagaagaaagtctgaactactccctgcaggaagagtagacaaggtaaagagccctagaaaagattcgtccccgtgctttcctctagaatgaggactccagtaatttataccagtgctggagcacaggcttgacaatggctggagctcagcctccacagtatctgctgtgattagtgctcaaaagcataaagcataactggaactaagaagaaacaagatgctcaaggtctccccttcagccttccttccaagtaacagaatcatgatttgatgatttgaccccttcttctaccacctcaatattgaaatctgtttccaattcccgttaccttagagaacaccatcagatgtccattgtatatctcagattcatttctgtccaaaaacgaatttaacttgccttccaaataattttactcctaatttttagctcactttctccatgaatatcatcgccattcacccagttacccaaaccaagagcctgaacaacatctttgagtccttctccatcacagcctacattcaaccaattgccaccttctcttttatatacctccttaagtcacggccttaatttgggaatgatcgtttctcatttggacttgacttcatggtcaaatatggcatccagagatctagccattgcatcctaattcaagaccaacaacaggaaaaatgggcaaagaaatatatggtcctcattctgagaaaatgtccatattactcttctctttgcattccttggccaaagctaattcacatggcttgggtagcttcatgagagactgggaaattagagggttttggttttgttgttgttgtttaaagcagagtctatgtcaccctaattaaaatcagtgtttcatcttttattcttcctcaaatattctgtgttaaagtcactaaagggcaccaaccaaagtaagcatcaatgagaggggataggacagagatctggcatggggtgttgaagcctagaattggtgcacgacctagttctagtcacgaaaaagcatcagacaatccccaattgagagctcttatacaacataaatggcctgtatcttcaaaagtatcaaggtcgagaaagtaacaaagagactgatgaatctgccggaataagacgtgacaattaaatgctatgataatcttgccctgcaagattataaaggacattattgggatggtcagtgaaacctgaatggggcctttggattagatggtggtaatgtatcaatgttataataatttcctgactttaatggtcgtattatgggcatataggagaaggtccttattgcaagaaacacacagtaaagtattgggaaatgattcgaggagagggaaaacttaattgtactgttcttccaactattgtctcagtttgaaatttttcccccgaaaataaggtgttatttcagagaagaaaagggaatgtagatgtttcaatatgtaaatagtaggctccaccacagatggtatttaaataatgtatcagaagaggtcatcccaagggagtaatatttaaatccagagccaaagagagaaagccatccacgtgaagagcaaggagacaaagttttcaggcagaaggaacatgtgagaagtagctgaacttgttttcagagttataaccctagcaatatggtggaaaataacaaataactagcaatgtggttgaaataaacaaactgctattccttcagaaacatgagtaagcaccactgtgtgcaggaacttgcagcagtcagctagatgctgtaagacaaacaaccccaaatcccagaaagagcttatttctctgccatgcccatatagcttggctggagcagctctgctggaggttgcaggtctgaagacatgctggggcggctctgctctagatgcatctcatttttctaggaccagtgaccaactaagtcatgtttttctcatagagaaggcaaaagcacaagaaggcaaactcatcacacgagagcatttcaagcctttcataagggttatgtcctctcacatcccattagccaaagaaagttaagctcaactcaacagttgaagggtagggaagtacactatgccatctctcagggaaaaggaagtcacatagcctagctgaacatcaatgatgtaataggagagggaacaaatatttactaaacaatagtctcatctaccgtaaagctcaaatacttcacaaaagagccacccttagaaatagcttttatctcatctattttatgggtgagtggggaagaaggatgacaaagcccctttaagaattttatataccctagacacattcacttttggaggtctcaccagaaagcatttgaaacatgctacaaatttgcctgtatcctacattaaatggatttttggctctaaacattttttgagaaaattttaaaattctgctcctgaaattatctggcaataggtgatttatttaaatttagattggatgtgatttcttggtaattgtgcatattcaggaggtctagaaagtgggaaattctaactatccacatttttcagatgtaatgaaatccctaggaatgttaaatttaacaattagtgatattgacaaagcagcacaatttgtaggtaattttttttttttttttttttagaaggagtttcactcttgttgcccaggctggagtgcaatggcatgatctcggctcactgccacctccacctcccaggttcaagcaattctcctgtctcagcctcctgagtagctgggattacaggtttacaggcatgcaccaccataccaagctcattttcatatttttagtagagacagggtttcaccatgttggtcagcctggtctcgaactcctgacctcaggtgatctgcctgcctcagcctcccaaagtgctgggattacagtcgtgagccaccatgcccagcgtaggtaatttttaagatattcattaatttcaattttgtcattttctcttttgcatttttaagccaatgtgtgtgtgtgtatgtgtgtttgtgtggtgttttttgtttgtttgtttgtttgtttgtttgtttttggtctcaaacatttctgtagatcttgaaaaacgtataggtcccgggaagaccctatgcctaacggattaaaaatgcacatgttgcctggaatcaaagctaattattattggttgggaaatggataccctcccactccagactcctcagcacaggaaaataagagcagctaactccaacagaacccaattcatttaggaggctctctgcctctgcataagggtgaatggtttgggattgctgctcagcagagcccttcatctcattcacgaagccattcacactgtatccagtccatttgtaaggcaaataaaaatgtcgtcttccaatcttggctcatttcatcttataagaaaagtctcccgtccgatgcctagccaacatttccctgttgtgattaaagaaacagcaggtaataaaagctggactaacggttggtcctctaaggaccaaaatatggttgaagaagcaataacttaccccagtgcccccaaggcaagttgtctcaataatgtaacaaagctatacttaatggcaacagagcacgtttcactgatactacaccgtaaactgcccgctttcaattagttgcatatgtattaaagggagtcaacacatatttacagcaatcatttctatgtatacaagatgccacaaaaatgtagctttctgctccttctggtcatttggccacataggaataatcaccaaccatagatgcaattctggaaaagtcattaatgctcatctctatggttgcaagagattattgggcttctatttcatgccaaggcactttacatatgtaaataatggtgcatgctttgaatgaagtcatgtttttgtgacctacaatccccactggctgctgcagcacctggcacatattagccactcaagaaattctcgttgagtgaataaatgaaacattcaatggctctgagaccctacctttcagattatcagcaccgtgaccctgcttttgagacccctactctctctcccttccctattatctcttggtgaatattggggaatggctcacctgaactgccccacgatttcatgcctctgttttcgccattacctgtcaccttacctggccacagtcattccttccaaagccactattcacatctctatcagatgctctgcagttctggggctcctgcctcttgggacaaggctagtactgtcataccaggtgtgatggttaatattgagtgtcaacttgattggatcgaagggggcaaagtattgatcctgggtgcgtctgtgaggatgttgctaaaggagatttacacttgagtcagtggactgggagaggcagacccaccctcaatctgggtgggtaccatctaatcagctgccagcatggctagaataaagcaggcagaagttggaaagaacagacttactgagtcttctggccttcatctttctcctgtgctgtatgcttcctgccctggaacattggactccaagttcttcagcttttggactcttggacttacaccagtggtttgccaggggctctcaagcctttggccacagaatgaacgctgcactgctggcttccctacttttgaggttttgggactcagactggtttccttgctcctcagcttgcagatggcctattgtgggacttcaccttgtgaccgtgtgagtcagtacccctgaataaactccccttcgtatatacatttatcctattagttctgtccctccacagaaccctgtgtaatacaccaggccagcagaagggagacatttgctttcctggacattttctgttcattttacatttgctcaatgaaaaaaatcaggttgcaatacatatataaatagaaaacacagaaagacataaatattttttaaaaagaatcagaaacgtatgccccaaaatgctaatatgattacatccgggtggttaatatttattttctgtttctattctctttgtgtttccccaaatttgcttgttgacagaacatgtgcattgcttttggccaataaatgtttggcttatttaaagagttatcttgatgatagccaggtgtggtggctcacacttgtaatcccagaactttgggatgccaaggtgagcagatcacctgaggtcaggagttcgagaccagcctggccaacatggtgaaaccccatctctattaaaaatacaaaaatcagtctatcttaaaaaaaaaattagctaggtgtggtggcacgtgcctgtaatcccagctactcaggaggctgagagatgagaattgcttgaacctgagtggcggaggttgcagtgagccaagatcatgccactgcactccagcctgagcaacagagcgagactctgtctcgattaaacacacaaacacacacacacacacacagttatcttgatggcagttcaggaacttgggagatgagggctgttctcctaaaaccctataagaaccctcaggtgggttatgccacccattcactaatatcccatttacgggtgaagggaaaggtggaggagaccaaccaacccaccagcagtggcctcagtctcaaataaaacttagtccctgagttagaagccaacttaaccatggagaggaaagagttcatcagatgggactaaacctgctcacttccttccaagaaccaccccaagggttcatttcccaggcaccaggagccacccagctccaacatgctgttttctgtcttctggtgacttatcacttgttgtttcttcaagaataagccttcgttgttccaagtaaacatctcaaatgcacacattcttaaagtagtaagtcatgtatccacctgtgcatccaacaaattattatgtagtgaacacccatgagggacgtgctgctgtgttcaatgctggggacaccacagggggccacccacggacttggttcctgccatcatggagctctcggtccagtggaggaattagacatgaaccaaataaaacacagtcatgaatgtaaaaccagaaactagagtaagtgctcttgaaactgccttagcaaaattatgactgagacagtgaaagagatttaacttgatcaattccatcttgcttctaacctccaagctgtccttattcattcttgggtgtaggctgacctaactttgggagaaactgagttcatggttcatagtttgtagtttaaagcaaagatgataacagccctttcccaaagcagacctccttcttgcctggggactagattgcctttgttaggactaaaatgagccacaagattagaaactatggtttaggagtcaggcggctggaggttacaagattctgaccctccctaaactgttcctaagatcagtgcttgagataatttgcagaccctgcacgtgacgggtcaggtggcaccacccagatcgatcaactggctcatctgatcttgtggccccaacccaggaactgactcagcgcaagaggacagcttcgactccctatgatttcttccctgaccaatctgcactcctggctcactggcttcaactaaccacccctaccaagctgttcttaaaaactctgctccccaaatgcttgtggagactgatttgagtgataatcaaactccagtctcccacaatgcccctctgcatgaattactctctctgtattccaatccccctgtcttgataaatcagctctgtctaggcagcgggcaaggtggacccaatgggcggtcacactctgtcgagaaggaacacagggagttgcggaaggcttccagaggaagtgcctgggctttgaagaatgagcaggcattaagtgggcaaaagagcatgtgcaagggtactgtgcaatgtgtcaccacccagggagagaggagaagtggactatgaggctggggacataaacacggtcctggccatggagggccttgtaaaccccatgaaggatgtttgctctttatcctaatatcaacatgaagtgattagaaggtagcaagcccttgattaaccaacaattctagatccttctccaaacttctcttttagggaaaggaaacctagaagtcaaaacataaggtggtgggatttcagttgaaaaggtgtccagggtcggcctcgggtcagtctatctttgggtctatcacaaacactatattaattgcccctattaatctttcattatgtgccaggcattgtgatgatgtatactttatatccattggcacatgtaagcctcaccacaagatttagggcctatcattatgcccatttcacagatgaggaaactgaggttcaggggggcttgtaacatgtcccaaatggtgtagctagtaagtggcaatgccgaggctcaaatccctccaaagattctctctccaaaggtcattttcctttccctaagccatgctggtgcatctggggtcctggaaactaggagatgattttcagaattataagacttaggtcgtgcaagcttcttaatcatcaaagaaagtctggaaagagaagaagatgtttgcaggaagctgccacagaagagaacattttagacagaggaacagcatgaagaaccgaacacacgtggcatcccctaggggccatgaatatagcagggaggcaaccacagagttgggaagatccagagagaggcgggacagatacagtgggtcctgaaagtatgttaaataaagtcacagtgacacggcaatcaggagtggcaagggagccacagacacacatgattagacacaaaaatcatgttttcaaggcacagcccacttagagatcacagcaagatgctttatccaacctccgccggcaatcagagcttgaaaaaggagcattgtcgtcaatcaacttccctttgggcaaaagacacaggcaaaggagaagatacttcacccaccttttaataaatgtgtcttgaggagagagttggcccacatagtacagtctccaagatctaagactccacatgggtagtggcaggggagacaatgggaaccaacaggacattggctggaatcacaagtcacaccttcagtaaaccagaggagtcatttctctctcccttattgactctgggccctggagaaatgccacagaaattcatgggaagaggagttgaaggtagacggcacctggacattatttctgccagcccatttgagttcatctggtaaacattttgcatttggaagttgacatcgtttaataataactgtcaatgtcaatgatcaatgccatcataatggcacaaatacccttgtgggcttggggttgggaggggtacggtggggactgacttctttgtctcctgtcctttcaatggttataaataatgatgataataatttctatttgtgtagctttgtgattgcagagagctttaggcttcctgagagctttcacctatattacctcagctgatccctctacaatgtgcagtatctattttggtcccctctgggaacctgaggcttgacaaggtcaggaaaggccacaccatggcctgttcctgaaacaggaaccacaaatgaaaatccttgcagagagtccaggcagataacataagtgaagaaagggaggaatgagaagcagtagggaatggtggggtctgtggtgaattggagtgcatgcctcattgaaagacgggggtagctgcctatcttgtatccaccaactgtctccacgtgggaacatgggcccaatgctgtcagagcttctaataaattaagagaagctaaaagccagatgctatgtcagtctcccagtttttaaatgatcgcaactgggagtcttgcaactctgtctcccaggctgtaaggcagtggcacaatcctagctcactgcagcctcgaaaccctaggctccaaagatcctcctgcctcagactaccgattagctcgaactacaggcatgtgtcaccatgcgtggctagttttcacaatgtttgtagaaatggggccatctcactatgttgcccaggctggtctcaaactcctgggctcaagcaatcctccctgctcagcttcccaattagctagaactacaggtgtgcaccaccacacctggctacaaactctccttgtcaccccctgttgataggtctctttccttcacaggctgagacaactccaattcaactctgaatccccaatacaggacctgcccagggaacagggctcagacatttatgctgggaaatactcagcttttggggctcagcgtccttttctgcaaaaagagttcccctcccaagaggaaatcccctaagcctaaggacaggaggtgatggaaagatggatggacgggcagatagatggatggaaaaaaatggacagttggaaacagacaaacttggtggatgagcagaaataagcctcattctcgcctaacaacgggacagcctgggggaggggtgggacacaccaaggctcccagttgacccccagcaattggacaagagagtttataaaccagcattggggttttaggagcattgtaagctgcagagtgcatggggtcttcagtgggaagcatctccttccccatccctgttctctgtcctggggttgcccatcaagctaatcacatgtccacccctggggtccctctggcctctgccactcttcaccaaagtacagttaaactccaggggcaaatgatgtgttgggggtgtggcagacagggattgtgtctcagcagagagggcacagcactcacaaaatagcttcaatagttccagggtcagtagatgtgcccgaagaggaaccccacatcgcaagtggcctaagcctggggtagggtgagcactgctcactcctgcccagaggagtagctgaggggcctaagctctagctctgagcccaccagccattccatccaccacccacctgaaactgttctgttgacccacagcaattggtcctggtgccaggcacagaacagatgctcaaaagatacggttgattctgtctgggtgcagtggctcacgcctgtaaacccagcactttgcgaggctgggatgggaggattgctggaggccaggagttcaagaccagcctgggcaacatagtgagatccccatctctataaaaataaaaattagctgagcatgatggtgtgcgcctgtagttccagctactcgggagactgaggtggaaggatagtttgagccaggagttcgaggctgcagtgagctacgatcatgacactacactccagcctgggagacacagcaagaccctatttaaaaaaaaaaatggtatggttaatctgcctttactgattacaaatcaataaatttgtattatcgtaataaatctgtctttattgattacaaggcactttctcatcccccatcacctaagacaactgcataaagaccgcatgagctataaagaccatttccttgccccaggtcacacggaggaaaagagacagagccaggatttaaacccctgcccctggctttcattcctttgctgtgtccctgcagacccgaggcccacctgggtgaagaacaggtgggtggacattggcagtgttcaccaggggaagcatgccaggtgcaaggaaacatgtgagcacctgtccgtgcccaatgggtctctgtttgtctccctgcatcttcacccaaaccagcttctcacacccccacggccaccaccaccactccaggcctctacctgggccctttaatgccccttcctcattcctcaagagcccactggcgtcccttccctgatggcctgctggcctcctgcctccctccctgacctcagcctcctcggattttcaacagcctggggttgcaggctgagctcagcatctggcaggggcctggaagaaatgacctctagagggcccacactctctgggtgtcatattttggggctattatcacaaaataccttagactgggtaatttataaatgacagaagtgcgttgctcacagttctggaggctgggatgtcccagatcaaggcacctgcagattcagtgcctggtgaggagggctcactctgcatcataggtggtaccttgttgccgtgtccttatatggcaaaagaggcaaaggcgcttgctcaagccccttttataaaagggggcactaatcccattcatgaaggtggattcctcatgaattagtcacttcctaagggtcccctcttactactatcacattgggtattaagttccaacatatgaattcaaggggaacaatgacattcagaccatagcaccagacgtctatctggggaagcccccaaatatttgtctttttttttttttggaggcagggtctgcctctgtcattcaggctggagtgcaatggtacaatcacagctcactgcagctttgaactcctgggctcaagtgatcctcctatctcagcctccccagtagctaggaccacagatgtgcactaccacatccgactatttttttattttagtttttttgtagagacagagtctcaccatgttgcccaggctgatctcgaactcctgaccccaagcaatcctcccaccacctcagcctcccaaagtgctgggatcacgagtgtgagccatcatgcccagccagccccctcatatttgatccaggcattaagcctcctggcaagaccagcagctccctgcccctgaggcagggctgagtttcagaagctgcttttcattctcagactatgctgagcctggtactgtgcacacagcacatctgaactttgttcaacatatccctgcaccaacctggcaggacggcctcaggccagggaggaaccggggagatgatgtgggatgagaagagagatcagacagaggctgtctagacacagtttcctggcaaagtcaccaagagccctgcgagcagctgtccacacctcctggcactctctgtatctgtcccgtccctgccagctccccacccgcccagtgcttcaccagctcacccctcagacactgtccaggtgggaaccattcccctcaactccctccagaacaaccagatggcacctgccagcagccctgggagccagaatcccacccacctgacccaagggctctatctgatctcagcctaacccatgaatcaggccctttggagagccaaaggaaaattgggcttccctgccagctgactatgtgacagttcagatgtcccagagcacaggaaagaggcagagacagggtcgtgaggagcccttgcttctccttcaacatctcccataaacaactggagaggggctctcacagggtccatgggaagagaccaaggaggggcatggaggagaggggagggctgagaagaccagggtgaaatggatgaggagaaggaagcagatggcagggaccctcccatctcccacatgggctcccttaggtgctactggccttgtgcaaatttgcacactcacattcacacatttctgtctgcttctctccaatcgttcagatacctagcacacaccccagcctctagaatcaggtagtcagtctagcagagtctttagcatttgacttctgggtttaaatcctggctttagcacttcctagcttcacggccctgtttaggcagtttatatgcctccctgagcttcccaggttttggggaggaataaatggcatagcagatgggaaacatctagcactgtcctgctatatcatagactgtgaaagatcactgtttttgtactattggccttgctttgtagtaattatcattaacttttttttgagataaggtctcactctgtctcccagcctagtgtgatcatagttcactgccacctcgatctcctgggcttaagtgatcctcccacctcagcctcccaagtagctgggactacaggcacacaccaccacacttggctaatctctctccttttttttttttttttttttttttttagagaccgggtctcattatgttgcccaggctggcctcccaaagtgctagaattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagagcttccactgggttctccttgtcttagagcccagccaccatacgatgaggaagcccaagtagctgaagagaggagaggcccaaacaaaggaaccaagtcccctggaccacagcctagctgagctcccagccaaccagaaagcgccaacttagcaaccgctagaggagccatctcagaaatgaattctgcagccccctggtgagctccagctgatgccatgtggagcaggaacgaactgtcccctcaacatcctgcccaaattgtggatgtgtgagcaaaataaatgactgtcatgttttaagctactacatgttgggtggtttgttgcacagccatagacaactggatgacaaacacatatctgacgctttatccgtcattgccatgctaagctgcagatatttttgtaatctacacgtttagaccttttccagcttttagagctcacacttcccttcagtacacctgcaagctccctgaattcattttcatgtaatcctccacttttttccttcagccggttcatgttaggtttctctcatagcccctaaacacagtgctcaaataccaataacctggatcccatcttgcggctctgcaggaagctgtttttgcacaaggttcttccacatttctgggaaccaggagatgtctacttcagctacaatctctcctgctcgtcccctgtcccctcgggagggtctggctcagaacagatttcactgtgggacccaagccaacctgttagccactcctaccccaggacgggtgaaacacagtcttgcagtaacaagacttacttttgaaggatggaattacaatatggaaaaaatacaacttcacaaggtacacgttcagttcatagcagcagccaagactttgaaggaagagttcaagtcgccacaaaaacatagcagagggaatagtacggattttagagccagatagtactggagacttggagactgcagggctgggagggtcacagacagtcctgagttcaaatctccactccaccactcattgcccacgtgaccttgagcaagttatttaacctctctgagcctccatttcctcaaaggcaaattggggataataaacccagtgtttgtgaggatagataggatgcatattctgctcgtggttgtgccaaccaaggacacattcagagtaaattcaagactcttcttgaagagtcacgagcacagtggcccatggcagtaatcccagcactttgggagggtgaggcgggtggatcacttgaggtcaggagctcaagaccagcctggacaacatgttgaaaccttgtctctactaaaaatacaataaattagcagggcgtaggcatgcctgtagtcccagctactcagaagtttgaggcaggacaatcccttgaacctgagagatggaggttgcaggcgctgcagtccagccagcctggatgacagagagagactgtctcaaaatacaaataaaataaaataaaaaaagaatgagactcttcttactgcaaaaactgacctctggggggtggaaacaaacaaacaaatgagcaaaaaccattgttcttgcctagctgttaaagaatattgcgttttctcataacttgacacgatacagaaacatacaatgaagaatctggtgggtattgaactgtcaattgcaaaataattattcatcactgcaggtccagcctgttctccgggaaggactgtttgaatgtcctgggcctccaagccaagctcccagagcccagaccgtctctttggctaatgctggctctatctcctgaagaaaatagtttgatgcaaggaagaactttcattatcttttgccctggagcaccagtaactgtctacaaagagcagagcaagggaagaagggcagtgagaaattaatctttgagtttcctccttggtgattcatccatttagaaatgggtagattcagagaagtgtttcttcatccggtccctctgttcccatgatctcaaaaatgaaaaggcagccaaccctgatcaccacccatcagtcagcctcttttcacaagtgggaggcatgggctgtgctggaccaagtgcaaatgcaagacatgtctctaacaggccttctggaaccaggggaagctggtggcttggatgcacccactgtgaggtagagtgttatactgcagcccccataaccctgcacttctccaagtctatgattatttgactctggaatctggtgtagcacatctgctcagttgctcagtcattacttactgagcacttacaatgtgccaggacaggcagggtataaaggattgagaattgaacaaggtagtcaaggtagtatgatccctgccctcaaagagcttgttttagtatatagggtttctcaactttggcaccattgtgggctgaataattctttgttgtggggctgtcctatgtactatatttttttttttttttgagacagagtctcgctctgtcgccgaggctggagtgcggtggcgctatctcagctcactgcaacctctgtctcccgggttcaagtgattttcctgcctcagcctcccgagtagctgagattacaggcaccaaccaccacgcctggctaatttttgtatttttagtagaaacgcggtttcaccgtgttggccagggtggtctcgaactcctgacctcaggtgatccacccacctcggcctcccaaaatattgggattatgggcatgagccaccacgcccggcccactataaaaactttagcagcatccatggcctctatccactagattccaatatcacaccctttctcccaattatgacaaccaaaaatgtctccaagcattttcaaatttcacccgagggtcaaaattcaccccaccccactcctaccattcacgattgagaatctctattccaatgaaagaagcaggcagcttagtggaaagagtgtgagcttcggagccaggtgggcctgggttctcccttccactttattagctgcgtgatctttggggaatcacttctctctcttacgcatacgtagattatttgaaaattatgggtagcaatcatatttttacaaggttgttgggtgagctaaagatcaaatgtgtaaagaactgtggcaggctgggcacggtggctcacacgtgtaatcccagcactttaggaggccaaggcgggtggatcacctgaggtcaggagttcgagaccagcctggccaacatggtgaaatcccgtctctactaaaaatacaaaaatcagccaggtgtggtgccacacgcctgtaatcccagctacccgggaggctgaggcaggagaatcgcttgaactcaggaggcagaggttgcagtgagctgagatcacgccactgcactccagcctgggtgacagagcgagacaccatctcaaacaaacaaacaaacaaacaaacaaacaaaaaacaggggcagacactgtcaacaccaaaagtcatcctcttgtcttaattcttcttgctaacagaaccccagttctttcaagggtccctatctcagaagttgggctcagtccctagagggggtgggcatgcaaaccaggtctagttaatgagctatttgagggagggggccctctgggggtagaaggttaataaaaagtttggttattttatttttatgcttttatttttttagagacaggaccttgctctgttgcccaggctagagtacagtgccacaatcatagctcactgcagcctcgaactcctgggctaaaggaaggtggggactagaagatggataagcactccacacttgttagctatctattattgctgttagcactgtcattatcagtattttttttttttttttgacggagtctcgctctgtcactcaggctggagtacagtggtgcactctcggctcactgcaacctccgcctcccaggttcaagcaattctcctgcctcagcctcccaagtagctgggattacaggcgcctgccaccacgcccggctaatttttgtatttttagtagagacagggtttcaccatattggccaggctggtctcaaactcctgaccttgtgatccgcccgcctcggcctcccaaagtgctgggattacaggcatgagccaccacgcccagccctttttgctttttttttttttgaaacagggtcttgctctgtcacccaggctggagtgcagtggtgcaatcttggctcactgcaacctccacctcccaggttcaagcaattctcctgcctcagcctcttgagtagctgggagtacaggcatgtgccaccacgcccagctaatttttgcatttttagtagagatggggtttctccatgttggccaggctggtctcgaactcctgacctcaggtgatcttcccgcctcggcctcccaaagtgctggaattacaggtgtaagccaccacgcacggccctttatcagtattattattattaacttttactaaggaaagagggaggcccttggccaggccgtaggattgctggccttccagggagtgtgttacccagggaagtggcataaaattacagaattgggaagctaagaggtagctctagacatcacacctctaacctttttgatattctgttgctccatctacaaatggcatttagaatttttgttcttaaagagtcacaaatcacgtgcaggaagcttgaaaccagtcctgttaccttcctatgctctgatgccacctgggaatttgagctggtgtttcgggtaagagaacagcttataaccaggcttttcaggacaatgaagactgcctttcagtgggaagatgaacaatctgcctaagtcataagaatgatacaatggactttggggacttgggggaaagagtggaagggggtcgagggacaaaaggctacaaatatggggcagcgtatagtgttcagatgatgggtgcaccaatatctcacaaatcaccactaaagaacttactcatgtaaccaaataccacttgtaccccaataacttatgggaaaaaaatctacccaaggaataaaactaaatcgagactttaaaagcgagacattaaggaagttgactcttagctgacctggacacaggcctatcatggtaagtgctgcaggtgaacaaacagcagcaatttgacccttcttccttatacatcaaattcctttttttaaaaaattatttttgagacagagtctcgctctgttgcccaggctggagtgcagtggcacgatctcggctcactgcaacctctgcctcccaggttcaagcaattctcctgcctcagcctcccgagcagctgggattataggcacccaccagcacgtccggctaatttttgtatttttagtagagatggggtttcgccatgttggccaggctggtcttgaactcctgacttcaggtgatccacccactttggcctcccaaagtgctgggattagagacatgagccaccgcgcctggcccaatttcatttttttttttttagacagagacagtgtcttgctctgtcacccaggctgcaatcagtggcgtgatcatagctcactgcagcctcaaactcctgggctcaagagatcctcctgcctcagcctcctgagtagctgggactacaggtacatgccaccacgtccgactattatttttattttttgtaaagatggggtctcattatgttgcccaggctggcctcaaattcctgggctcaagccatcctcccacctcagcctcccaaagtgctgggattacagatgtgagccaccacacccagcccaaattccaattttctaaagaatctggggctctctgtgttttaagactattaggctctccccagtttcaggggatgaatcttgagcagtctgatggagggctggcaagccattgcctaaacccggcccaccacctgcttttgtacggctcaggagctggaaatggcttttacatttttaagtagttagaaaagatcaaaagtgtaataatatctcctaacacataaaaattagatgaaattcaaatctcagtctccataaataaacccattcacttatttattatcatctatagctgctttcacactgcaacagcagaacagagtggttgctacagaaactgtgtggccacaagcctgaaatatttattctctggctcttcagaggaaaagatcttaggaagccagaggttctcaaactcagtgtccatcagaaacccccggagggcacgtttaaacatagactatgggccgggcgcagtggctcacgcctgtaattctaacactttgggaggccgagagtttgagaccagagcattgtttaagccaagagtttgagaccagactggacaacatagcaagaccctgtctctacaaaaaataaaaaaaatagctgggtgtgggggtgcacacctgtagtcctggctacatgggaggctgaggcaggaggatcgctcaagcccaggagttggaggctgcaatgcgctatgatagtgtcactgtactcctgcctgggcaacagagaccccgattctagtaaataaataaataaaaacatagatcccaccccagagtttctgatttagtaggtctgaactggggtctgagaatttgcagttcttaaaattgcctagacatggcagatgctgctggcctggggatctcgctttaagaagcactggtctaaggcaaccttgggaattccattcccttgccagcaactggcttagaaaagggcacgtgatacatttctgaccaatgcgatgaaggagaagtcagctggcagcttctgagaaaatgagaaaatgatcataaaaagggacagatgggctgggcgtggtggctcacatctgtaaccctagtgctttgggaggttgaggcaagaggatcacttgaggcccagagttcgagaccagcctgggcaacagagggagacctcatctctagaaaaaactctgaagttagctgggtatggtagcatgcacctatagtcccagctactcaggaaactgaaggaggatcacttgagcctagaagttcaaggctgcagcgagctatgattgcaccactacactccagtctgggtgacagagcgagaccctgtctcaaaaacaagcggggaacaagtggaagaaggctctcttctctcttgtccatattatcttgagaccatgatggggtgtggctgagggcaagagccagctgctaagaatggaatagtggaaaagtggaaggaaacaaggcccaccattccacaatggagccactgaatcaattaaccacatggccccctgcagagaaacaataacttccattagcatctacaccacttccagttgggttctcagtgatttgaagccaaacacaacctacctggcaaccctacaacttcacccctcaccactgtttggacactaccaaacttaggccatgatgattaaggccaggcatgagctccaccctccctgccaccctatgaggaataaagcagatatggggaaggtgaaagggcatgatttagggatccataaagccccagattggagccttagttctacaactcaataatggtgggctagagctctatgcaccccatactctaggatggggactcatacctgcatggttgactagtgcagtcatgtctgtgcatctgagcagttattttcttctctggaccattattaaccattagagctagcatttgtccccaggtcccgggcactgtgcaagtcttcacctacattatcctactacctcataagatagtttggatgtgtgtcccctccaaacctcatgttgaaatgtgatccccaatgttggaggcggggcttggcgagaggtatttgggtggtgggagcagatccctcatgaatagcttggtgccctccctgagtaatgagtgagttctcactcttttagttcacggcggggtctgattgttaaaaaagtgtttggcacccttcctgtctctctctcacccctcttctcaccatgtgacacacctgctcccctttcaccctccacagtgaagaaaagcttcctgaggtctcaccagaagcagatgctggcatcatgcttcttgtacagtctgcagaacgtgagctaaacaaacctcttttcttataaattactcaccctcaagtattcctttatggcaacgcaaaacaggctaagacacctcaatggactaatacataacagccccataaggtgagtgccaccatctcccccaccttacagatcaggaaacaggggctctgaaaaactgtggctcactcaaggtcataccgcttgttaagtgcagagataggattccaactcagaggcatctggctcaagaacccacgtgtctgtgtttcaggttgcaatgctgaggttaaacaagaggatgtgtgctaggagccccagcacaccacaggggctgggaaacgttattgcatcgagtttgagtccaacacacggtctcattcctccacccaccactcagcctagaaaaagggtcggaaggttgactccactttcagaagcttgccagctccagccagtcagccagagtgaagctgacaagagcaatgagggaaatacggaaagataaatccagatgtggacaatgagaccgtgtcccctgagaactgtggtggcagagggactcaaaggtccaggcctgctcggtgtggctgcggctcaggttcctgggccacagggctgccttacctgccagtttccatgcctggctgactccccccaccgcccctctggcttccacaccagcccactgatgccaccccagagaactcggctgtttgccttgctcctctagagggcaggtggatgcggtgaaacgggcagcgattccagagccatcacaactcctggctgaaaccaaacatgacagatttaccattgggcaggctgctccatttattatttaacactcgcaataaatatttgcatgacccagtgctggagggaacgctctgtgataactcactgcattttcctgccaaacaccagcacagtcggattccgaagctgcagcagagaatattttatgctattctaaaaatccaggtgatggccccttgttagaaaaccttttctcatccatttccatagaggaaaaaaggagcagggagaccttagctccgagaagcaactagaggaggaagaagaggaggaggaagatgctgacaggtgacatttacttagcacctactgagtgccaggccctaagctaaggacttcacactcattcattcaacacctctctctagagggtagggttgccagacttaacaagtaaaaatatacgacacccaattcaattttaaatccagtgaaataaggaatgattttttaaatacaagttatgtatctgatgtaatactggaaaattattcaatgtttatctaaggttcaaatttgggtgcaatggcatgcccttatattcccagctacttggaaggctgaggcagggaaatcacttgaacccgggaggcagaagttgcagtgagccaagatcatgccactgcactacagcctgggcgacagagcgagactctgtctcaaaaaaaaaaaaaaaaaatagaacaaactgggctacaaagttttgccaggcatggtggctcacgcctgtcaccccagcactttgggaggccaaggtgggcagatcacctgagatcaggagttcgagaccaacctggccaacagggcaaaaacccatctctactaaaaatacaaacattagccaggcctggtggtgcacgtctgtaattccagctactcgggaggctgaggcatcagaatcacttgaacctgggaggcagaggttgcagtgagccaagatcatgccactgcactccagcctgggggatagagtgagactctgtctcaaaaaaaaaaaaaaaaaaaaaaaaaaatgtaactgggcatcctgtttgtatctggtaacactccttaaggttggactaactatgcgaagacactgaatttaaaaggcttttcttttcatttattttttaagagacgtatctgtgtaactcaggctgcagtgcaatggctattcacagggatgatcagggctcactgtagcctcaaactcccaggcttaagagatggtcccacctcagcctcccaagcagctgggactacaagtacatgacactgcgtctggtgttcagtggtgcaatcacggctcactgcagccttgaactcctgggctcaagcaatcctcttgcctcagccaccagagtagctagaactacaggtatacagcaccacgcctcgctatttttttttttttttttttttgtagagatggggtctcaatgtgttgcccaggctgatctcaaactcccggtctcaagtgatcctcctacctcagtctcccaaagcactggaattacaggcatgagccaccacgtccagcctcttttttttctttaaggaggcttattttttagtgtgggttagggaagagccatgtgtgaagttgactctggagcagagatgtcaaagatgagaaagagctacccataacaaaaaaacggggaacaggattcctggcaaagaccccacaaagaccctggggctggaaaccatgtggggcattggaggagtcaagggaggtgacacttttggagctgagtaatggagaggaaagtgacaggagcagactgcacagggccttggtcacaatgaaggatttggatgctattctaagttaaagggaaggcatgggaaagcttttcagctggaagtggccaaactggggaccgactctggctgtacggatttctgagcctggagatggcacaaaggacctgacattggcaggaaaagaaaagaggaggaacaagaacacgagaaattgccttaaaagggagctggtcaggtctcgccagaaaagttcacgcaataacaaaccagccgcccacaacagacatctccacattttcccagagctgtcccccagccaggcggccggagtgaggggatgccgacggtgacaatgctatcaatttccattttgcttttgccaaatacggaaaaggacacttcaaagacttttaaaaataacttccaaacaactcaagggtgaaaaaaaagaaagaggtaaaaaattacagtctgcctgcttgagaatagcgataatgaaaataagtgatagaaataagaacagctgcttttgcacacgttatgtcatctgctccttagcactctatgaagcaggcagaacaggtcatggtatccccatttcatagataaggaaactgagacccagaaacataggatacaacagagaggaaatgatcaggtgggtgagaagctatgtttgtctggccccaaagcctgggttccccaaagccctctgcaggctgatatgagcctaaccccagcccggctcctggctctcagccatctcatcctcccagcccagctatggggagcaagatacctcctaccatgtcccttgcagccttcctccctcgcctgcaggggcttcctgcctggaaagcctgttcctttgcccttcttctccagaggattcacgtacctcagcacatgttcgacgacaaagtcacagcactgcagggacacctcccctggagaggaacacgatggtagagtggaaggggcacagctttgccattagaatgcctgagttcaaatcccagctcaatcaccaactggttgggtatccttaagctcttccaaggagtgggggataatccaatccatccccacaggatcctggtggggattaaatgagatgctgtatgtaaaacatcaacacagggccaggtgccatggctcacacctgtaacaccagcacattgggaggtggaggcaggagaatcgcttgaagccaggagtttgagactaacctgggcaacatagccagacccctatctatacaataaaatgtctttttaattagctgggtgtgatagcccatgcctgtaatcccagctacttgggaagctgagacaggaagattgcttaagcccaggagttcaaagctgtagtgagctatgatcatgccactgaactccagccatggtgacagaactagaccccaactctaaaaaaataaaaaacattaaaaaaaaatcagcacagtgcctggcatacagtcagcacctaataagtagtagctgttttttgttttttgtttttttttccatctctgaaaaaaaaaatcagccattttttaaaattagctgagtgtaatggtatatctctgtaatcccagctacttgggaagctgaagcagggggactgcttgaccccaggagtttgaagcttcagcgagctatgattgtgccactgaactccagccatggtgacagaacaagacccaatccctgaaaataaataaatcaattggcacagtgcctggcatatagtcagcacctaataagtagtagctgttagaataattacaaaaggccaggcgtggtggctcacacctgtactcccaacactttcagaggccaaggagggtggatggcctgaggtcaggagtttaagaccagcatggccaacacagtgaaaccccatctctgctaaaaatacacacacacgcaaaacaaatcactgggcatggtggcacatgcctgtagttagtctcagcttcttgagaggctgaggcaagaaaatcgcttgaacccaggatgcagagattgcagtgagccaagatagtaccactgcactccagcctgggtgatagagcaagactttgtctcaaaacaaacaaacaaacaaaaacaaaaaaaacactcaaatcatgggattgagtgttcaatcattcaatcaatttttattgaatgcctactacatgctaggtacttagggatataacaggaaataagacatacgtgattctaccttaatgaaacttagaagaaggaatatacttatggtatagtgaaagaaacatatttattagaaatcaaacataaaaagcataaaaagtgttgaagagtgctctaaaagaacagaggtttctgtgaatcatctactttatttatttatttatttatttattttgagacagagttttgctctgtcacccaggctggagtgcagtggcgtgatctcagctcactgcaacctccacctcccaggttcaagcgattctcctgcctcagcctcccaagtagctgggattacaggcacccgccaccatgcctggcttatttttgtatttttagtagacacggggttttactatgttggccaggctggtcttgaactcctgatgtcaggtgatctgcctgcctcagcctcccaaagtgctgggattacaggcgtgagccactgcacccagcccagaatcatctactttagactgaggcatctgagacgtgctcaaaggacatttcagtggagaaccatgggtgtgaaggagggagtcacacggagactgggaagggacagacctttgtaggacagacggcaacacgtgcaaagcttgtgctgggaggtgaagggagaacaactcgctggaggaagcaaggaagaggagatttagttagagcagacagccaggatcagagcatgcagggtctgatcatttatttccaagttattctgaaatcaaagagaagcaggcttttaagctaagaatgcagcacatcggctagcatagaataagagttcaaaaaaagtgtaagctcccttccctctcctgaaacaaccaaagtaaataaaaatggcccctctgttttcaattatttatttatttgtgctttcaaactgttttcttaaaaaaaaaaaaaaactacagagtagtgagtgggggcgggggggtaaggggtggaatactcaaaacgtgttcaaaatcaaacgagccagaaactcctcgctggaaattttctctctagatctctgcaggaatcagtggaaccatgagagacagagtcgaaagcagcagagcctggaattatttctctaagcaagacccagacgccaggcaggtagtgaaattgctcctgccccacctccatccttgctgcctatttgagaacagagtctgccaacccctcctgatgagagactgacccctcatagccactgcaggctggaagccataagcttaaaccacttccataccatgaaagcaaaatgtatggttggcaaaaagcaaaaaaaaaaaaaaaaaacaaaaactggttactggcgagtgcagaaccacagtctgggtcgatgacaaattatccagcatgaatcttggtgtgacttaggcccttcttagtcctctaaaattcatcacattttgtttattcgttcactacccacttacagtagatgccaagaaatatatataacaagattatagatataaatttaaaattaggactaaagaaagataatctagaataagaggtaaaagcagaacagagcaggatggaaggtagaataaagatatacaggccagaaggccagttactaaactggatttgagaacatggcgctgagttccctggtggccaagtcaaaaagggcagttggagatgttctcatggtccacaaaaagaaacacacttaactttgcagaacaagcactgtcctgccgtgtgacctcagataagtgatttaacctacttagactcagctgcctcattgccaaaaagttagtgaaaactattgaatgtttaggtaaaaagttgtaataaaaaacaagaatgggaaaggattccctatttaaaatggtgttgggaaaactggctagccatatgcagaaaactgaaactgggccccttccttacacctgatacaaaaattaactcaagattgattaaagtcttaaatgttagacctaaaaccataaaaacccaagaagaaaacgtaggcaataccattcaggacataggcatgggcaaaggcttcatgactgaaacaccaaaagcaatggcaacaaaagccaaaattgacaaatgggatctaattaaactaaagagcttctgcacagcaaaacaaactatcatcagagtgaacaggcaacttacagaatgggagaaaagttttgcaatctatccatcgggctaatatccagaatccacaaggaacttaaacatatttataagaaaaaaacaaccccatccaaaagtggccggaggatatgaacagacacttctcaaaagaagacatttatgtggccaacaaacatgtgaagaaaagctcatcatcactggtcattagagaaatgcaaatcattgtcagagtgctcagagagggcatgttccctgggtcttggtggatttagaggtcaagggaccatttctggaagctcactgtgtgccagggcagcttatatcagagctccgctctttttctttttcttttttttttttaagacagagtctcactgttgcccaggctggagtgcagtggcaccatttcggctcactgcaacctccacctcccgggtccaagagattctcctgcctcagcctcctgagtagctgggactacaggcatgcaccaccaccacacctggctaatttttatatttttagtagagacggggtttcaccatgttagcaaggctggtctcgaactcctgacctcaggtgatccacctgccttggcctctgaaggtgctgagattacagtcatgagccactgcgcttggccagagatctgctctggaagaccccccaggctggagggcactgccacaagcagacagtatggcgagggtccctatgaccacctggcaggcagggtggattctggagggaggtggcctgggagcaggctgaggatggggtgagggcatttgagcagcagagtgtctgcgtgaccgggcataactggagggacagtaaatgactcttgtgtgagaggatgagggaggggtgagaggggctgactacccccaggacttgaggtgcagtgagactccttagctttaaccagactcatgggagccatggaggtttgaggcagaggtgtgggctgctgggagagtgaggactcaccatccagagaggaaggtgaagctttcaactctaaatgccgttttattttcgtgtgttttttttttttttttgagacggagtttcactcttattgcccaggctggagtgtgatagcacgagctcggctcactgcaacctctgcctcccgggttcaagcgattctcctgcctcaccctcccaagtagctgggattacaggcatgcgccaccatgcgtggctaattttatatttttagtagaaacagggtttctccgtgttggtcaggctggtctggaactcctgacttcaggtgatccgcccgccttggcctcccaaagtgctgggattacaggcatgagccactgtgcccggccccaaatgtgttttacattttcttcctatttgattcatctttgtcgtgcaacataaatatgctacttttccactgataaaaagacaaaatggaatttaaaattggcctggacttctcaaaaaaagtcagtgtgatgaaaacatgttctagataaaacagaaatgagactgggcatggtggctcatgcctggaatcccagcgccttgggaggccaaggaaggagaatcacttgaggccaggagtttgtgaccagcctgggcaacatagtgagaccgcagatctactaaaaatttaaaaattagctgggcatggtggtgcgtgcccgtatgtctggaggctgaggcaggaggatcgcttgagcccaggatctggaggctgaggcaggaggatcgcttgagcccaggatttggaggctgcagtgagctatgattgtgccactgcactccagtgtgggtgacagagtgagaccctgtctctatttaaaaaaagagagacaagatgatcaggatgagcgcagtggctcacgcctataatcccagcactttgggaggccaaagcaggtggatcacatgaggtcaggagtttgagaccggcccagcctagatggtgaaaccccgtttctactagaaatacaaaaatcagctgggtgtggtggggcacgcctgtgatcccagctactcgggagactgaggctggacaattgcttgaacctgggaggcagaagttgctgtgagcaagatgacaccactgtgctccagcctgggcaacaggaatgagactctgtctcaaacaaaaaaaaaaaaaaaaaaaaaaaagggatgatcaaacacaatgcgtcaacctcccggagctgttgtgagcaagatgacaccactgtgctccagcctgggcaacaggaatgagactctgtctcaaaaaaaaaaaaaaaagcgatgatcaaacacaatgcatcaacctcccggagccgtataaaccctaaacctaaaccaggaagcaggcaagcctgtgtgtgagtttccactctattgctggtaccactcggctctggcaacctggaaggccaccttcccctgttgttactgtgtaaggaggaaggagcactggtttgcaagtcagaagcctgggttgaagcctctgcttgagttcctgctggctgtgggaatgtggggttacctttcccggctggcctcgtttcctacatgtccaatgcaggggttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagccttttttttttctttttttgagactcttgctctgtcgcccaggttggaatgcagtggcaaaatcttggctcactgcaatcttcgcctctcaggttcaagtgactctccttcctcagcctccctagtagctgggattacaggcgtgcaccactatgctcggctaatttttgtatttttactacagatggggtttcaccatgttggccaggctgatcttgaactgctgacctcaggtgatctgcccgcctgggcctcccaaaatcttgggattacaggtgtaagccactgagcccagccggattataatagccttttcatgcaccaggggctttatactcattatctcatttcattcatatgagttgaagtcagcttatcccccatttcacagatgaggaaaccaaggcccagagaggttaggaatttgtccaaggtcacacagccaggaagtaggattcaaacccagacagccaggctgtaacacctgggctcctctcaggctcatgcccttcccaggggtctgggaagccctgacctgcagcctgtcacctttgtttaccccccagcctccaggatattatgtgtgcaccggcgtgggatcctggaactggcaggaattgtgggttgtgttggtccctgaactcccatcgcctatgtgaaatatggttgcttttgtggcttgggaggccatggccagccccgcgatgccattgactggtgagtgcatgcctgggaccaggctgcaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtactagctgtgccttaccctggccatgggctgaaaacgttgccttaaaaaattggccaggagcggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaataataataatataaagtgaccaggtgtgttgactcatgcctgtaatcccaccactttgggtcgaggcaggaggatcactggagcccaggagtttgaaacgagcctaggcaacagagtgagaccctgtctctatattaaacacacacacacacgcgcgtgcacacacacacacacacacacacacacacacatacaaaggcagccagactatgcactaggaactgccctgggaatccctttgtgttctcacaacaatcccatttcacatgaagaaacctaggcacagaaatattcagtaacgtgtccaggtgcggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagctgagatcacaccactgcactccaacctgggtgacagagcaaaactccgtctgaaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatgtttccatgacttccactcatttacccccaaggctgttcttaaagacgggcatgacagttatgcccattttacagatggggccctgaggctcacaagggcacgccactcacccatttccacaaagctatagttagttagcagagggcagaattcggccgcctctcccctagcttgaaggctgtgattgacacagaggtttttttgttgtcgttgctgttgtttgttcctttttcttttttttgagacagggtcttgctctgtcatcccggctggagcgcagtggtgcgatgtcagctcactgcaaattctgcctccaagatgcaaatgattctcgtgcctcagcctcccaagtagctagaattacaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcccaggtactcaagaggctgaggcaggggaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggactgcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcagagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctgacatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcatgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctatgattaaaaacctcaggtccctcaggcaatcataccagatattgaaacaaagcaataacataaggactgcagtattcattttatttttatattatttatttattcttcattagtttcttgagattatcatccgctgagggtggaaggggagtgagcagacacactcgggaggtgtcttgagattatcatccgctgagggtggagctgagggtggaaggggagtgagcagacactcggcaggtgtcttgagattatcatccgctgagggtagagctgagggtggaaggggagtgagcagacactcgggaggtgtcttgagattatcatccgctgagggtggaaggggatagagcagacgctcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacaactggggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacctaaagaatacttttgtccatggaaaaatgaggtgggaattctaaacaaagcaagttttaaaactgtgtttcacttcaagtgtagaagtcccatcgcgtgtaatcataggactcggcagcttttgaaggtacagaggccacacaagaaccagcttagctgagcatcatttaaggccttcatttggaattgtccctgtgggtaataagttacattcactcttcactaatttacagtcagggcccatttgctattacaaatatggaacctctgacacttagaatattagatgggggccccactgggtggggatgaaggtgtttttgcgcaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctgtaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcacctgtaatcccagctactcgggaggctgaggcaggggaatcatttgaacctgggaggcagaggttgcaatgagccaagatcacgtcattgcactccagcctgggtgacacagcgagactccatctcagaaaaacaaaaacaaaaacaaaaacaaaaaaaactgtacagtctgatccaaactgttgctgtattgattcctcctcttgcttactgcctgctgacttctgagatgatagcttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaatggacacctcccattgagggataaaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcaaaagctcattttagttcagtgtgaaaaaccagacctcaccaattcatcacaactaactccatcggaagcagaggattgctcctcatctgactcctcctgtgtgagactgattctcagtcagaggctgatgccggaactgagaccatcagccatagagagatccttccagaatatggtgtcattaaccctgcagttcactactgcactttgccatgattcaggactggaactcttgtcatcgactttaaagatcctgaaaaggcaatctgaatgctgggcgcatctattgaattagaaatgatgggaatggctcctaagtcagggtgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcgtgatcctaaggatctcacctgatacttggttttataggaaggatgtgtaaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccctggcctttgtagggactgagcctgcacagacgacctcaattgcagcctgtatggaggacccctgaccatcccccagaagtagactcccatctcttctgcagcaagataacatgctactaggtctcagttcattgctaaatattttttaaaaagtatctcacatttaacaaaaaaagatcagtcatatggcagcaaaatacaatgtaatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccctgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaattggccgaatgtggtggcacacacctgtaatccaagctactcgggaagccgaggcagaattgcttcaaactgggaggcagaggttgcagtgagccaagattgcaccatagcactccagcctgggcgacagagcgagactctatctcaaaattaaaaaaaaaaaaaaaagcctgggtgtggtggctcatgcctctaatcccagcactttgggaggctgaggcgggtggattacctgaggtcagaagttcgagaccagtctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacggcctgggcaacaagagcaaagctccgtctcaggaaaaaaaaaaaaagagagagagaaaggaaaaccaatgccagtactagcaactcctcttcccctgaaaaaatgacaaacaagattgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaacggacctcagcccttggtgagagtgaggagaggagaaggtgagaaacctgagggcaagaagctgttctttccctttccagggcaaactcatttccacactatggggactccaacagagccataccttcctgtctacggcagttggacctcctggctctctgctgtacatccgtggatccatcatgtccattttgagacgggaagatagtcttcaggaaagacacctaggaaataataatataagaatgacggctaggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccaagctactcgggaggctgaggcagagaaccgtttgaagctgggaggtggaggttgcagtgagccgagatcacaccactgcactccagcctgagtgacagaatgagactctgtcacacacacacacacacacacacacacaaacacacaagaatgacatgaggctggcatggtggctcactcctgtaatcccagtactttgggaggccgaggcaggcggaacacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaggttgtgttgagctgagattgtgccattgcactccaacatgggcaacaaaattcaaactctgtctcaaaaaaaaaaaaaaataggccaggtgcggtagctcacgcctgtaatcccagcactttgggaggccgaggcgggtgaatcacggtccagagatggagaccatcctgggcaacatggtgaaaccccgtctctactaaaaatacaaaaattagctgagcatggtggcgcacgcctgtagtcccagctactccggaggctgaggcaggagaactgcttgaacccaagaggcagaggttgcagtgagccaagatcccaccactgcactccagcctggtgacagagtgagactccgtctcaaaaaaaaaaaaaaaaatgacatgaatatacttcacacaactgaactgtacacttcaacatggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaatgcaaaacattctcactaatgattgaattcccaccaagatttccatattatcacagtatgcttttaatcttcgaagatattaaatatttgttctcatcatagctaaaatgcaacgcaaatcccatctgagatgtgggtcagatacctatgaatctcctgaggtagtcattgaaatgacttttttcttgagacggagtgtcagtcaaccatgctgaagtgcagtggcgctaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaatttgttttttcctgatttctgcacataggataaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatgacacccatgatgtccctgcttaggaggtaatgactagatgacaaggacaaagatgagaggtacaaagttgtccaagtccaacagctcaactgaactttcctaaatggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacacaaattagctgggcatggtcgtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaaagcttcctccaatttataccaaaaattctctgttcaggactaagtggcatagagaatgttaaatgtgcctagatatcttcataactcatatattttctgttttctacatatcttgaaaggcagtgccaaatgacgtgtaattatctaggcagtaaaactgaaacatacttcctcttcccttgaatatcaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatacggatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaattttttttttttttttgagacagagttctgctccactcagtcgcccaggctggagtgcagtggtgcaatctcggctcactgcaacctccagctcctgggctcaagccattctcctgcctcagcctcccgagcagctgagattaccggtctctgccaccatgcctgactaatttttgtatttttagtagagatgaggtttcaccatgttggccagtctggccttgaactcctgacaggcgatctgcctgcctcggcctcccaaagtgctgggattacaggtgtgagccaccgtgcccagccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagtgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctgggaatacaggtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaatacaatgaagagattatttcattcacaaataagtatcgaattttagttcttaaaaagtaacaaggtgggccgggcgtggtggctcacgcctgcaatcccagcactttgggaagccgaggtgggtggaccacgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaattaccaaggtggagatcatgaaaatggcatgaatagtgtgggatttctctaagattgttgatattaattccattagactcttatgtgagtgaagacaaagacttcccctgagtaagttcagacagcttgtgataacatttctacatcaattcctcaggatttaactatatattcttgaaaacatctcaattttaaatgtttctttcaagatggtgaattaaacagagatagcccttcaacaggttgaactcagcatatgctgagtctgaaatggaaatgatggagttagagaagcatacaacaatggtaatgatttcagaaatacggtgttgagcagaataaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatagaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcggatcacgaggtcaagacatggagactatcctggcgaacatggtgaaacccagtctctactaaaaatacaaaaattagccaggcgtggtggcctactaaaaatacaaaaattagccaggcgtggtggtctactaaaaatacaaaaattagccaggcattgtaatctgagctactcaggaggctgaggcaggacaattgcttgaaccccggaagcggaggttgcagtgagccgagatcttgccactgcactccagcctgggcgacagagtgagactctgtctaaaaaacaaacaaacaaaaaagtcatcaaaccagatgacacaaatcaaatgacatttcactttgttttggtccgttttgtttgttggagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccaacgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggctccctgaggcagccaggacagaggtggaggtggcttagggcagggcggagggaaggggacggggaccggggccggatctgagttggggagggggaggggagggggaggggaaggggaaggggaggggaaggggagaagtaagggaagggaaaggaggagaagggggctgttggggaggaggaggaggagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaagtagtgcccgcatcatcccaatgacccctcccccatctcagtcccccacgctcctcccaaggccaggtcctctctggaaccttcacaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacaaccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgcgtgatctcaaatcacccctaacccacctagacattttaacatccgaaaccgagtgatgatgtccttatctatattatcttactgcccgtgtgtgtggactttaaattctgaacccaaatgagggggagaaaaccaagctgactttcatgactggcctctcagggatgtccaaggaatctgtgcatttcaagaaacaaagctcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactctctcaggcctctggcagctgaaaagcactgctttaaatccctttaccatttactatgacataaggttattgtaaacaggaaatattctattgatgctacaaatggaaagccaatgcctttaccataaatagaaaaacaaccctaagaagcaagcaaaacaaaagaaaacaggggctgggtgtggtggctcacacctgtaatcccaccactttgggaggccgaggtgggcggatcacaaggtcaggagttccagaccagcctggccaatatggtgaaaccctgtctctaataaaatacaaaaattagccgggtgtggtggtgggcacctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggggttgacacgagcctggccaatatggtgaaaccccatctctactaagaatacaaaaattagctgggcatggtggcgcatacctgtagtcccagctactcagaggctgaggcagaggaattgcttgaacccgggagacggaggttgcagtgagccgagattgtgccattgcactccagcctgggggacagagtgaaactctgtctcaaaaaaaaataaaaaatatatatatatgtgtgtgtgtgtgtctgtgtgtgtgtgtgtgtgtgtgtgtgtatctctataaatctcaaaaataaaagatcatttttgagattatcattttaaaagacaagataatgttcaacttaatgaataatttaattattactactggactttttgtagactgcacagagcattcaaaacaaatgaaggagaataaaaaatatgtattacatgttgtaaaataaatgtgatgtggttaattcttttattcaaaattatagaacatatatatgtactgtagaatgtatttcttattatgagtcatgttaaaaagtagtttagaagctgttgatttgaatttccttttcaaattttgcaggataatttttttttttttttgacagagtctcgctctgtcgtacagtctggagtgcaatggcgtgatctcggcccactaaaacctccacctcctgaatttcagcaattctcctgtctcagcctcctgagtagctggaactacaggctgacaccaccatgcccggctaatttttgtatttttagtagggacgaggttttgccatattggtcaggctggtctcgaagtcctggcctctggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgagactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacgtgctgctgcagctccttggtgagctggccctggtcatgggacaggaaccgtggggtcaggacaatagagagcttcaccatttgcagaatgagaacaggggctcatgatgagtgccaacctattagacaattttaaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttcggtcataattagtgggatccatttcactattattggatatacagttctgtgcctgaaacctacaaaaaaagaaaatgttaagtctaaaaagcattagtgatttctcatttttacattactaattataaccctgtttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataacgagaatccttagctcattcggttgtggtgaggggtgaatgatttggcacacaggaggggcttgttaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggcttctgctgcatctgccttctcagtgttcacctaaggacttttgtattttcctcctcacatccccacagaaggggttcaggctgccgaacacagctgggtgatgccagggcagtggccacctgtgccagccctgtgaggtagctggaggatcattgctccttccttctcaggctctgggcagatgccagggctggggtgacccatgccctcaagtttcttgctttggagggccacattttcccttggcaaagagggtaaaggtcacaggatgccggagagctgtgacttctctgtgccctgggcccaaactatgaagacctgacacactatgctaaaagtccaaggctgggtgctccccagagcttcttgcctcaccacttctgctgagggaggaatgaatactatgtcctcccagagctttgggagcttgtagcaagcagcctccccagcgcaaaatctcttggaaacctctaactgtgtcggaaacattagtgcaaatgttgcatcctatttcccatatgtccgcatgttttaggaaaaaaccctcaatttcctaaatatgcaagaaaaattggtattgtaggacaatgtgactttttaaaaaatgttatttaaacatcttccccacctccttttctgccctccaagactgccaaatacttgttgaacaaatattattaaatgcctactacgtgccagccatgattcatggtcttggggacacagcagagaacgaactgacaggattcctctcttatgtaactcacattcttatatgataatgataagggttaacattaattaagctgtcactacgtgttagtcacggtgcagtcattcccacacattattacacttaaacctgctagcaagcttgcaaggtagttagttgtttttcctttaaaaactgagtctcagaatgatgaagcactttgtccaatgtcacacagctagtaagtgtggagaccttgcatccaatcaatgcccgtctcattctaaacaccacgttatgtgttctccagcccatggagaataattttaacacagtcaatgaaatttctacacaacaatgttcttgtctcaagtccaagaaagccataatactggctttctggtgagtaaagatgccattctcatgtgtaatcaggtggcaaatggagatatgaccaaagtaaccctttgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaatgaacaccctttttaatagtgacctgtgattctgttttgatcaagtgttttcaaacttgacatctttgatgggtttctccagtgtcaaaatcctaaatcaggtctttttggcttaaaattaactttgggatttttccactgcgtcccttcgggagtctgaagaatgcatctctcatcttgtagagatattaagtgattcgatttatttggtagattatatgggcgggcattgtcaaatgtggtgatactgcatgggagggcactgtcaagtgaggtgacattagatctcatctcagttatatttatgggtatgttgttgatatacatgttccaaaaattacatacatttatacaaatttaatatgttatgatttgtaattttgatagttatactaaatatttgttaaagttatatttgtataaacatgttatgaatggctgggcaccgtcactcatgcctgtaatcccagcactttcggagacaaaggcaggtggatcacctgaggttgggagttcgagaccagcctgactaatagggtgaaaccctgtctccactaaaaatacaaaaattcgccatgcctggtggcacatgcctgtagtctcagctactcgggaggctgagacaggaaaattgcttgaacacaggaggcggaggatgcagtgagtcgagatcatgccactgcactcccacctgggcaacagaggtagaatctatctaaaaaaaaagttattaattatttctgaagattatatgaaatttataaaagtctggtggtcctgatgtgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcttgtttttgagacacagtctggctctgtcgcttaagctggagtgcaatggtgggatcttggctcactgcaagctctgcctcctgggttcacgccattctcctgcctcagcctcccaagtagctgggactacaggtgcctgccaccacgcccagctaattttttgtatttttagtagagacggggtttcactgtgttagccaggatggtctcaatctcctgacctcgtgctctgcccgcctcggcctcccaaagtgctgggattacagatgtgagccaccgcgcccagcttaatttttgcatttttagtacagaggaggtttcaccatgttggccaggatggtctcgatctactgaccttgtaatctgcctgcctcggcctcccaaagtgctgggattacaggcatgagccactgcaactgaatttttttttgtttgtttgtttgagacagagactcactctgtcacccaggctggagtgcagtggcatgattttggctcactgcaacctccacctcctgagttcaaacaattatcctgcctcgtccttcggagtacctgggattacaggtgagtgccaccgtgcctggctcatttttgtatttttactagagacagcgtttcatcatgttggccaggctggtctcaaatcctggcctcaactgatccactctcattggccttccaaggtgctgggattataggcatgagacaccacacctggctcagtaagtacattttttattatcaaaaaagagtagtgtatgattggcttattctgtgtagaatgtattttatcgatggcttctatttttataatttctgagttaagtaatttttaatgaatgctttttagtttggggcagattcagttgactaaagcacctcatttcccagatacatgaaataaaatatttggcttcttttccaatttcacactgatgttattttgtgaaaatcagtgctttaagataaatctttatactttaaggtaaacatgagaaacttgatctaatatttaatatttattcagttctacactttattaacttctacaccagcagatttaaaaattatgtaactatctcaagaagtttcacttgggtgtaacggttcacgcttgtaatcccagcactttgggaggctgaggtgggaggattgcttaagacaaggagtttgagaccagcttgggcaatacagcaagatcccatctctattttaaagaaaagtttcactttgggaggccaaggcaggcggatcacaaggtcaggagatcgagaccatcctggctaacatggcaaaaccccatctctactaaaaatacaaaaaattagccaggcgtggtggtgggcacctgtagttccagctactcgggaggctgaggaagaagaatagcgtgaacccaggaggcagagtttgcagtgagctgagattgtgccactgcactccagcctgggcgacagagcgagactccgtctcaaaaaaaaaaaaaaaaagtttcagcaaattccacctaagaattccaccagagttctgttgtctccaatgtcatgttccacagatttcaagttgtgaagccctgaactgttaatttatcttgagaatgtacatttaagcttaatttaagactatatacctaaaaattgagcatataatttgtataatttgtttatgtaagtttttgtaagtcataagtatgtagtttccaagtatataatttatctgaatgtaataggcattaatatattttacattattgggaccataatacagaaatttctaaatggtttgtaaaataacttgttatttgcaatgttgtaaaagtagttaatacaatggaaaaactcataataagaagatacattttaacatcaagaagtttacccaaggtaattatgaatactacctggcaaactttacagaagctgtggtatcacttttatgatagaagaatagtgtttgcattttgtgtaaaagtacttggggctgggagtagtggctcatgtctataatcccagtgctttgggaggtgaaggcaggtggatcatctgagcccaggagtttgagaccagcctaggcaacatggcaagagcctgtctctccaaaacctatgaaaattagccaagcatggtggtgtgagcctgtagtcccagctacttgggagactcatgcaggaggatctcttgagcccaagaggcagaagatgaataaataaatggatgccactgaatgagatgaggtctctcttgaaggagagagaaaaagagatttaaatagtaacaattataataaggctgggcgcggtggctcacgcttgtaatcccagaactttgggaggccaaggcaggaggatcggttgaggtcacgagtttaagaccagcatggccaacacggtgaaacaatgtctctattaaaaatagaaaattagccagacatggtagtgcgttgcctgtggtctcagctactcaggtggctgagacaggagaatcgcttgaacctgggaggaataggttgtagtgagccgataaatataaaaagtattagagtcctaacagaggaaagtttccactgatcaccttttagctttgaacaatgcagaagcatttgcccagtttacttgtaattaaaaatcatgcatcattcacaatttatcagtcttttttgtttgtacaaaaactaatataagttattctcttttgtctgtattgtgactggtttggtgagagggaattaggccactcgagagtttgtgtgtgtttaaaattttctggccaggcacggtggctcatgcctgtaatcccagcacattcggaggctgaggcaggggtatcacctgaggtcaggagttctagaccagcctgaccaacatggagaaacccccatctctactaaaaatacaaaattagctgggcgtggtggtacgtgcctgtaatcccagctactcgggaggctgaggcaggagaattgcttgaacctgggaggcggaggttgtggtgagttgagatcacgccattgcactccagcctgggcaataagagtgaaactctgtctcaaataaataaataaataaatacataaactatcacagcataaagtaggagggatatttcattactgtctagttaaactggttaatgcggaaaggaagtctggaaattccagttttaaagtaaaattttggacattgtaggattgattatttggcatagctgtgatgtttgttgctgcattatggttttgttggcagggcagcctttaaggacctgtatattttcttctagactctatatattccccgtcagtattagttgcatggtcaaactggcaaattttaccataggtataaataatagagaatgtggaagaatagtgaatagtgtcagagatagttaaaggtccatacagaagtagagaaggtaataagtaatagtggcttggactaaatatttgttgaataaattttttaaaaaacagcctacctaaaatttgtgttgaagatatgaatgaatgaagtttccgcacccttatgtggagccctgataagtaagcaaaaataaggaagggtccccaggttggggagagccccaagttgaggagaataatgaacaattattgtatgaacaattgttagagacagctaatcacaaacaacctgtgggtacaatgacctcattccacatgtagcacccttaagcatgaccctgtaaaactttcctccagcccttgcctctttgcaggtagctccttctctgctgagctgcccactgcaacatattttcataatttctctaataaatctgcctttctttacctacaactatcttggtaaatagctttaccacctgcaaaactgaccctagttagttgctacccgatatggtttggctgcgcccccacccaaatttcatcttgaattgtagctcccatcatccccatgtgtcgtgggagggacctggtaggaggtaatggaatcatgggggcaggtttttcccatactgttctcgtgatagggaatacatctcactaaatctggtggttttataaagggcagtttccctgcacatgctctcttacctgctgccatgtaagacgtacctttgctccttctttgccttccaccatgattctgaggcctccccagccttgtggaactgtgagtacattaaacctctttttctttataaattacccagtctcaagtatttcttcatagcagtatgaaaagtaactaatacactacccgagacaccttaggagatttgtaacagctgtaatgccaggtccaccatatttttagcataaagcaaatgtttacccatgatatgactgcacaggctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggtaacatggaaaaacacagtctctacaaaaaatacaaaaattagctgagcgtggtggcacacacctgtagtcccagcaccttgggaggctgaggcaggagtatctcttgaacccaggaggtggaggccgcagtgagcagtgatcatgtcagaggcatgtgaaccagagcaactccatcttaaataggagctgggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagtgacaagagtgacctcccgtcatcctcactgctacactcctaccagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcctggctgctctgtctgtggagtagccattcttttattcctttactttcttttttttttttttttttgagatggagtctccctctgtcacccaggctggaatgcagtggcgtgatctcggctcactgcaagcttcacctcccgggttcacgccattctcctgcctcagcctccagagtagctgggactacaggcgcccgccaccacacctggctaatctttttgtatttttagtagagacggggtttcactgtgttaacaaggatggtcttgatctcctgacctcgtgatccacctgtctcagcctcccaaagtgctggggttacaggcgtgagccaccgtgcccctcctcctttacttttttaataaacttgctttcacttcacactgcaggatcaccctgaattctttcttgcacaagatccaagaaccttctcttggggtctggattgggacccctttcctgtaactatcatgccactgcactccagcctgggcaacagagcaaggccctgtctcaaaacaaaaaaaactaatatgacttaatacattcattttggagggcaagtctctcaaaatgggcctttcactgggggaaaatggtaaaaatactccctggtaattcaagaattgcagactcctgagatgctgctcatattagctgaacacttaccaatacttcacttttttccatatatactcaaggaacaagtgctatttaaagtgtttcactctgctgtgctaggtgcaagactataaagaggtgtgaggatcaacacttttatgaaaaccaacgtcattctgaatgtagtttcagatgctagtgcaaaggaagttcttggtatacggaaaaagtattcaacaataaattaggcatggttgcttccattttctgcctcacacacttttttttcgtggttaaagtgataaaacgtctatgatattttagattggcagttgcaaactagtggtcctcagcgggttttttatgacacctacaaggtttgaagactttgatttcatattaaaaatctgggtttcagtctgggtgtggtgctgcacttctgtaatcccagcactttgggaggctaaggtgggtggatcacctgaggtcaggagttcgagaccagcctggccaacatgatgaaactctgtctctactaaaaatacaaaaattagccaggcatggtggcatgtgcctgtaatcccagctactcaggaggctgaggcaggagaattgcttgaaccagggaggtggaggttgcagtgagccaagatcgcaccactgcactcaagcttaggcaatagagcaagactccatctcaaaaaatgaataaataaataaataaaatctgggtttcaggccagctgtggtggtgcactcctgcaatcccagcactttgggaggctgagatgggcagacagcttgaggtcaggaattccagactagcctgggcaacatggcgaaaccccatgtctacaaataatacaaaaaaattagctgggtgtagtggagtgtgcctgtaatctcagcaacttgggaggctgaagtgagaggattgcttgagcctgggaggttgaggttacagtgagccaagatcgcactcctacactccaacctgggcaacagagtcagaactactcttaaaaaaaaaaaaaaaaaaaaaaaaaaaaaaattctgggtttctggcatctcaaaaaaaaaaaaaaaaaggaaaggtcagggcagctacagtcctctattaagcaatgtgccacagcaggggtccctaattcctgggccatggacctgtactggtctgtggcctgttaggaactgggccacagagcaggaggtgaatggtgggtaacaactgaagcttcgtctgtatttctggccgctccccattgtttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattagcatcctgtgccccatcccttgccgcctgtggaaaaattgtcttccgcaaagccagtccctggtgccaaaaatgttggggactgctgtgctttagaatctgcctggaatctgcagcctctattatatagttccctatagactttgcttcctaccatcttacattctgccttataggcatttgtgtttgcaactcttgcttttgtcagtatgctacgctggtgacattgaccaaattgaccacacattaattataagcttagttggtgatgacctcaatggaataacatgacataagtattgtgacactacttcttgcatgtatctgcaggtggaattgtaaacctggtggtccgagatggtctaattcgatcttcctatgtatctccttatattaatagtggtaacatttgtggtggtgattcagcgtttcaatgcctcttctcatggcaacaacaaacgttttccgtctgaatcaacattaacctagatgttactgcggatcagaattagactctacattttcaaccacagaaatattgggcagtaaacatttttcttaatattgattgcctacataggttgtgtaattagcatatgtttatagttctatgatttgtgcatggctgctgcagagctggagggggtaaagcaacagtgttttctcagttgtgcgagcagcattacattataatgaataggtaatattaaactgggctgataagagttgcaaaagactactttaatgttcatatggaaccaaaaaagagcccgcattgccaagacaatcctaagcccaaagaacaaagctggaggcatcatgctacctgacttcaaactatactacaaggctacagtaaccaaaacagcatggtactggtaccaaaacagacatatagaccaatggaacagaacagagccctcagaaataataccacacatctacaactatctgatctttgacaaacctgacaaaaacaagaaatggggaaaggattccctatttaatagatggtgctgggaaaactggctagccatatgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtgaacaggcaacatacagaatgggagaaaactttcataatctacccatctgacaaagggctaatatccagaatctacaaagaacttaaacaaatttacaagaaaaaatcaaacaaccccatcaaaaagtgggcaaaggatatgaacagacacttctcaaaagaagacatttatgcagccaacagacacgtgaaaaaaatgctcatcatcactggccatcagagaaatgcaaatcaaaaccacaatgagataccatctcatgccagttagaatggcaatcattaaaaagtcaggaaacaacaggtgctggagaggatgtggagaaataggaacacttttacactgttgatgggactgtaaactagttcaaccattgtggaagacagtgtggcgattcctcaaggatctagaactagaaataccatttgacccagccatcctattgctgggtatatacccaaaggattataaatcatgccgctataaagacacatgcacacatatgtttattgcggcactattcacaatagcaaagacttggaaccaacccaaatgtccatcaatgatagactggattaagaaaacgtggcaattatacaccatggaatactacgcagccataaaaacggatgagttcatgtcctttgtaggaacatggatgaagctggaaaccatcattctgagcaaactatcatcaggacagaaaatcaaacaccgcatgttctcactcataggtgggaattgaacaaagagaacacctggacacagggcggggaacatcacaccctggggcctgtcatggggtgggggaagcggggagggatagcattaggagatatacctgatgtaaatgacgagttaatgggtgcagcacaccaacatggcacatgtatacatatgtaacaaacctgcacgttgtgcacatgtaccctagaacttaaagtgtaataaaaataaataaataaatagggctgatgaatcatattacagtaatccaatatttcccttgtaaagtccctgaggtttacagaaggaaatcttttctaataacaaaaagagtgaggcatgtgctttggtctttatttcctagttatacgatcctgggtaaggagctcaacttttctctgccaaaattaaatgaggattaaatgagatcatatatgtgaagttgtgaaagacagtacctggcacatagcaggatcaatcaatgttagtatctctaaaatagagattgagtctgaagatccacaaagtggtagaaccgatcttaagattcccaaataatagaattgtgctttatttgcctaagtagtatggtattacttattgtatgcccaggggatcttttttttttaaataatatttatttatttattttgagacagagtctcactctgtcccccaagctggagtgcagtggcaccattttggctcactgcaacctctacctacccagttcaagcaattctcctgcctcagcctccggagtagctgggattacaggtgcacaccaccatgcccggctgatttttgtatatttagtagagacagggttttgccatgttggccagattggtcttaaactcctgacctcaggtgatccagctccctcagcctgccacagtgctgggattacaggtgtaagccaccgcacccagacctaatgttttattttttggtagagatgaggtcttactatgtggcccaggctggtcttgaattcctggacctaagtgatcctcccaccttgacctcccaaattgttgggattacaggcatgagccaccgcgcccagttcccttcttaaatagttttaagggggagaagaaagaaaaagactgattttcttcccttccactaccaaaacaggcaaaacacaccagaacactttgcttagcatttcttttcttttctttttttgagaaagagtctccctctgtcagccagggtggagtgcagtggggcgatcttggctcacttcaagctccacctcctgggttcaggccattctcctgcctcagcctcccgagtagctgggactacaggtgcccgccaccacgcccggctaattttttgtatttttagtagagacgggatttcaccgtgttagccaggatggtctggatctcctgacctcgtgatccgcccgccttggcctcccaaagtgctggtattacaggcgtgagccaccgtgcctggccgtcccatcattttttaagataaattcacataccataaaacttaccattttattttctctctcttttctctttcttcctttctttctttcttttttttttttttttttgcaggctggagtgcagtggccctatcgtggctcactgcaaccttgaattcctgggctcaagagatcctcccacctcagcctcccgagtagcagtagctgagactatcagtgcgcaccaccaagcctgagtaattacaatacttttttctttttccttttcttgattttccgtagagatggggtcttcctattttgtccaggctgatctggaactcctgccctcaaaggatcctcctgtctaattctcccaaagtgctgggattacaggcatgtgccaccgcgcctggccaaatgcaccccctttttttaagtgtacaattcaatggtttttaatagattcacaaagtcatggaaccatcacacctatctaatttcaaaatgttttcatcactccaaaaaataaccccatatgggaggccgaggcgggcaggtcactcgagaccagcctggccaacatattgaaaccccgtctccactaaagatacaaaaattagtcgggcgtgatggcgcacgcgtgtagtcccagctgctcgggaggctgaggcaggagaatcgcttgaacccgggaggcggaggttgcagtgagcccagatcgccccactgcactccagcctgggcgacagagcgagactccgtctcaaaaatatctaattaattaataaaaataaaataaataaataaataaccccatgccttctgcctctgtggctttgcctgttctcggtattttgtgtcaatggacccatgcatgggggtgggccgggcacctttcaaacgttcagcccccaggacggcccgtggcctccggattggacggcgcgagctgggtgtgtgtgggtcgctcaatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtgaggggccgggaggggacctggggggtgggacccagtattgggggactggaggctgggactcggggatcaagcggctggagggagggcgctgcaggagcctggggacccgggcaggagccggggctctgagaccggagctgcttcagaggcctgaagggccagggcaaaggctagaggctggggtgtttgattgcgaaaatttgcaggaggcactggctggggagccgagaaattggggagccagaggtccaccaggtcaggaatttagaggactagggtcggggctcagactctggggttgggtgtagaccaaggctggaggtaggcagggctgcggaggtctttgccccctgaaaaaggcccacgggaaaataaaggagatcccagttcaaggccgtagcagctgcaatgaccgtgaaccagtcgtgggacagggaaggaaccgacctgctgttcagaaaatccacgcctggggccccggggccaacacaggaacaaaatgcaaggggatcagtgaccctgaggggcagagcaggtggaatctgaggttgggcctggatcttcagcaaattcatgcccaggggcctagtcctggtttggtaacaagattttcccctggggtctcacggaaaacatcaagggaccttggatccttgccatggaggactatatacctgtgagggttcagggaaccctctccttagaaaatccgacccgggcctggggtgtgggggacaggggcttgactgtggaaaccttctctactgcatacaataagaacaatggaaatggtacctgaaaaataccggggttcattcccttaacgagtcacaaaggactccaccaagaggcggattttgatcaatgggagttttacttggcacaagaaaggaagacactgggcgtattctcccaagtagtgtgtcccccagagaaagagacaggagggttttataaggtgatggagaaaggagagggtgcatgactgcatgtagagtaggggtcccagtgagtcatgatgctagcacataggctgcataggttgcataggttatagtcgtgaagctatagcttctcccggggtgaagactttagcatggtaatgaggagagttaacttgggttcatctacaagtaacctggggtcacttaggagctgatttaaacaaacagggtgacctcattccgcccagggttggggaagaacaggttgaggtcaggaggctgtaaaacaggctgatcgctcaagttggttaaattcttgtcatctttggagatcccccgtctgctcacaggaggggccctgtggcctctagcatcattgcgatttctagagccttgaaggggatggggtgggtaactggggagaaaatctctacgggtctcaagcctgaccttgggattggggatcacagatctccccccaaatgggagggaacttctcctaagggctgttggtgctttctaaaccaggttgaagtcagacaagccaccatcttgaagaaacctaccctgccccgtgtgccttatttttaagagttggattcacttcctttccctacagaccccaccagaaacacaaaccacctggttgcctgttgtcattgcggccaactacatggctgacggggtcagtgggtcaggagagcaggcagcctgagagctagggcctcctgttttatcagaaggtctgtgcctgtgcccggtgtgtgatttgcagactagatttgcaaacagcttcctagcacctgttacaggaacctggtacactggtgaaggggtaggggaccagaatgctatttaatcctcaaacaactagtgagattgttctctttttcttcttttttttttgagacagagtctcgctttattgcccagcctggagtgtgcagtggcccagtctcagctcactgaaacctgcatctccaggttcaagcaattctcctgcctcagcctaccaagtagctgggattacagatgcacaccaccatgcccacctaatttttgcatttttaatggagatggggtttcaccatgttggccaggctggtctcgaactcctgacctcaagtgatctgcccatttggcctcccaaagtgctgggattacaggcgtgagccctcacacttgagattgttcttaatactctcatattacaaatgaggaaactgagtctcaaaggggttctgtgactcacccaaagacaacacaatccaggcacttgatgctctcatggtgggaagtttgacagtttgcctgaaactgaaagatgctgagttactaacaagacttgaacctaagtccaggccaagctctctgatacagattcctggccagattgcagctttgctttggtcttcagtttttcttttctttctttctttttttttttttttgaaacggagtcttgctcttgttgcccaggctggagtgcaatgacacaatctcagctcactgcaacctcagcctcccaggttcaagcgattctcctgcctctcctgcccctcctgagtagctgggattacaggtgcccgccaccacgcctggctaatttttgtgtttttagtagagacggggtttcgccaagttggccaggctggtctcgaactcctgacctcaagtgacttgcccacctcggtctcccaaagtgctgggattacaggtgtgagccacctcacctggccggttttcagtttttctggttcagtttcccttacctcacatttcaatgaaaggggaagtggaaggggatagagtggaggtttgcgtaaggctttacatggaaattgcaggaatcaattgatctttgtgctggggctaccttggggaaccagagtcgtaacagattaacaactctggcttgggaatcagacacctgggttgaactctgtccgctattaacctctctaagctcttttcctcctttgtaactctacccaccttagcgaattgtaaggaggggcacatgaaatgaggcacgtaaactacatagcatttaattaatgctgggtaagtggaacacagtattaccaatattttgctgggtcatgtaagaatcgtctgtaattaactaataaagctcttatattccctccctcctaatcagggattggaaagaatttttaaagtactctcagttttacaaccttcctaaaataggagagctttgccttgctacctgaatttattgttacttttttccttttctttttctgagacagggtctcactctattccccaggctgaagtgcagtgatgtgatcacagctcattgcagcctcgacctcctgggctcaagcgatcctcccacctctgcctctggagtagctgggactacaggcacgcacccctatacctggctggtttttaaatagttttgtagagacaaggtcttgatatattgcccaggctgtgaatttctcttcagggatattgaagatcaaagtgtttttaggaagggtgaattggtgttccactttcaaattttgaatagggtaatactgatggaaaatttgtagtcgccagagtatttgggtccactggcctttttttatttttatttttttgagatagagtcttgctctgtcacccagtcaggagcacagtggtgcagtctcggctcacctcaacctccaaatcctgggttgtgtagtggtacaatcttggctcaccgcaacctccacttcctgggttcaagcgatccttctgcctcagcctctcaagaacctggaattacaggcatatgccaccatgcctggctaattttgtatttttagtagagacggggtttctccatgttggtcaggctggtcttgaactcccaacctcaggtgatctgccagatcagcctcccaaagtgctgggattacaggcatgagccacgcgcccagcccactagcttttttaaaaagacagaaattaaaatttcaaaatgttcaaatgttcaacatttcacaaaatgtttggaaggtagagaaagtaaccaatagacccactattgtaacctgattgtttttgtgaattgttagtttttgaaaaaataatcgttctgctataatttttatactctgctattctcacttcgtatttatcattcctttaaaatttatctagttttagagtggagattatgttttcttttttttttttttttttgtttgagacagggtcttgctgtgttgcccaggctggagtgcagtggcatgatcacagctcactgcagcctccacctcccaggctcaagcgatcctcccacctcagcctcctgagtagctatgactacaggcacgctactacacctggctaatttttgtattttttgtagagatgaggttttgccctgttgcccaggctggtctcttaactcctggactcaagcaatctgcctgcctcggcctcccgttacaggcttgagccacggcgcctgtctatgttctcttttcactgttgggtcagagggtcatattgttggatgatagtgatggttactttgcattttggaatgggaaacttaaacatgaactgttatacggtactctactgaatcttttaaaattttttttgggttttgcaaataggtatgagcattctccaaggaaaggatgacatatttttggacctgaaacagaaattctggaatacctatctggtaagataggcgtttgaaaatgtaatcactatatttttgtgtatatatgtatatatatgtgtataaaaatatatgttttgtgtttatatttataaagattaaaaaatcttttaattgacacatataagtacatattttcatatacatgtgataatttgacacgtgtttaatcacatcaggatttttttgtatgtgtgtgtgtatatatatatatatatatatatatatatttttttttttttttttttttttttaattaaaaaaacctttttcgagacagggtctcattctggcacccaggctggaatgcagtggcatggtcatggctcactgcagcctggacctcctgagctcaagcgatcctcccacctcagcctcctgagtagctgagactacaggcatgtgccaccacacccagctaattatttttaaattttttggtagagacagagtctcactatgtagcacaggctggccttgaactcctgtgctccagtgattctcccacctcaacattaagtacatttttattaaactattcctaaattagagctccagtttggttgacagaagggtccaatattttgacatagaaatcttaaagttattttgatagatgtatgaggagaggttttaagagtatctgtacttctcatgaactggaaagaaataatgtctctgggcccggtgcagtggctcatgcctgtaatcccaacacttgggaggctgaggcaggcggatcacttgacgttaggagtttgaaaccagcctggccaatatggtgaaaccctgtttctactaaaaatacaaaaaatagtcaggcacggtggtgcatgtctgtaatcccagctactcagtaggccgaggcaggagaatcacttgaacctggagacaggttgcagtgagccgagatcgcaccactgcactccagcctgggcaatacagcaagactccatctcaaaaaagagaaaaaagaagaaaagaaaagaaataatatctctgaattttagtccatgttctcagtgatttctgactttattatattaactcttagtaatgatcacaatttactttgtaaattttgcagccaaagggacaacaatttattctgtaaatttgggattctatttgcaaaatagagattatagattgtgagtggcttaatggaatcattcccacattcagagccaatgttttcaggtgagcatcctgcggagtcctggtgaaaagaactttaacatcacaaaggtattgatagagaaggagaaggtttccaagggttattccaaggtttgaagcaaatcagcatttttactgtttgctcggcacaaatatatacagtccagtccaatacatatttattcattgattcagttaatatttattgaacagtgtccttaaggcctggcaaaatcagggatggttttcatctctgccctagagcatgtttgattgcattcatcacaaggaggtaaatctttgggattacagaatgttcgcagactggcctagggcttcacatgttcttccttccctatcaaaagcagtgttgagccacacccagctattacctccacagcttctagcatcatctgttggatggtaccaggcccctgagccagcattacttgatggctagaggcagaggatggagaggtttgaagtcagaggcttcccctgagcctctatactcaggaacagtaactataagtgtgttcagaactcttgtgatttctcttagggcagaaattgaggaccccatggtgacaaccaaatgtgattttcttctggttttgttttttgtttgtgtgttttggtttttttgtttgtttgtttgttttttgagacggagtcttgctccgtagcctaggctggagtgcagtggcactctgcaacctttgcctcccgggttcaagcaattctcaattctcctgcctcagcctcctgagtagctggaattacagacttgcaccaccacatccagctaattttttgtatttttcagtagagatagggtttcaccatgttggccaggttggtcttgaactcctgacctcaggtgatccgcctccctcagcctcccaaagttctgggattacaggcatgaatcaccatacccagccacttcttctgttttactttagaaaaaggaacaagtttttccattatgttgtaaagtctatggagatatgtacatctaacttttttttttttttttttaaagagcaaggaccggaggcagtagctcatgcctgtgatcccaacactttgggaggtggaggcgggtagatcacaaggtcaggagatcgagaccatcctggctaacatggtgaaaccgtgtctccactaaaaatacaacaaattagcagggcatggtggcacaagcctgtagtcccagctacttgggaggctgaggcaggagaatcacttgaacccgggaggcagagactgtagtgagctgagattgcgccactgcactccagcctgggcgacagagcgagactccgtctcaaaaaaaaaaaaaaaaaaaagagcaagaagtaggcagctcacacctgtaatcccagcactttgggaggctaaggcaggaggatcactagagcccaggagtttgagaccagcctgcgcaaccatagtgagaccccatcgctacaaaaataaaataaattagctgggcatagttgcaagtgtctgtggtcccagctgctcgggaggctgagatgggaggattgcaagcctgggaggtcgaggctgcagtaagctgtgattgcaccgctgcacaccagcctgagtgacagagtgagaccatggttcaaaaaaaaaaaaaaagagagcaggaagtagaattgggaaagaagcttcaggcagggatttgtaaatgaacaaaaccacaggaacatttgcatactgtttaaaaaaaaaaactggttacaatgagtgagtctcatctaccctcaggagaagaaagagggcaaaccagtagtctgaagcccagcccatctggagattttttgggaagatttcctttaaagaggcaggatggctcacgcctgtaatcacagcactttggtaggccaaggcaggcggatcatgaggtcaagggatcgagcccatcctcgccaacttgatgaaatcccctctctactaaaaatacaaaaattagcatgagcccaggaggtcgagactgcagtaagctacgattgtgccactgcactccagcctgggtaacacagtgagaccctgtctcaaaataaaaaaataaaataaaataaagatctgaagttatgcacatactgggggacaggtcattccaggggcagaagagctgagtacagttgacaatgcgtaaagcaccatggtatgcctggaggggagaaaccacaggcagtttggtgttcacagagtatttgttgagcaacttggaatgagtttggatcctggagactgttgaacacccagagctgaggatcttgaacttcacagttaggtaatggcagcaaaggaaaccaaagtgggtggttatcgtgaccaagttcacataagaaataaggaagcatatcaggtgtggtggctcacgcctgtaatcctaacactttgggaggctgaagcaggaggatcccttgaagttaggagttcaagaccagcttgggcaacatagcaagaccctgtctgtatttaaaaaaataaacatggtggctcacgcctgtaatctcaccactttgggaggccaaggcgagcagatcatatgaggtcaggagttcgagaccagcctgaccaacatggtgaaaccctgtctctactaaaaatacaaaaaattagccaggtatggtggtgagtgcctgtaatcccagctactcgggaggctgaggcaggagaatcacttgaacccgggagacggagattgtagtgagctgagattgcaccactgcactccagcctgggtgacagagcaagactccatctcaaaacaaacaaacaaacaaaaaagaaatgaggtgagttcagcttgggaaatgttgaatgtcagatgcctttggcctattcagagggagattgccgaagcacagaggagagttcatggcagggtttaattatttttagcgctcacatgtcccagattcggccagtgggagttcccccaagctggttcctgtgtcctgtgcatcacccatcttctttctcctttacttctttcttaagccacttcctttctggcatgacagcgtgttccaggatcatcttgtacttgcacctgccctgccctggccctagaatcagccaattctttgaggcatcctgcttccttttagtgggggaatgatttgagaacaaaatatactactacatgatactacattctgacaagaaaaaaaacacagccataagaaataaagccatggccaggcacagtggctcctgtaatcctaaccctttgggtggcggaggttggaggattgtttggggtcaggaattcaagaccaacctggcccgcatagtgaggcctcgtctgtattaagaaaaaaaaaaaaaagaaagaaggaaagccatgtttggataagtttagtcttctgattatttttgctaaagttttaattttttttttttttttgagacagagtctcgttctgttgcccaggctggagtgcaatggtgcagtctcagctcactgcaacctctgcctcccgaattcaagcgactctcctgcctcagcctcttgagtagctgagattacaggttcctgcaatcacgtcctgctaatttttatttttagtagacacagggtttctacatgttggtcaggctggtctcaaactcacgacttcaggtgatctgcctgccttggcctcccaaagtgcagggattacaggggtatattttatatttaaagcatatttaacaattaagggccaggctcggtgtctcacgcctgtaatcccagcactttgggaggctgaggtgggcagatcacctgagctcgggaatttgagatgcacaacaagagcgaaactccgtctcaaaaaaaataaataaatataaaatatacattatggccgggcatggtggctcacgcctgtaatcccagcacgttgggaggccaaggcgggcagatcacctgaggtcaggagttcgagaccagcctggccaatatcatgaaaccttgtctctactaaaaatacaaaatttagccaggcatggtcgtgtgcacctgtaatcccagctactcggaggctgaggcaggagaatcacttgaacccaggaggtggaggttgcagtgagccaagatcgcaccattgcactccagcctgggcaacaagagcaaaactccatctcaaaaaatatatatatatacatacacatatacgtatatatgtgtatatatacgtatatatgtatatgtatacacacattatatgtaatatctacttttaaatataaacataaatattataaagcttttattgcaattgttcattttagaaacttcagaaaatacaaattagtaaaaagaagaaaataagtctgtaataccacttttaaggactattttgaaaacctctagctgttttttgagataaatttacataccaagacttttttttaaaaaatcataatgatgactttttcataggactgtgtaggataaagcttgtgaaatgtctatctaacatattttgtaatatatgaaaatttcagctaaacttgttctatagcatcacatggtttcaatatattattagaaaatcattccataaacaatggtttggtatatagtttcaacaattcaaggctgggcacagtggctcatgcctgtaatcctaccactttgggaggccgaggcaggcaaatcacctgaggtcaggagttcaagaccagcctggccaacatggtaaaaccctgtctctactaaaaatacaaaaattagccgagcatggtgtcaggcacctgtgatcccagctactcaggaagctgaggcaggagaactgcttgaacctaggaggcagatgttgcagtgagccaagatcttgccactgcactccagactaagcgacagaatgagattccatctcaaacaaaataaataaataaaataattcagcaggatgaggtggctcatgcctataaccccagcactttgggaggctgcagtgggactactgcttttgcctgggagttcaagaccagcctgggcaacatagagataccatgtctcagaaaaaaaaaaattaatttaaaaaaaaagaattcattgatgattctgtatttacaaatatattcctgcatcatttgttcatggtaaccaggaaattgcaatgcatatatacatgctgtcatttccaaagccgctgtcttccagaattggtactgattctagtagacttttcattctggtgttaaaaatataattaatataggaatgtcttctacctaatagcttttttccccacaactccccaaccccctcactctagaggccttaagtagtctaagttaatcagcttagtctgaaatataatactacctaggcatcttgttggcctagtatttcttactcttttatggaatgaactgtgcaattgttttgtgtggttaaaaggtattctaggtcaggtatagtggctcacacctgtaatcccagcactttgggatgccgaggtggtggatcacctgaggtcgggagttcgagaccagcctggccaacatggtgaaaacccgtctctactaaaaatacaaaaattagccaggtgaggtggtgtgtgcctgtaatcgcagatactcaggaggcagagacacgacaattgcttgaacccaggaggcagaggttgcggtgagctaagattgcaccactgcactccagtctgggcaacagagtgagaccctgtctcaaaaaataaaaaacaaaataaataaataaaaaataaaaggcaatctaataaagttgttgctttttttttttcccaattccagagtggactgatgtactggccctttgtacaggtaagttccacctactcagtaatatgaactcagggctttggtttccatgtggccctaacggactctctctctgttccagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatacaaagcctgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacactttattaacttctacaccagcagatttaaaaattatgtaactatctcaagaagtttcacttggacgtagtggttcacgcttgtaatcccagcactttgggaggctgaggtgggaggattgcttaaggcaaggagtttgagaccagcctgggcaatacagcaagatcccatctctattttaaagaaaagtttcactttgggaggccaaggcggttggatcacaaggtcaggagatcgagaccatcctggctaacatggtaaaaccccatctctactaaaaatacaaaaaattagccaggcgtggtggtgggcgcctgtagtcccagctactcgggaggctgaggcagacgaatggcatgaacccgggaggcagagattgcagtgagctgagattgtgccactgcactccagcctgggtgacagagtgagactccgtctcaaaaaaaaaaagtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgtaggccgggcacagtggcttacgcctgtaatcccagcactttgggaggccgaggcgggcagatcacgaggtcaggagatcgagaccatcctggctaacatggtgaaacgccatctctactaaaaatacaaaaaattagctgggcatggtggcgggcgcctgtagtcccagctgctctggaggctgaggcaggagaattgcatgaacccgggaggcggagcttgcagtgagcagagatcaggccactgcactccagcctaggcgacagagcgagaatctgtctcaaaacaaacaaacaaacaaaaaactgtacccaagttaattataagtactacctggtgcaaaactttacagaagctgtggtatcacttttatgatagaagaatagtgtttgcattttgtataaaagtacttggggctgggcatgatcgcttatgtctataatccaagtgctttgggaggcgaaggcaggtggatcatctgagcccaggagtttgagaccagcctaggcaacatggcaagagcctgtctctccaaaacctacaaaaattagccaagcatggtggtgtgagcctgtagtcccagctacttggaagactcatgcaggaggatctctcgagctcaggaggcagaagatgaataaataaatggatgcaactgaatgagatgaggtctctcttgaaggagagagcaaaagagatttaaataataacaattataagaaggctgggcgcggtggctcatgcttgtaatcccagcactttgggaggccaaggcaggtggatcggttgaggtcaggagttcaagaccagcatggccaacacagtgaaaccccgtctctattaaaaatacaaaattaaccggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcagaagcatatgcccagtttacttgtaattaaaaatcatgcatcattcacaatttatcagtcttttttgtttgtacaaaaactaatataagttattctcttttatttgtattgtgattggtttgatgagagggaattaggccacttgagagtttgtgcgtgtttataattttctggctgggcccggtggctcatgcctgtaatcccagcactttgggaggccaaggcgggcggatcacttgagctcaggagtttgagaccaacttgggcaatgtggtgaaaccctatccctaccaaaaatacaaaaattagccgggtgtggtggcttgcacctgtcctcccagctacttgggggtgctgaggcaggaggatcactcaagcccaggaggtggaggttgcagtgagccgagatcacgccactgcactccaggaagggcaacagagcaagactgtgtctataaaaaaaaaaaaaaagaaagaaaagtaaattaactttggtatttcaggttgtatttatatggggacttcacatcaactatgttcactacaattgaccaagttaagtgtagacagtctctttaatagagagattatctggaactgcaattttttttttttttttgagacagagtttcgctttgtagcccaggttggagtgcagtgtcgcgatctcgcctcactgcaacctctgtctcccgggttcacgccattctcctgcctcagcccaagtagcagggactaaaggcgcccgccaccatgacccactaattttttttttttttggatttttagtagagtcggggtttcactgtgttagccaggatggtctcaacctcctgacctcgtgatctgcctgcctctgcctcccagagtgctgggattacaggtgtgagccaccgcgcccggcctggaactgcaatttctaactcatacatcattgctataaaccttatttgtttactgtttctcttccaaggacggtcagtcatcctttaaaattcatttgaagttatgaaaagatagtttttgttacatgggaaatttacttttagtacagtaaaatgttatgtgaatttctacagaatgtttgctagaatgaattatatctaggatatgcttaacaatatattctggaggcagctttcatttgaaattaggttcatcttctgagagtattaaaaagttaatgggtttttgtgcctgaagattttgatgttgcatttggctacatttaatccactttcacccataaggtttagcatctaaaaaaattaaatcactgctaatgcaattaaaatgactgaaaaagtttcttttaatactttcaacagctgatacataaaaagggaaatctggaatttgaagataaagtatgtgctggagttgaaaggttaggaacacatgaagatctgtgaactgtagctaaccttgtgaatagaaggcagtaattactgagtaacatttttggtatatatcaagtaaaagcttgtcttttcctagttctcttctcctttgttaagtgtatccttctctaactacatctttattcatccttttcttccttcctctttctttgtccacaacccaaccaaacccactgctctctcctctcaccccctgcccgtgccatgaccacttgaacattccaggagggcagaataattgtaataaggctaagggcttattacacttcttacacttaaggactcaacagccttgctttagagaggatggtagcggaggatcctctctggtctctgtgagaagaaaagagaaaggaccatcctacggagaatttatttttatttttatcttttttgagatggagtctcactctgttgctcaagctgcagtgcaatggcatgatcttggctcactgcaacctccgcctcccaggttcaagcgattctcctgcctcagcctcccgagtagctgggactacaggcatgtgccagcatacccagcgaatttttgtatttttagtagagatgggatttcaccatgttgcccagactggtcttgaactcctgacctcaagtgatctgcctatctgtctatgatattttaggttggcagttgcaaactaatggtccacagcgtgctttttatgacacctagaaggtttgaagactttgatttcatagtaaaaatctgggtttcaggctgggtgcggtggtgcatgcctgtaatcctagcactttgggaggctgaggcaggtggatcacctgaggtcaggagttcgagaccagcctggccaacatggtgaaactgtctctactaaaaatacaaaaattagccaggcgtggtggcatgtgcctgtaatcccagctactcgggaggctgaggtgggagaattgcttgaaccagggaggtggaggttgcagtgagccaagattgcgccactgcactcaagccttggcaacagagcgagactccatctcaaaaataaataaataaacaaataaataaatatataaaatctgggtttcaggccaggtgtggtggtgcactcctgcaatcccagcactttgggaggcggagatgggcagacagcttgagcttaggaattccagaccagcctgggcaacatggcaaaacgccatctctacaaataacacaaaaacattagctgggtgtggtagagtgcgcctgtaatcccagctacttgggaggctgaggcgagaggattgcttgaggctgggaggttgagccacgatcacactcacacacttcaacctgggcaacagagccagactgtctcaaaaaagaaaaagaaaagaaaaaagaaaagaaaaaaggaaacgtctgggcacatgcctgctacagtcctctatgaagcaatgtgccgcagcaggggtccctaatccctgggccatggacctgtactggtctgtggcctgttaggaactgggccacagagcaggaggtgaatagtgggtggacaattgaagcttcatctgtatttctggccgctccccattgcttgcattgctgcctgagttctgcctcctcttagatcagcagcatcattagattctcataggagcataaaccctgttgtgaattgcacacacaagggatccaggttgcatattccttatgagaatctaattcctgatgatttgtggtggaacagtttcatcccaagaccattaccatcctgcgctccatcccttgctgcctgtggaaaaattgtcttccacaaagccagtccctggtgccaaaaatgttggggactgctgtgctttagaatgtgccttgaatctgcagcctctattgtatagttccctatagactttgcttcctaccatcttacattctgccttataggcatttgtgtttgcaactcttgtttttgttagtatgctacgctggtgacattgaccaaattgaccacacattaattataagcttagttggtgatgacctcaatggaataacgtgacataagtactgtgacaatacttcttgcatgtatctgctggtagaattgtaaacctggtggtccgagatggtctaattcgatcttcctatgtatctacttatattaatagtggtagcatttgaggtggtgattcagagtttcaatgcctcttctcatggcaacaacaaatgttttccttctgaatcagcattaacctagatgttactgcagatcaaaattagactgtacattttcaaccacagaaatattgggcagtaaacatttttcttaatattgattgcctacataggttatgtaattagcatatgtttatagttttgtgatttatgtgtggctgctactgagccagagggggtaaagcaacagcgttttctcagttgtgtgagcagcattacgttataatgaataggtaatattaaattgggctgatgaatcatattacagtaatccaatatttcacttgtaaagtccctgaggtttacagaaggaaattttttctaataacaagaagagtgaggcatgtgctttggtctttatttcctagttatacgatcctgggtaaggagctcaacctttctctgccaaaattaaatgaggattaaatgagatcatatatgtgaaggtgtgaaggacagtgcctggcacatagtgggatcaatcaatgttagtatctctaaaatagagattgagtctgaaggttcataaagtggtagaacagatcttaagattcccaaatgatagaattgttatttatttgcctaagtagtagtagattacttattgtatgtccaggggatccttttttttttttttaataatttttatttctttaagacagagtctcactctgtcccccaagctgaatgcagtggcaccattttggctcactgcaacctctatctccctggttcaagcaattctcctgcctcagcctcctgagtagctgggattacaggtgtgcaccaccatgcccggataatttttgtagttttagtagaggcaggattttgccacgctggccaggctggtcttaaactcctgacctcaggtgatccagctgcctcagcctcccaaagttctgggattgcaggcatgagccactgggcctggcctttttttttttttttgtgaggcaggatctcactctgttgcccaagctggagtgcagtggcactaccatgcctcactgaagctttgaactcactggctaaaaagattctcccacctcagcctcctgagtagctccatgggtatgcaccaccacaccccattattttattttttgagaaggagtctcactctgtcacccaggctggagtgcagtggcatgttcttgactcactgcaacctccacctcccaggttcaagcaattctcctgcctcagcctcctgagtagctgggattataggcgcatgctatcttgcctggctaatttttttgtatttttgtattttttaactagagacagggcttcaccatgttagccaggatggtctcgatctcctgaccttgtgatctgcccacctcggcctccaaaagtgctgggattacaggtgtgagccaccgtgcccagccctggtattttttttttttttttttgtagagatgaggtcttactatgtggcccaggctggtcttacattcctggactccgaccttgacctcccgaagcgttgggattacaagcatgagccacctcgcccagttcccttcttaaatagttttaagggggagaagaaagaaaaagactgattttcttcccttccactaccaagacaggcaaaacacaccagaacactttgcttagcatttcttttctaaagtgaccaaaatttataatagacacttaaaatgtgtactggaatatatcccaattatatccccagtctataactcagctatatgcagctcctttgtcttattaatgctatgaatcagcaatagtttatgttttcatatcacctgaggccatgcaatcctcttttttggttgttgaaataatttctataactatttcacaatttcaattgccaacattaattcaacagtatttaagctgtctgtcccagacactatgctagcctttggagatttccaaggtgaataaggtgaggacccggctatttgcctacggtctagcagacagacctttttttttaattttttgagactgagtctcgctctgtcacccaggctggagtgcagtggtgcgatctcagcttactgcgagctccgcctccccagttcacgccattctcctgcctcagcctaccgagtagctgggactacaggcgcccaccaccacacctggctaattttttgtatttttagtagagacacggtttcactgtgttggccaggatggtctagatctcctgacctcgtgatccgcccgccttggcctctcaaagtgctgggattacaggcatgagccactgcgcttggccaccttttttattttttatttttatttttttgataggagtctccctctgtctcccagcctagagtgcagtggcacgatcgtggctcactgcaacctctgcctccagggttcaagtgattctcctgcttcagcctcctgagtagctgcaacttacaggtgtgtgtcaccacacccagataatttttgtatttttagtagagacagggtttcgccacgttgtcaggctggtctcgaaatcctgacctcaggtgatctacccgcctcagcctcccaaagtgctgggattacaggcatgagccaccgcacctggccagcagacagacttctaagcaaattacagctaccactttttgtatgctcactaactgtagataagggtctatgccaagccctttacatcatgtggtaattgatatggtgtagttgagtggtttctaccatcgatttccttacctcccccacttcccaacagctcccagttcctttttggggatcttcccagaagatgactttacttggctcaagaggtggagcacatgacagattaagccaatcagggcgtttcatgccccttgctacagggttcagagacaatcatgttatctgcagctgcccaattagagtgaatctcataacctttgatggaaaaccaggacaaaggcatattctctcattgtgtcatagagatgttaatatagatgtaaggcctaggactaccatagccattttttgttaccgtgaaagacatggaggcaagagggtatcactgaaagaatctcagagaaaccctgatgatttcataacctctgatatagcctatgcccaaagcctgctctgggcttttctgttataggagctaggagattccctttatttttcaaaccactgggaattaggttttctgttacttgaaggaaagcatcataaaggatacacaggaccttttttataacacagtagatattattctcattttatttttgtgtgttttgttttgttttgttttttaagacagagtctcgccatctcagctcactgcaacctccacctcctgggttcaagcgattctcgtgcctcagcctcttgagtagctgggactataggagcgcaccgccatgctgagctaatttttgtatttttagtagagacagggttttgtcacgttggccaggctggtctcgaacccctggcctcaatggatccacccaccttggcctcccaaagtgctgggattataagtgtaagccaccacactcagctgattcatttattttcatttttttttgccatacaaaccaacaacttgcaaactcccattataaacatttccagaaatttatggggtacaggtgcaattttgttgcatgcatagatttcatactggagaagtcagagcttttaggctgtccatcacctaaatgacgtgtattgtactgaataagtaacttctcatcatccacccacctcccacaccctaacccttctcaatctccatcatctatcattccacactctacatttctgtgtacacattctttagcttccacttatgagtgagaacatgcaatatttgtctttctgtgtctggctggtttaagataatggcttccagttctgtccatattgctgcaaaggacatggtttcattcttttaatggttgaatagtattctattgcgtatatgtatcacattttctttttttttttttttttttgagacggagtctcgctctgtcgcccaggcggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcccacattttctttatccactcatctgaagatggacacttagattgagtccacatctttgctatagtgcattcactctcattgttatagttgagaaaacaaaggtccttgccctttgccactaagccaatacatggcagagtcaggttgatttccaaacccacactcttatgatcatgcttctagtaactccagtgcagtttaagaggtatatcaaagatacagtagtgacagccaggcatagtggcaggcacctgtaatcccagctacttgggagacaggagaatcacttgcaccggggaggtggaggttgcagtgaaccaagatggtgccactgcactccagcctggtcaacgtagcgagactccatctcaaaataaataaacaactaaataaataaaagggatacaatagtgacataaaggaatgatcagctcattgtgtgtgtgtgtgtgtgtctggtggccatggagatattccagggcaccagacatggacaaaagtatgaagtgaagggctcatggtatatgctaaataaatgtttctattttattttcctttgcgcttctgagaaatttgctgtgctagggaatcttagtgggaggttccaaatgtctctaatgggtccttaaaagtaacacaggggactgagagttactttcaaaaagctagtattttaaaacaggttgtgcagatgaattcagacttttgtttgtttgtttgagacagtgtctcattctgttgctcaggctggagtgaggcagtacaattatagttcactgtagtcttgacctgctaggctcaagcaatcctcctacctcagtctctggagtagctgggactacaggcctccacacctgcataatttttttttttttttttttttttttttgtagagacagagtttcaccatatagcccaggctggtcttgaactcctggcctcaggcagtcctcctgcctcggcctctgaaagcattgggattacaggcatgagccactgtgcctggcccagacaggcccagacttctttaccatggatgagatctttgtcaactcagtgtggccatctcacgctgctttgtcaacaagttctttttttttttttttttttttttttttttaatgagacagggtcttactctgttaccaaggctgcagtgcagtggttcaatctcggctcactgcaacccctgcctcctgggttcaggcaattctcctgcctccgcctcctgagtagctgggattatgggtgcccactaccacacccggtggtacataataataatttttctatttttagtagagacagggttttgccatgttggccaggatggtctcgaactcctggcctcaagtgatccgccctacgtggccatccaaagtgctggaattacaagtgtgagccaccgcgcctggccacattctatcatttttatattggtttagtccatcctgtctttgattccactgccattgcttatttcagatcattgctgtttctcatggagacccttgatactcagagtgtggtccatggatcagagtctcaacatcacctgggaacatctaggaatcttagatacccacctcagactctctggattagaatgtgcattttaacacactgaaatttgacaagcactaataaattttttcactagagtcttccaatgatctcccgactctagtttggttttgttttttcagagatagggtctctctctctctctctctctctctctctctcacccagttgagagtgcagtggtgcactccatagctcactacagccttcagctcctgagctcaagtgatcctcttgcctcagccttctgaatagctaggattacacatgcatgccattacatgcagctacgtttctactttttgtagagacagggtctcactatgttttccaggctggtctcgaactcctggcctcaagagatcattccaccttggcctcccaaagtgctgagattagaggcatgaaccactgcgctgggcccctgcctctagtttttttgtttgtttgtttgttttgagacagagtctcactctatcacaaagtctagagtgcagtggcgcaatcttggctcactgcaaactctgcctccagggttcaagcaattctcctgcctcagcctcctaagtagctgttccaagcattttgagaggtggaggtgggcagatcgcttcagcccaggagttcaagaccagcctggacaacgtggcgaaacccatctccaccaaaaatacaaaaaattagctgggtgtggtggtgcacctcagtggtcccagctagacaagaggctgaggtagaaggatcacttgagcccaggggcggaggttgcagtgagccgagatcctgcaactgtgctccagcctgggtaacagagcgagaccgtgaacattaaataaaaatggattgtctaggggagagagaagttgagaccaaaatagttcaatgctagtagagagtaagggacagagtataggttaataaatttagatttacctaggtagtatcagccagatttgtaggtcaaagtacaaatttacggccgggcaccgtcccagcactttgggaaggtgaggcaggtggatcacttgaggtcaggacttcaagaccagcctggccaacatggtgaaaccctgtctctagtaaaaatacaaaacgaaattagccaggtgtggtggcgctgcctgtagtcccagctactagggattctgaggaaagagaattgcttgaacccaggaggtggaggttgcagtgagctgagatcatgccactgcactccagcctgggccacagagtgagactgtctcaaaaacaacaacaacaaaaacaaagtacaaatttactggtttcaatgactagctcaaacaaaggtgtcatcagctgtcataggaaatacacaagataggatctggaggaagatattaaatttgaagtgcttctgggatatctagtctagtggtgctgcccaacaaagagttgtatagacacatctggaaatataagttcgtaaacttttagcatgtctttactcactttactgtttagtttaggtgaacctttttccagagggtaactcccctgcatagatgatggtaaaaaactgtagagactaaggttggggttataaatacacagtaaatataggtagaatgcaaggaattttttttttttttttttttttttttttggagagacacgatctcaccaagttgcccagcctggccttgaactcctgggctcaagcaatcttcgtgccttgaccttccacagtgctgggattacaggtatggggtaccacctccggccagatgcaaggattttatttcctggatggagcagcattttggagcatccagaaatatcagccctgtatgcaaggggatgctgttgaatcaattccacatgaaatagacaaggcatactagcagttatgttaggatgttattatttgagccatacacagatcagggggcactttagaatttttcttctgcttactcagttcattcatacgttcaacaagcattggctgggtatctaccacgtgcctttcaatatttcagctctgatgatttgaaagtaaatagaacacatttctacttcatgggtatcctcatgtaaatatgtgatttataaatgagttgtattactcacgcacatttcttttcttttcttttctttctttttttttttttttttttttttgagacagagtctcactctgttgcccaggctgcagtggtgtgatctcggctcactgcaacctctgcctcccaggctcaagcgattctcaagcctcagcctcccaagtagctgagtagctgggattacaggcacacgccactacgccttgctaatttttgtatttttagtagagatgggatttcaccatgttggccaggctgatctcaaactcctggcctcaagtgatttacctgcctcggcctctcaaagtgctaggattacaggcataagccaccatacccagccctcacacacacttctggtgagtataacttggcatgacacttttgaaggatggcttgataatataaaatgcctttaaaaatgtgcatatcctttgattcagcaatttcacatcaaggaatttttcccaaaagaataagatatctacaaagctttaactgcaagactgctcctcatattttgctgataatctcgagaatttaggaataacctgtttgtccccagaaccaaggagattggttatataaattattctatagctagcaggaaaccagtggatgattttctttttaatttttttttttttttcagagacaggttcttgttctgtagcccaggctggagtgcagtggtgtggtgatcacagctcattgtaacctcgaactcctaagctcaagcgatcctcccacctcagcctcccaatggaggtttttaagcaggagagtggcattggatgtgtgtgtgtgtgtatctaattttagaagtcgtgtggagaatggttttcagtagggagaaaaaaaacccagaaaagatgttttttgccacagtgtaggtcagagatgatgcaaaattgagctaacttaggcagtaggaaggaggaggagaatcagatttgggagctatttccaaaatagagtcaataggatttgttgactgactgtggcagagagtgttgggatgttgcagaataaggtaccaaggatatactgagatttccaactcggatggagcaggtatgggggctgatatagtgaatctgactttgaatatgatcaggttgaggttataaatccctcttcatgggcactgccatggtggtttcttgaaacacctttgagaggtgatgtgggatgtggcgaagtgtttaggctttgagactggctggctgagtttgaatgctggttctgccatgtgttagcaagtaatttacttacccaaactctctgagctacagcccctgtctcacaggatactacagcatagaatgaagaaggataaatctggtacagtgcccagcacatagtaaccacgcaataaacatcagctttaaaaaaacagacaatgcgggctgggcgcagtggctcacgcctgttatcccagcactttgggaggccgaggcaggcggatcacaaagtcaagagatcgagactatcctggctaacttagtgaaaccccgtctctactaaaaatacaaaaattagctgggcatggtggtgcatgcctgtaatcccaactactggggaggctgaggcagaacaatcgcttgaatctgggaggcggagattccagtgagccgagataacgccactacactctgacctggcgacaaagcgagaaagcgagactccctctcaaacaaaaaacagtcaatgctgcctgtaatcccagtattttaggaggctgaggtgagcagattgggctgaggttgggaattcaagaccagcctggccaaaaggtgaaaccctatctctaccaataatacgaaaaattagccaggcgtggtggttcatgcctgtaatcccagctacttgggacaggcgtggtggttcatgcctgtaatcccagctacttgggaggctgaggcaggagaatcgtttgaacctgggaggcggaggttgcactgagccgagatcgcgccattgcactccagcctgggggacagattgagactccatcaaaaagagaaaagaaaaccacaaaaaaactcagacaattctataatagagggagaatacgcatgcaacccagggatttttctcagataccctacccattctcaaatagcatgtgctctaagctcctatggtaaaagcttcatgcccctgcaaaactcacacacctgatcccactcctcaagcacttcatggagaagcagcagctcccagctctataacagataggggatttcaggtcctaagtcttgagagcaaatatttcctcaacttcttttctctctctcaagcctcctttaagaggaatacatactatgctttctggaactctgttctaccttccaaacccatttatatcttttacgattttttttccccaagattgcggatattttctattttttttctggagacagtctcgctctgttgcccaggctggagttcagcggtgcgatctcagctcactgcaacctccacctcccgggaggaactgccagaccatcttccaaagaggttgcaacattgtatattcatggtatgagagatctaatttttctactcaatgtcattttaatggtgtggtgttttgttttgttttgttttgttttgttttgttttgtttgagacaggatttcactgccactcaggctggagggcagtgatccagtcatagctcactgcagcctcaacctcctgggttcaagtaagcctcccaccccagccccctgagctgctgggaccacaggcacatgccaccactcccggctaattttttaattatcacttgtatagatgggatctccctatgttgcccaagctggtcttgaactcctgggctcaagcaatccttttgcctcaatctcccaaagtgttagtgagaggtgaagcccgctgcatttcctgtatggagtggggacttggagaacttttctgtctagctaaaggtttgtaaacgcaccaatctgcactctgtaaaaactcaccagtcagcgctctgtgtctagctaaaggtttgtaaacgcaccaatctgcactctgtaaaaacgcaccaatcagcaggacatgggcagggacaaataagggaataaaagctggccacctccaaccagcagtggcaacctgcttgggtccccttcaacgctgcggacgctttgttctttcgctcttcacaataaatcttgctgctgctcagtctttgggtctgcaccacctttgtgagcaataacactcactgcgagggtctgcggcttcactcctgaagtcagcgagaccgtgaacccaccggaaggaaaaaactccagacacatctgaacatctgaagaaacaaagtccggacacaccatctttaagaactgtaacactcactgcgagggtccacagcttcattctttaagtcagagagaccaagaacccaccagaaggaatacattccagacacattaggattacaggtcaatgtcattttaataggtttttggttttgatttggagacttcatttggtaaattctcaaagagtcagcactcaaaatatcagctaacacgttgcttcaacccaagaaggatgatgatcatgatgatgatactaacttgtactgaggacctcctatgggctgccatactttatctcatttaatcataatagtcctctggggctgggtgtggtggttcatgcctataatcccaacactttgggaggcctagtcaggcggatcacctgaggtcaggagttccagaccagcctggccaaaatggtgaaacctcgtctctactaaaaatacaaaaattagccgggcctggtgatgtgcgcctataatcccagctactcaggaggctgagacaggagaatcacttgaacctgggaggtggaggttgcagtgagccaagatcacactactacactccagcctgggcaacagagtgagactccatgtcaaaagaagaagaagaatagtcctcaccactacactccagcctgggcaacagagtgagactccatgtcaaaagaataataataataataataataatagtcctcaccactacactccagcctgggcaacagagtgagactccacatcaaaataataataataataatagtcctcagaatagataataatgtcattagcatttgaaagaaagtgaagattaaagaaattaagggacacaacacacagagtcacacagccagcaggtggcagagtcagggctcaaactcagatcctctggatttcacggcccgcatttttgaaaaccatgcgattctcataagctcagtgtcatggacgtttgaaattctcaacatgctggatgaagtatcaaattaccaggatgagattgcattatttttcctttcaatcaagcaaaatgacagttataaaagtgtcttgcactggcccctgctgccttggctctttataatcacccaggatccctccaagtccttggcattcccagcaaagccgaggcactgagccaggacaagcagccagggctcgggggcggtggcgggggggtgagggggtgaaggggagggtgtgggggggtgttgctgcttaatacttccatgcagatggtgacttcagccagttactgaacttgaagcattatcaccctatgctaatgcaaacagacagggttctggggactgtggtggcagggatagtttgtcctctaggattgtggaattgtattacacacttttagaaatgaaatgtattcgtttttgaattctaaaacaatatgggctcaatatagatggttggaaaattcataaaattaaaaaaaaatctttcccaaatttcaactctagaaacaaccattgttaatattctcttgtatttactgctagtcattttatttttcataccttaaaaccattatttattgctgggcgtggtggctcacgcctgtaatcccagcactttgggaggctgaggtgggcggatcatgaggtcaggagatcaagaccatcctggctaacacggtgaaaccccgtctctactaaaaatgcaaaaaattagccgggcgtggtggcgggtgcccgtagacccagctactcgggaggctgaggcaggagaatggtgtgaacccgagaggcagagcttgcagtgagccaatatagcaccactgcactccagcctaggcgacagagcaagactctgtctcaaaaaaaaaacaaaccaccattatttatttatattttagagacagagactcactctgtagcccaggcaggagtgcagtggcacgatcatagctcactcactgcagtctcaacctcctgggctcaagcaatcctctcacctcaacctcccgagtagctgggactataggtgtatgccacaacagctggctaattttttttttttttttttggtagagacagggtcttgctgtattcctcaggctggtcttgaactcctggcctcaggcaatcctcctgcctcggcctcccaaagtgctgggattacaggtgtgagccactgcacctagcctgatttcttttctgattataaaagtaatacaggccgggcttggtggctcatgcctgtaatcccagcactttgggaggccaaggtgggcagatcacttgaggtcaagagtttgagacgagcctggccaacatggtgaaacctcatctctactaaaaatgcaaacattagctgggtgtggtggtgggcacctacactcccacctacttaggaggctgaagtgggaggattgcttgaacctggcaggtggaggttacaataagccgagatcaagatcgtgccactgtactctagggtgggcaacagagtgagactatctcaaataaataaaagtaatacgtatactttgtagaaacattggagaatacaaacaaaacatttattatcatgacatacataggtagtcactatcaatattttggtgtatgacattttagtgttttttcaccctggatgtgtatacatgtttgtatatacgtaaacaggtaaaattggaatcacagtagccgggtgtggtagcccatgcctgtaatcccagctctttgggaggcagaggcaagagaatcacctgaggccaggaggtcaagacccacctgggcaacatggcaaaaactacatctccgctaaaaatacaaaaattagttgggcaaggtggtgcatacccgtagtcccagctactaaggaggcctgggcgggaggactgcttgagcccgggaggtgagcagtgagccgacatcccaccacagcacgctagcctgggtgacagagcgagactctgtctcaaaaaaaaaaaaaaaaaggaatcacagtatttttaaatttctaccattatcattctataaaatatgattgagattacagtgtgcacttgatcttagccaaaagatccagaatgacagctcacactttatattacaatttgtattctacttttcctgatattttgattaaattgtgctatgttttccctatgacatttccctattacatttctttgtaaacatcattttaaataagtgtacagtgttacattgcaggcataccataagtttagccatttcccttttgtaagatactgacccttttctaattttttctacagtttacataaattgtaaaaaaaatatattgtgtgaatgtatttttagtaattcagatattccttcgggtagatttccatgagttgaatttttagatccaatagatgtattttttcttttttaaattataaaatattttaatgtagagataattacatgacaaagatccctaaatgcaccaaccgtcttttaagggatacacacccttttatttatatattatgtctgtaagattcatccattttgttggtagtaatttgtttgtttttttttttttttttttgtgagacagggtttcactctgtggcccaggctggagtgcagtggcatgatcacggctcactgcagcctgaacctcccacgctcaagtgatcctcctgcctcagcctcctgagtagctaagactacaggcacacaccacccatgcctggctaatttttgtattttttgtagagaagggattttgccatgttgcccaggctggtctcgaactcctgggctcaagcgatttgcccacctcagcctcctcaagtgctaggattacaggtgtgagccattgtgcctggccagtagtttggtctttttcgttgctgtgcagattcagttgtatgaatatagcataatttttgtccattctattgttgatagacatttgagttgttttcatttcttgtcattatgagtaaagctcttaacattggtggacacaagtatgtatttctcttagggatatatccaggaatagaattgctgccagacagaaaaatatatatgtatttgtagctttagagggtattgccagtctttttttatttctttcttttttattttgagacagtctcactctgtcgcccacgctggaatgcagtggcgcaatctcagttcactgcaatctctgcctcccgggttcaagcgattctcctgcctcagtctcctgagtagctgggattacgggcatgtgccatcacgcctggctaatttttgaatttttttagcacagacgaggttttgccatgttgggctggtcttgaacccctgacctcaggtgatccgcccacctcagcctcctaaagtgctaggattacaggcgtgagtcaccacgcccagccattatctctcattttctaaagtggtagtaccattttatactccgaacagcaataaattgtagttacattcttactaactgctaactcatttatttactagcatctggactaacatttggtattgtcagtctttttaattttagtcattctggtaagggtgtagtgcccaccagccatctccaacagattttaacatatatgcttcagatctcttttaagaaatataaatttaaatattcattagtgaatctagtaagggatgtgtgtgcgtgtgtatatatatatatattgtatatatacacacacatatacaagaaaataacatacatattatataaaataacgtatatatacacatactgtatatatacacacacaaactatatatatatatgtgtgtgtgtgtgtattttggagacagggtctcactctgtcatctaggttggagtagagtggtgtggtcttgcctcactgtagcctcgacctcccaggcccaagcagtcctcctacctcagcctcctgagtatctggaattataggtgtgtgccaccacacctggttaatgttttaatttttgtagagatggaaaactgctttgctgcccaggctggtctcgaactcctgagctcaaggattcctcccaccttagcctcccaaagtgctgggattataggcatgagccaccgcacctggccaaggtctgtatttttcttattgtactaaacttgcaacttttctgtagatttaaaaattttcaaaatactgtaaatagtttaaaaatatataaattttagatatagctgaaactaactacttaccctttcccagcctcctaaagtaattactatcctgaatgtaatgtttattgttttttttttttttttttgagacagcgtctcactgtcactgaggctggagtgcagtgtcatgatctcagttcactgcaacctccgtcccacgggttcaagtgattctcctgcctcaacctcctgagtagctggaattacaggtgtgcgccaccaggcccggctaatttttttttttttttttttttttgtatttttagtagagacggggtttcagcatgttggccaggctggtctcgaactcctgacctcagactaaccgcccgcctcagcctcccaaagtgctgggattacaggcgtgagccactgtgcctggcctggtacaactaattttaaaagcaggttgacactctagtccaactggcagatgtgcataccccatgccattgtaatttttccccctagaaaaactcctattcagtcgtacagggaaatgagtataaaaacatttgctgctgccatgtttgtaattgtggacaattgggaataatctttatacctcatcaatgaaaaaatagaccaattatggttcattcatgtagaatactatacagtagactatgaaccagagttacatgaatcagaattcgtatttctcaaaagcataatgtgggccgggcacggtggctcacgcctgtaatcctagcactttggcaggctgaggcaggtggatcacttgagcccaggaattcaagaccagcctgagcaacacagtgaaaacctgtctctatctttttaaaaggaagaaaagcatattgtggaacaacaacagaaaaaagcaacttgcagaattataaagtatgatatcatttgtataaattataagaaaatgttaaatagcgctattatatataatttgtagagttatacatatatacctgagaacaataaacattacattcatgcagccaggcacagtggctcattcctgtagtctcagcactttgggagaccaaggcgggcagatcacttgagctcaggagttcgagaccagcctggccaacatggtgaaaccacatctccattaaaaatacaaaaaattagctgggcatggtggcacgcctgtagtcgcagctactcaggagcttgaacccaggaggtggaggtttcagtgagccgagactatgccactgcactccagcctgggtgacagagagaaaaaaacagttgtaccaatttatactcccactagcattagataaaagttcaaattatgccaggcatggtgtctcacatctgtaaccccagcatttttggactctgtctcaaaaaaaaaatccacatcttttacaacacatgattgttagattttttagtttttgcctatcggatgatatattcttatttacattttcattttccttattactaagggggttgagcagcttctcacattaggccttcctcctctgcccacatgacatgactattcatattctttccctgtttcctactgggatatcattttctttttttcgtttcttttctttttttgagacggagttttcctcttgttgcccaggctggagtgcaatggcatgatctcggatgactgaaacctctgcctcccaggttcaagcgattctcctgcctcagcctcccgagtagctggaattacaggcctgcgccatcacagctggctaatttttgtattttcagtaaagatggggtttcaccatgttggccaggctagtctcaaactcctggcctcaagtgatccacccacctcggcctcccaaagtgctgggattacaggcatgagccatcgtgcccaggcactgccatggtgttttttgtttgtttgtttgtttgtttttaaagataaacctctggggtttctggaaagtaaagccccatgctccaaacagctctgctatacctgtgtgcaaaatattttcatctctctctctctctccccaaagtgcatgcaaacacatatggaactgacataggcatccactgtcgcacttcaaattaaacagacgcacacgacagatattctcacagaaaagcagtcagccaagcccagaacccatagatctaggtccacactcacgcctctgcatgctccccagaaagacggatgcatcgcccgcaggtagagacgggctcaccaatcccactcaaaacccgctgccggcttacagctcgcaagccgcccacagtgccagccccatgccaagcatcactaggggctctagaataggcaggggccttgttctcacttcctttgtgttgcttttattttagttgttttgtttgttgtttttcttagagttatcacctgcccctctgtctccctacccagcccccaagcctcccctccaagcctccactgcgcatgtgccgtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcccagcttttcctccctcgccttccttgggtcggggtgggaggcttggggcggcaaaagggtcaaaaggcacacaccgttctcttttctctcttgactcagttaaagtctgcttgggcacaactctagaaggcagtttcgaaatagaccggctgtatttatttactggttctctctgcggtgtttggatgtcaacatttctaagtaaacgaaggattttgtttttcattaataggatacaatagttgaaactcctgccctcaaagtgtagaggcagcgtcaggggctccagggtcactggaggtccctgcaaacccgggggctccccaaagccgctgctctcacatggcttgcccaccaggctgggaaggagaggtccttctcagggacccggcagcttcctgcctcggctctgggtcactgctccgcgctctgccccagcacggatctctgagcgatgtagggctaaagtattgtgaatgtgatcttattctgtcctcacctggtggaaaattgtgtgtgcgcgctttctttctctatacctgtaattatggatttagaaaatcttcctagaagggctcaactgtgttctgattctgacgggttgaagttgaaatcacaatccaatgtcttagtggttcatgggctaggatggatgtcatagcactgccaacctctttccttttctttttttttctccctttttaaccttggtctttctttctagttcatcctttcaagacccaatgacttggtgctttggcataatatcagggcgtcagggctgagggtctctgtttctttctttaatttttaagtgcacatagtgggtgtccatatttatggaatacatgagatattttgatacaggcatacaatgtgtaataatcacatcagggtaaacggggtatccaaaacctcaagcatttatccttttttttgtgttacaaacaatccaattacactccttttttaaaaaagcccagctgtgtgactaattatactcttttagtttagcttttttttttttttttttgagacggagtttcgctcttgttgcccagactggagtgcaatgacacaatctcggctcactgcgacctccacttcctgggttcaagcgattctcctgcctcagcctccagagtagctgagattacaggtgctcgccaccatgcctggctaacttttgtatttttagtagagatggggtttcaccatgttgggcaggctggtcccgaactcctgacctcaggtgatcggcctgccctggcctcccaaagtgccgggattacaggtgtgaggcaccccacctgccctcttttagttatttttaaatgtacaataaattgttgactgtagtcatcgtgttgtgctatcagatactagatcttattcattctatctacctatatttttgtacccattaaccatctctgtgtccccccatcccaataccctccccagcctctggtaaccatcattctactctgtatctccatgagggtctcttgtttcttacaagctcaaaataatctcaacaatggctgccttttattgctagatgaccatgtgctgagaactctaaatgcatcatttcatttagtcccctcaacaacctcctgcagtactaagatttataaatttaaatcttgcctagatttaaaaaaacattttaaaataaaaattttaaaacaaaacattttaaaataaaaaatttaaatataaatttaaaatcttgcatagatttaaaaaaacaaaacaaaactgggacttgttaggtgatctgacagttaagtggcagaaccaggatttgaaccccggtctgttggaccccagagcctgcttttaacatgaaggtttattgctttcatggtttcagaaaacttcctaagtctattgagatagtcacagaacatgctcagtgattttataattatgtggcagccctgttgctctctgaagctcacagaggccttaaaaaaatgctgggtccacgcagaatggaagctgttcacaagagtgctgctttgaatcctcactctgtgccttgctggctatgtgactttaggagtattgctaagcctcactctgccttcattttctgaaaatagagattatgtctttattgtgtatactaaataagatgatacatatagtactcaaggttaagtgctcaatacgtattgttcacttccattcggttactgcacaacatttatagacagaacctgcttttactctttgcaaggaattatgtaaatattggtcaattcttcaataatgcccttgtagctttttatatcttaacattttatgagaaaaaatttgaaacatgcaggaaaattgcagcaagcacccaatttacagcagtttcaatcctgaaatttttgtacttctgggtcctatgctgcacactgttaaaagtcaggtataaggccaggcgcattggctcacgcctgcaatcccagcactttgggaggccgaggcgggcggatcacaaggtcaggagatcaagaccatcctggctaacacggtgaaaccccatctatactagaaatacaaaaaattagctgggtgtggcagtgggcgcctattgtcccagctgccggggaggctgacacaggagaatggcgtgaacctgggaggcggagcttgcagtgagccgagattgcaccactgcactccagcctgggtgacagagtgagactccctctcaaaaaaaaagagtctggtataaagtccttcttaccctctgtttcaaaccatcaaagactcagtcttgcttcctagtcaaaggcaagaggaacagctcctgatctgtacttgcgtggatcctcaaatctggtttttcttttcttttttgagatggagtctcactctgtcccccaggctggagtgcagtggcatgatctcagctcactgcaacctccgcctcccaggttcaagccattctcctgcctcagcctcccaagtagctgggactacaggcgcctgccaccacgctcaactaatttttgtagttttagtagagaggggttttcactatgttggccaggctggtcttgaactcctgaccttaggtgatccacccacctcagccttccaaagtgctgggattacaggcatgagccaccacacctggcgaaagctgaaattcttaaaacgtggatccagagtctaacttttgaaacttgaatctggcaagttttattttctagactatttttttttttttttgagacagggtcttgctctgtcgcccaggctggagtgcagtggcacaatcagctcactgcaacatctgcctcccaggttcaagcaattctcccgcctcagcctcccgagtagctgggattacaggcatgcaccaccacgtccggctaatttttgtatttttactagagatggggtttcaccatgttggccaggctggtctcgaactcctggcctcaagtgatctgccctccttggcctcccaaagggccgtgattacagatgtgagctaccatgcctgggcctgttttctagatgcgtgtttgcacgcagggggtgtttgattaaaccttttttggaacactctttcaactctcagggtatctatggatccattccataaagcctgggccctccatttatttattaagtgtgaaaattagtacttttgtttctatggcatgacaattgccaagccaatgttgtaacacatgaaatgctggagaaaagaagagtccccttaaaaagaagacatgctctgtttaacttccacacattttaaaatattttatgttaaacactgagtaggtgtaaattaaacagaattgaagaggggagggagactgcagaactggtcttttttagttaagattgtgttgactgctattttaaatttcaactatagtttttagataaaagatatgtaatgtgctatatcagagtagcaaagaaggaacgttttgaagttaggctgaatgagttcaaaccagcctcattcagctgtcacttggtagatttgtgaccctgggaaaattgctcaaggtctctgtgtgtcagttgcctcatctgtgaaatggggataattgtagtaatgcgcacttcggactcttggaagattagatgagataatgtatataatgcatttagcacagggcctcacatgctgaaagcgctcaatcaaggttgaatggttgtcataggaggacagaaggggattgccccagcaatatttgcagaggttatcccaaactcaccagttacagcttttcattgcttccatttcttagtaaattctggttaatgattctgtacatactgccttcctcatgggaacatgtggagaaaggcttctgcacccttacaaaccatctagtattttctcctttgagaaaggttcaaagtaattgctcccagccaccttcaacagcgtttttccactagcagggaggttttttccccgctcagctggaaaatgtatagtgacatttcagcgtggttagatatataaaaatactgctttcaaccaagtgtaattaattgagggagacatgcagacaaggtgccttttgaaaaagcgcagagcttttcagaaacacagttgtctctgttgtggccatttcttgatagatttgtatgtgtcttaaaggatgatcaagattttggacaggggaaatggaggagttggaggcgggagaggggaatgccaggagaggtaatagcatcaactggctgggtgtggtggctcatgcctgtaatcccagcactttgggaggctgaggtgggcggatcgcttgaggtcagcagttcgaggccagctgtcccaacatggtgaaaccctgtctgtactaaaaatacaaaaattagccaggcgtggtgatgggcgcctatagtcccagctactagggaggctgaggtgagagaattgcttgtactcaggaggcagaggttgcagtgagccgagattggacggctgcattccagcctgggtgacagagcaagacttaatctcaaaaaaaaaaaaaaaaaaaaaaaaaatcaacacagacatagtgctggaaataaatgctctatgagtaggagattggaatgaagtagagagctcaaactgcaatctttccataagcccgggggagatgactactatttaaaagttcaaagttgtgtactgactaacaagcagatcgtaaaactggccagcgtttcaggtttcataaacagtgtggaggctgaaataatgcaaattgctggcaatctatataatagattcttggggaaaggtttgaactatcttctgtttggttacatatgctcattttattattttattttggttttgcatcatttctttttttctgattctagaagtaatacatgtactttataaaaaatttgaattcatctgaaatatgaaaataaaaagtaaaaaacgaccatcatttgctccccagatcccatttattcactccataaataggtactgagtgccttacaagtgccaggaagtgttctaggggctgcaggtacagtcttgagatttctcgacaaagtccctgcccacataaagcttctgtttaggggaagttaagacctgggttgagagtgaaggcgtcaaatattacataagcaaacaagtaagatggtttaggtcatagtaaatgtttcatgggcattaatagggaaggggtacttttcatttggtgttcaggaagcgcttctctaaggaggtgacattttgctgtatcaatagcaggaatccaggcagtaaacgtaaaggccttgtgctagaggaagagacagaaggccagggtggctggaacccagtgagtcagggtgaagggcagatgaatcagagggaagccagactaggtagggccttttaggttgtgattaaaacaaacaaacaaaaagtctgaaatttattctcattgcaggagaaactgctaaaaaattttaatcaagggactaacatgaactgttatgttttttgaggttttttgtttttgagacagggtctcgcttgtcacccaggatagagtgctgtggtgagatctcggatcactgcagcttcaacctcctgggctcaatggattctcccgcctcagcctcctgagtagctggaactacaagttcgcatgcctctagagcccattaaaaaaaaaaaaaattaagacagagtctcgttctcttgcccaggctggagtgcagtggtgtgatcttggcttgctgcaacctctgcctcctgggtccgagcgattcttctgcctcccaagtagctgggattacaggtgcccaccaccatgcctggttaatttttgtatttttagtagagatggggtttttccatgttggtcaggctggtctcgaactcttgacctcaagtgatccacctgcctcagcctcccaaaatgctgggattacagccgtgagccacgatgcccagcagccctgttagtttgtgaatttttggtagagatggggttttgctgtgtttccaggctagtcttgaactcctgggctcaaaagcaatctgcctgtctcagcctcccaaagggctgggactacaggcaagagccactgcgcccagcctggtttttgtttttaaagggtcatgttgggtactagatggggaataagtccatagcggggcaagtgatgatcaatgcaagcagcatttgatatagtccgtgattccttcctaatcaattttattttggagaagtggtggcagtttccttgagtgtgaaaggtgtgacaagggccccatgggttgtcctctggaagatcaagcacctggttaagacttaggagagggaggccgggcacagtggctgaagcctgtaatcccagcactttgggagaccgaggcaggtggatcacctgaggtgaggagtttgagaccagcctgggcaacatggtgaaaccccacatctaccaaaaatacaaaaattagctgggcgtggtggcgcatgcctgtaatcctagctactcgggaggctgaggcgggagactcacttgaaccagggggcagagcttgcagtgagctgaggtcacaccattgcactccagcctgggcgacagagtgagacactgtctcaagaaaaaaaaaaaaaagaattaggagagggatagattctgcactgtctcttgacaggcaactatgtaagttattgcaaaactattatagcagtgatataaatattacaaatatgatagtatctagaatgtactttgaacaagcccaattatttacacagttgagtaatgtctgctcataactttgctcataacattatgttttatttttgcaagagtttcctcctgtgttaattgaagaaaaaattaatcatgcctattcttggactgattagttattaaacacatattaataataatatccattcaatgagttttagctatgaacttgagcttattaaattctcataacagccctatgacataaggagaattattattcccatttaaacatggggaaaccgaggtttcagggggttaagaaacttgctgaaaggcataaagctagaaggtggtagggctggagcctgattctaagccctctctgcctctggatgttcctatccactgtctgttattcttggttcagtgctgggtgctgtagagattagagatggaataagacagaatcccagccttcactcttaaaaggtttacagatttggagtgagagacacagccataaagaacaccacagggccgggcgtggttgctcacacttgtaatcccagcactttgggaggccgaggctggtggatcacttaacatcaggagttcaagaccagcctgagcaacatggtgaaaccccatctctaccaaaaatacaaaaattagccaggcatagtggcatgcatctgtaatcccagctactctggaggctgaggcaggaggatcacttgaaccggggaggcagaggttacagtgagctgagattgcaccactggactccagcctgagcgacagagcaagacctgagaccctgtctcaaaaaaaaacaccacaggctgggtgcggtggctctcatgtgtaatcccagcactttggtaggcccaggcagggaggattacttgagccccagagtttgagaccagcctgggcaatgtggcgaaaccctgtctctaccaaaaatacaaaaaattagctggacgtggtgctagctacttgggaggctgaggtgagagaatcgcttgagcctggggggcccggaagctgtggtgagccaagatggcaccactgtactccagcctgggcgacagtgaggccctatctcaaaaaacaaacaaacaaacaaaaacaaaaacaaaaaatccaccgcaacttataaagcagtataatgaaacacatgctaaatgaaaagtacaagtgtgggccaggcatggtggctcgagcctgtaatcccagcactttgggaggccaaggtgggaggatcacctgaggtcaggagttcgagaccagcctggccaacatggtgaaaccctgtctttactaaaaatacaaaaaattagccagatgtggtggtgcacacctgtgattccagctactcgggagcctgagacacgagaatcgcttgcaccctggaggtagaggttgcagagattgcaccactgcactctagcctgaacaacagagcgagactctgtctccaaaaacaaaaaaaaaagtgtgaaattaggaaagaaattggctgtgactggggagctgcaggccaacagcaaagaggggtgtttgcattgggcctgaaggctaaacagggtttcaaaagaggaagagtgtagagaaggggatttcaggtaagctgtctgccccaggcacagaggtgaatattccaaaggccagggtccaggcaccagctttgtttttttttttttttttttttttttttggctgtttctttccccttggcttaatggatcctgggactgcctggttcacttatatgaatgggcttgggggttggttggaagccagcacaggtaaaggccctcttttagtacttcactcacaagttcccccaaaagatagaatcaattcatttcttcactattcacttgttgtgggcgtctcctgtgcacttgttttagaggaacagagctagatgggtcctgaccccacccttaagaattccgtcctactgtggtccatttcttcctctgctgcttcctagcactgtgatcttggacaattggcctaacttccctaagcctcagtttcctcatctgtaaaatgggtatagtgatttctttaatcccctgagaaataaacagaataatgccaggaaagcatggtgacaaatacatgtcactaaatgttattgatggtagcagtgtgaaggctcagctctgttttgcagacgatatttattgagaaatgcctgccaggctgggtgggaggagctggcctcatagtatgagtacatggtggtcctgcatggaagagcagatggtttctagtttattggttataagtgtgggctttcgagagagcttttattttgaggcctggctctgccatgtcctggctctggactttgaatgagttatttcacctttttttcccccacctcaatcttttgctatctgtatctgttctcaataataaccatgaggaattatataaatctgaagaagtttctcaaagtcagtttttgagacagggtcttgctccattgcccatatgggagtgctgtggcacaatcacagctcttgcaagcctcaacctcctgcctaggcctcccgcctaggcctccgaagtagctggaactacaggtgcacaccaccacgtgtggctaatttttacaatttttttgtagaggtggggtcttggtatgttgcccaggctggtcttgaactcctggcctcaagcaatcctcctgtcttggcctcccgaagtgctgagattataggcatgagccaccacgcctggttatttcacctcttaagctttggtttctgcaactgtacaacagtgacagtaatagtatctacttaggatagctgagaattccttgagacacagattggaaatcattcaatacagaggtcagtacatgatacatgtttagtaaatgttaattattatattattggctttacagctatggcaacaggtacataaaaaggtaaacttgatttaataagggtgtgtgagtaagtagggggctggcagcagggtagctaatggagcaaagaggaggggcttagccaaccctggggcttctgaaaacttctggaagagctgagccttaataagaaagaatagaaggaaatacatatgtggaatcaccattaattgttaggaaaaaccaaattggaaccttactgagatatgtagccactggaaaggctaaaattaaaaggactgatcatactaagtgctggagaggatgtagatcaactggcaccctcatgccttgctggtaggaatgtcacatggggggaaatggcttggtcatttcttaaaaatttaaacatacaccaatcataggacccagacggtgcacttctgggtatttacccaacagaaatgagagcaagtgtctctacaaatatttgtacacaaatgttcatagcagcttttttaggaatagccccaaactggaaacaacccaaatatggtataatcatacaacagaatgcttctcagcagtaaaaaggaacagactaaagacacactatgtaaatggatcacaaaatcatcatgctgagtgaaagaagcaagcaagaaagaaaagagtacatactgtatgagtccgctgacatgaaattattttaaaaacttaaactattgtatacagacagaaagtaagcgagactctaactctacaaaaataaaaataaaaaagttagctgggcatagtggcccacgcttgtgatcccagctacttgggaggctgaggcagaatggcttgagcccaggagttcaagaccagcctgggcaacatagcaagtcctcatctctacaaaaaaataaaaaaataaactggctgagtgtgatgatgtgcacctgtagtcctagctacccgggggctgaggtgggagaatctcttgagcccaggagtttgaggctgcagtgagctatgactgcaccactgcactccagcatgggcaacaaagtgagaccttgtctctaaaaaaataaagaaaatgattataagaaataacatgcatgaagttcttcctatgagccactgtgtgcatgttttacatgcatcctccgctccttacaaaacgttctgtgagatgagacacaatatagccatctattgcatttattgttctatttacagaggagcaaactgaggcttacagaggttaagcaattggcccaatgtcactccactgataagtggtagggctgagatttgaacctagcacaggttgacttaattctgctaccttcctaatttcccaggattagttgaagctgccattgatatagatgcttaatgtcaactagacacatctctgtgtttcttagaactgattctgttctctggctcattaatttccttttccattacaaacatgcctcttgtaagcttgaggactacatctcaccacttcaaagtgccttcagtgtcaaactggagtggaagttgaagacgttcacaaaaatggaggagggagagcctttctgttttgaagacttgtagcttcacaaagaaaggctttctttgaatgatcaagaaggatttctaggtcaatataggggcatattactgtaacgtttggcagcaggagctctgcctgcatttgaatcctggctttaccacttcataatagttgcgtgatcttgggctagttacttaacctctctgaatttcagttttctcatctgtaaaatggggataataacaggatctgccccaaaggatgtattggtccgttttcacactgctataaagatactacctgagactgagactgggtgatttgaaaagaaaagagatttgattgactcacagttccacctggccgaagagtcctcaggaaacttaaaatcatggcggaaggcacaggagaagcaagcaccttcttcacaaggtggcaggagagagtgacagagggaagcaccagatacttatcaaacaaccagatctcgtgagaactcactcagtatcatgagaacagtatgggggaaaccgcccccatgatccaattacctcccaccaggtccctccctccacacatggggattacaattcagattacaattcaagatgagatttgggtggggacacagccaaaccgtatcaaaggctaattaagaagattcaatgaaataatacatgaaagcccttcacagagtctggtgctctcagtaaatggtggcgatcatgttaatagaagaggatgtgaagtgggaattgacctgatagtatctgaatagttggagagaaggaagagagagaagttaaatttaagtgggtgaacctcaaggaagaatggaggtgacgatgagcgtggagatttctggaggcgtgcatgagcttcgctgcattggaggagttgtgagataaaaaggatggttaagcaggaccactagactttggtggattaaaaaaggactggcaatatggggccattggaggacaagggatggagggaaagaagtagcatttatttatttatttatttttgagacagagtcttgctgttgtctcccaggctagagtgcagtggcgtgatcacggctcacttcaacctccacctcctgggttcaagcgattgtcctgcctcagcctcctgagtagccggaattacaggtacccgccaccatgcccagctaatttttgtacttttagtagagatggggtttcaccctgttggccaggctggtctcaaactcctgacctcaggtgatctgcctgccttggcctgccaacgcgctgggattacagacatgagccactgcgcctggccggaagtagcattttaggaaggcttgtctggcaatggtgaccaactggatgcaaagtcaggggccctggggataagaaggtcagctaggagggtttggaattatcccatgatgagggctgtatgtccaaatatccatggcagggctggagtctgcaggagcagtgggtttgaaagaaggggctgatcagaaatcttgaagggagaaacccatagtagttattatgtctcagaaggaaagaaggtcttctaagtgctctcaatgtgataggcaaggaaaaaccctgtcattagcctgaggtcttaaccagttaaaaatatcagcatccaggcgcagtggcttacgcctgtatttgcagcactttgggaggcccacgcgggtgggtcacttgagttcaggggttcaagaccagcctgggaaacgtggcgaaatcccatctaccaaaaatataaaaattagctgggcatggtggtgcaagcctgtaattccagctactcaggaggctgaggcatgagaatcgcttgaacctgggaggcagaggttgcagtgagctgacatcgcactactgcattcaagcctaggcgacagagcaagaatctgtctcaaaaaaaactgaaaaaacaaagagttgttcctgatgctgccgtgagattagcatcctcgccttctgctttgagggaaagatgtgagattttcagatcagatacaaagtaacaggaataggtaccatgaatgggaaccggcagccaagtgacagtgttgtgatgggtataggctgggctaggtactttacacaccttaaatttttgattcttagatgccagcataggtgaggtataacatttcagagtaagtcacgtctttctgaaacaacagaaacaaaaaaacgataaggccccgttaaataactggtccgtttagcactacctgcaatagcaaagatgtggaatcaacctaggtgcctattgacagtggattggataaagaaaatatggtacatatataccgtggaataccaccagctagcaaaaaaagtaaaactatggtctttgcagcaacatggatgcagctggaggccattatcctaagtgaactaatgcgtgttctcacttataagtagaagctaaacattgggtacaaatggacacaaaggtgggaacagcagacactggggactacaagagggaggaaggagggagggaagagttgaaacactacctgttaggtactttgctcattatctggctgatggtttcacccagaccccagatctcagcatcatgaaatacacccttgtaacaaacctgcacatgtacctccttagtctaaaataaaagttgaattttttttctttttctttaattttttttttttaagagagggagtctcgctctgtcgcccatgctggagtgcaatggtgtgatctcagctcaatgcaacctctgcctcccaggttcaagcgattctcctgcctcagcctgctgagtagctgggactacaggtgcacaccaacacacctggctaatttttgtatttttactagagacaagctttcaccatattggtcagactggtctcgaactcctgacttcaggtgatccacccatctcggcctcccaaagtgctgggattacaggcatgaaccactgcacccagcctactttatttttaatctccatctagtatttagactagagatgggcaaatttttcttttttgttttctttaaaatttttttttttttggtagagatggggtctcactatgttgcccaggctggtcttgaactcctggcctcaagtgatcttcctgccttgacctcccaaagtgctgggattacaggtgtgtgtcatcacacccagccctgatacactttttctgtacaaggatagatactattttagggtgtgcaggtcatatggcccctgttgcgaccactcagctctaccaccgtactccaaagctgtagcctaaagctgccatagacaggcacctaagtgaatggatgtggctatgttttgtttcagcttgattggtgagcactgaaatttgaattttatataactttcccatgtcataaaatattattattcttttgatgttttcccacagccatttgaaaatgtagaggtcatctcaaaaaagaaaaaaaaggaaaagaaaatgtagaagtcatccttagctcaagggccatagagaaactggcattggtctgggtttggtctgaaggctcatggatccctaccctagacaaataataggcatgtaaaaggtattcacatcacagctggctttttttttgaaacagagtcttgctctattgttcaggctggagttcagtggcatgatcttggctcactgcagcctccacctcctgggctcaagcaatcctcctgcctcagcctcccgagtagccgggattacaggcacaagccaccatgcctggctaattgttgtatttttagtagagatggggttttaccatgttgttgaggctgatctcgaactcctgggttcacaggattcatctgcctcagcctcccaaagtgctgggattacaggcatgacccaccacgcccggccatagctggctttttgcttgctgtgggaggagaaagttctggctgcttggcttcgatgctatgcttggctcttccaaccaccatttgtggctttttgctgccagagcttgtcatgctgctgcattgcccaagagaaaaagtttgtgaggttccacgttccatcatatcgatgatcattttagggttttcacacacaagagacaggattattgcaagcaacagcaatgaactttggaaaactcagaggttttccaagtgtgagatttaaagcctcatgcatgaaactttaaattagtttaagggggcgtaaccagcataaaaaaaatgaaatagaaggaaataggaaatagaaagctgcatctatgctgctaaagttaagtcttatttccgtgcaacctttcgtttgtttgttttgtttgttcgttttctgagacagagtctccctctctggagcgagtctcacccaggctggagtacagtggtgtgatctctgctactgcagtccctaccttccgtgttcaaacgattctcctgcctcagcctcttgagtagctgggaccacaggtgcatgccactatgcccagctaatttttagtagagatggggtttcactgtattgaccaagctggtctcaaactcctcacctcaagtgatccacccatctcagcctcccaaagtgctgagattacaggcatgagccaccatgcccggcctattttgtccaacgtttgttttacttatgcctatgtgtgtatgtacatactgggtcactcttagtatttcttttttttttttttttttttttttgagacaggagctcactctgttaccgaggccagagtgcagtggtgcaatcatggctcactgaagccttgaattcctgggcttaagcgattctcccacctcagtctcctgagaagctgggactacaggtgggtgtcaccacacccagctagctaactaatttttttttttttttttttttttgtagagacagggtcttactttagtgcccagactggtcttggactcctgggctcaagtgagcctcctgcctcagcctcccaaagtgctgggattagaggcatgagccactgcatctggctctctgagtatttcttactgtgatccacagtaagtaaacttatttaaataagtttgcaaagtacaggaacttaaggaaaaggaatgtatctggaaatccttccagaatttaaaacaaaaaatagctctaggcacagtggcttacgcctgaaatcctagcactttgggaggctgaggcgggaggattgctagaggcaagagtttgagaccagcctgggcaacacagggagatcccatctctacaaaacagttctaaaaattatccagtcatggggcgtgcacctgtagtcctagctacttgagaggctgaggcaggaggattgcttgaacccaggagtttgaggttacagtgagccatgattgggccactgcgctccagcctgggagacagagtgagaccctgtctcttaaaaaaaaaaaaagaaaagaaggaaggaagggagagagagggagggagggagagagagagagagagagagagaaagaaagaaaaagaaaaagctaaacagccagaccttagagagaagaggaaccttggtgactaggaatttccagatggcagaaaattccgggtactgtcatctggctgaatcagtcccactcttttgcatctctgagccactgtgcccaagattcaagtacctgggggagaacacagagaagatctctgcgttaaccagagtccatttctgttgcttgcaaatcatcccatctcctgtgtgtgcaaactcctaaaataagcacttttagaagaaacgctgactcgtacaaactttccctgtgtcctaaggcctcctgccagctttgcaactgctgctcgcgggcaagggaacctctccagtctcaggacaatggtggttgggagaagctaagctaaggtcaaagccaaacacagcgagaacttagcctaagtgtatcggaccagctaggatcaagacccaacccttgactaggaaggagggcatcttgaatgccagttccctaagacagcatttcacgggtgaggtgtattctcccatggcaagacattggaggtgctatcatgagagaaagaacaatggatgcttgcagaacagaacccgcagatgaccactaaggaatgacactggttttccttctctaataaaaataacaacaacaacaacaaaaatagctgggcgtggtggcaggtgcctgtaatcccagctactcgggaggctggggcaggagaatcacttgaatccgggagacggaggttgcagtgagctgagatcgcaccactgcacaactacctgggcaacagcacgagactctgtctcaaaaacaacaacaacaaagaaaaaaccaaaacaccgttgcttttattctgataataaaacagggttaatgctcgaaattttaaaactaaaaaaataccaaaagttataaaagagggcaaatgtcatttaaaggaatgctgcagcgaggtagagtctcacacctgtaatctgaggcagaaggcaggagcttgagcccaggagttcaaggccagcttggccaacacagcaagaccctgtctctacaaaaataaaaataattacctgggtgtggtggtgtacctctaattctattattagctacttgggaggccaaggcaggaggatcacttgactccaggagtatgaggctgcagtgagccaagactgtgccactgcactccagcctgggcaatagagtgagaccctgttctaaaactaaccggctgggcgaggtggctcacctgtaatcccagcattttgggaggccgaggcgggcagatcacttgaggtcaggagttcgagaccagcctggccaacgtggtgaaaccctgtctctactaaaaatacaaaaaaattagctaggtgtggtggcacgtgcctgtacacccagctacacgagaggctgaggctgaagaatcacttgaacctgggaggtggaggttgcaatgagtcgagatttcgccactgcactccagcttgggtgacagagctaactctgtctcaaaaataaaataaaataaagcaaaccaacagaatgccaccaacctccaataaccactgagagcatcccttcagatgtcccttcctcccttcccctttccttcctctcctcctcttcttcctgttctgagtcatgtttctcaaggagagacaagttgtactttgggatctggtctcttttctcacacatctctgctctctaggggggcacctccctccctatggatatcacagggagtttttttccttttagagtttgaatggaggaagacttcagacagaactgtacacagcacagagctgcagagaagtggaagattaagagaaaataatgttggacaaattagatgtagcttgtataatctggagctacagtcacgagaataggatgtaacataaagtctaatgtgattcagcaaacacacgttttcattacttttgtgcagatggctctgctaggtgacttggaagggaaggaaaccgaggcagtgttgcttccttcgaggaagacagagttgcttcctttccccccatccactggggacagaatttcaaagagattacagcacagaccagcctgtggcaaatgcatgagccaagtgtgatggggacacagaggcgattaaaatgcaatcattagggctggtcatggtggctcacgcctgtaatcccagcactttgggaggccaaggcgggtggatcacttgaggtcagcagttcgagaccagcctggccaacatggtgaaaccccatctctactaaaaatacaaaaattagccggtgtgatggcacatgcttttagtcacagctactcaggaggctgaggcaggagaatcgcttgaacccagaaggcggaggttgcagtgagccaagattgtgccactgcactccagcctggatgacagagtgagactcagtctaaaaaaaaaaaaaagattgctgttctatttatgctgtgaacattgctgaaagattgagcaggaaaaatggagatcaatgctcagtaagttccacctgaaagacctcctttgaacatagcaactgttcacttggtgaaatttggctatacaggtaatgaatactttgtgagaaatcacactctgtggtctccgagtagcattaacaatctcttgcaacagagaaagctgaaatgaagaggagaagtgtagaaaatgtcatctgagggcgcgcgtggtggctcatgcctgtaatcccagcactttagaaggcagaggcaggtgacctgaggtcaggagttcagcctggctaacatggcaaaaccgtctctactaaagatacagacattagccgggcgtggtggcgtgcacctataatcccagctactcaggaggctgaggcaggagaatcacttgaacccgggagatggaggttgcagtgagccgagatggcgcaactgcactccagcctgggcaacaaatggagactctgtctcaaaaaaaaaaaaaagaaaagaaaagaaaatgtcatacccaacagtgtgttgggtatgacaactactagtgtgtccagccatcctggtttgcctgggactatcctatttttagctctgaaaagtctttttaaaattttatttatttatttatttttgagatggagtctcgctctgttgcccaggctggagtgcagtggcatgatcttggctcactgcaagctccgcctcacgggttcacgccattttcctgcctcagcctcccaagcagatgggattacaggcatgtgccgccacacctggataattttgtatttttttagtagagacagggtttctccatgttggtcaggctggtctcaaactcccaacctcaggtgatccaccagcctcagcctcccaaagtgctgggattacaggcatgagccaccgcgcctggccatgttaactatatattaagatacgaaacagctttctttcaaggggtgcagctttaaaacagtctacagtagcaaggcatttaacctgtactcggaagccaggaaaccttggcctgacttgccactgtgttctttgaaaggtccgtcgttaatgtttgactattcttaatgacaatttgtggcttatcaggttgacgttttcctttcttttcaggcagctgagacttaagggagtgaagtaatttggtggtattcattgcaggggccacatagatactgtcagtacgcttttaaaaatctttttaaagtaatagatgctcattataaaaattcaaacaatacaaaagtgtagaaagtagaaagtactttctacttcaggaagaaaatttcccaccctcaaattgtcattccgtcacaagtttgatgtgtatcttctcagtgttttgttggacatatgttaacacatggattttaaaaaatgaattggatgatatgtgtactaatcagtcttctttttttattcaaactatatatcatgaccatctttctaagtcagtaatacagcattatcttttccttgttttttttttttttgagagaaagtctagttctgtcacccaggctggagtgcagtggtataatcatagctcactgcaacctctgcctcccaggttcaagtgattctcatgcctcagtcacaggagtagctgggactacaggcacatgccaccacacccagctactttttgtattttttagtagagactgggttttgccatgttatccaggctggtttcgaactactggcctcaagtgatctgcctgcctcagcctcccaaaatgctgggaagacactgcatcagccaaaaaaagtatcttgtgtttaatttggcctatgtcttccttttctgatcactgcataatttttcagtgtctggttataccttattttttcttaattaattctttattgatggacagctaggtgatttaacaatttgataaagaatgctgcaataaatatcttttgtcatttttgcacattgtccaattatttcctctatataaattcactttttttttgatgcggaatctcactctttcgcccaggttggagtgcaatggcgcaatctcggctcactacaacctccacctcctgggttcaagcaattctcgtgtctcagcctcccgagtacctgggattacaggcacgcgccactatgcctggctaatttttgtatttttagtagagacagggtttcaccatgttggccaggctggtttcgaactcctgacctcaagttatccacccaccttggcctcccaaaatgctgggattgtaggcatgaggcactgtgcccagcctcctctatacaaataattaaaagtagaattgctgagttaaaagctttcaactaggtttagaatgtggaagatacacaaatctgaattcactttatggggtgcatatttgagactaaattaaaactaattaacttgaggaagaaagaaaatatcgtaattcaaatgatactgtggaaaaagtagcagagtaggagttagaatactttggttctagagcttgttcaccttccagctaactggttgacctttgacaagcttcttaacctttttgcacgtctgactcttgcctccagttgtatctggtctcatgaatcttccaaataattgacagagtcattttctacaatgcgaatatgacctctgcttaagtccatcaggagctcaccattgcctttggggtgaagctaaaactcctagctaaccatgcagcagtctgtgtttgtagcttcctctccctccacgtgcccagccaggacctttgatccacctgttctcacctcctttcattgccttcaatgctcacagtttgctaagcctccagatgttggttcaggttgttccctccttctggaatatctggtcccttctctgaccagctgacttctactcattcttcaagaaatagcttggactttgtattagtccattctcacgctgctataaagaaatacccaagattgggtaatttataaaggaaagaggtttaattgactcacagttccgcatggctggggaggcctcaggaaactaataatcatggtggaagagaaagcaaacatatccttcttcacagggcagtagaagagaaagaacgagcaagaacagggaaaactgccttaattaaccatcaggtctctcgagaattcactcactatcacgagaacagcatagggaaaaccacctccatgatccaatcacttcccactaggtctctccctcaacacctggggattacaattcaagatgagatttgggtggggacacaaagcctaaccatatcagacttcttaccttctcagaagactttcctgacacctacaggttgaactgatgcctcttctcttggcttttgtgaaggcagcatattactttacacatcctctgtaaatagcacacactgtattacaacggctgactttcttatctgggtcacttcattcttttgagggcagaaaccgtgacctgttcatctttgaatttatagtatctaccacagtgtctgacacatacagatgtttgctgaatctttgtggaataaaacaattgatctataaaataagtgattggattcagtaatacaaaattgcagccaagtatggtggctcacacttgtaaccccagcactttgggaggctgaggtgggtggattacctgaactcaggagtttgagacgagcctgggcaacatggtgaaaccccatctctataaacaatatgaaaaaattagctgagtatggtggtgcacacctgtagttccagctacttggggggctgatgcaggaggattgtttgagcccagaaggtcaagactgcagtgagctgtgttggcaccactgcactccagcctgggcaacaaagtgagaccgtgtgtccaaaaaaaaaaaaaaaaagtagaagtttatgagaattaaaagttcaaggaaacctcagaactactaaggaaacatctcaaaataatacagtaaaaaaaacacaaacaaagccaggtgcggtggctcacgcctgtaatcccagcactttgggaggctgaggcgcgtggatcacgaggtcaggagtttgagaccagcctggccagcatagtgaaaccccatccctactaaaaatacaaaaaaattatccgggcgtggtggcgggcgcccataatcccagctactcgggagggtgaggcaaggagaattgcttgaacctgggaggtggaggttgcagtgagccaagatcgcgccactgcactccagcccaggtaacagtgtgagactctgtctcaagaaacaaacaaacaaacaaaacacacacacaaacaaacaaaggaattaaaatggcacactggaaaataacatgaaagaaagctattaaaaaggaacagactaacaaaaaagacatgaaggatataaaaaacaaatagcaaaatgtcaggtgtaaatccaaccacatcaataattacataaatgcaaatggattaaatactccaatcaacaggcaaagatcgtcagactggattaaaaaaaaaaaaacaccaggatccaactatgtattgtctataagagacacacttcagattcaaagacacaaataggttgaaaagaaaaggatggaaaaatgtatagcctgcaagcataagagagcaggagtggctatattaatatcagacagaagaaaatttaagacaaaaaatgttactagagacaaagagggacattttatagtgataaaaacaacaatacaacaattatatatgtgtccaataacaagagtagaagggaattgtagaatgaattatagaacctttacagtgtgaatattgtaacttacagtgtgtaaattacagtgtgttttcagaaccataccttggaacctctccagattctttaccttgtggcctcctgtccactccattctaaggtgttatcatactgaagtgcaccatagtggtggtcttgatggggaaaagaaatcacagtagcactaacaggaaacatcctgagggaagaggcactgtcatttttaggtgtagggaagatgtttaagagcccgttttaaacatctgagcttctggtctttggaattttgtcagcccagagacagtttcttttcttctcaattctcttttcctttaattggtcttcttcttgccatacctcattccttagtcatcctggtcttgatctcagaaatctcacattctcattgatttagcatggttttctactctagtgccagttctactgttggatggaaagaaccatcttctgatgtgacaggaagccttaattattaatttaaaattcccctacccttctccaacttctatggaagttaactcaggaattattggagtaggttgaagattctctgagtgggaggatgggtgagattcaaattagagaagtactatgaggactaaatgaccctacctaagaaagacagtttccaaactaaagttatgggagttgggtacgtaggtagggactcgggaaccatcttggctagagaagggtcagaggaaaaatacagaggaaattcatgggagagagtatcagggtggatatatacggaacagatgcatacttcaaggggacatttagacattttgctctgggatgagcaaaatcaccctctttttcatctcccaacaaaccatttaataaaaagtaagacattactcattatcggagcaggatctgttgatttcgttttttaatttttttaattcatttgtgtttgatgtgatgatgtgccaagaccagcctgaaggtggccaagggcaaaagcagaggttgttatttgcaggctacgttgacactaggtagtgaacttcacagctcaacacatccacacatattggctgaacgttaattagttctgcctagttacagggtttccaaaatggatgagacattctgcctcccctcaaggaatttgtgggctggtaaaggagacagacacagtaacagatcattatgtaatatgctaagtgctttatcagaggaaaaaagctgggtgcaggctgggcgcagtggctcacacctgtagtcccagcactttgagaggccaaggcaagcacctgaggtcaggagtttgagaccagcctggccaatatggtgaagcccattttctactaaaaatacaaaaaattaaccaggagtggtggcacatgccggtagtcccagctactcgggaggctgaggcaggaggatcgcttgaacccaggaggcagaggttgcagtgagccaagattgcaccagtgcactccagcctgggtgatagagcaagactctgtctcaaaaaaaaaaaaaaagaagctaggcgcatcaggggctttgagccttctgacccagcctgggaacagggagaagcacaattcaaggggacatttagacattttgctgtgggaggagcaaaatcactcctggcaggagcgacccccgggctcagttcaccaggtgaaaggaacaggcaaagtcacataagtacaaagcagtgtggtgcttcctgggaccaaaaagcaattcgttatcaataaaacatactttgcgttggttcccatcttaccgaaccttctttcctttcttctttcttccctgcttccttctcacacgccctccactcacctctcagaactcattctatgtgatctctacccaaagcacagtgctaagagcccggaataaaacgggcaaaaccaacctagccattgtcctcatagaattaatcatacaaataaaaatataattttaacctgtggcaagtgctcagacagaaaaaatccagttaggctgccagtaaaaatactagatgtggccggatgtggtagctcatgcctgtaatcccagcagtttgggaggacaaggcaggtggattgcttgaacccaggagtttgagaccagcctgggcaacacagcaaaccccatctctacaaaaatacaaaaacaaaacacaaaaattagccaggtgtggttgtgtgcacctgtagtaccagctacttgggaggttgaggcaggaggatcacctgagcccaggaggttaaggctatagtgagctgtgattgggccactgcactccagcctgggtaacaggaagaccctgtttcaccaaaacaacaacaacaacaacaacagcagcagcaacaacaaacaaaaaactcccccaaacaggtgcccagttaactttgaatgtcagataaacaacatatatgattttgcagtataagcatgtcccatgcaatatttgggacatacttatcctacacaaaaattgttttttctgtgaaattcaaagttaactggatgtcctgccttttttttttttttttttttttttttttttttgaggtggagcgtcgcactgttgctcaggctggagtgcaatggcgccatcttggctcactgcagcctccacctcccaggtttactagattctccagcctcagccccctgagaagctgggattacaggtgcccaccaccacgcctggctaatttttttgtatttttagtagggacagggtttcactatgttggccaggctggtcttgaagtcctgaccttgtgatccgcccgccttggcctcccaaagtgctgggattacaggtgtgagccaccacacctggcctgcatttttatttgtaaacctggcagccttaagtccaagatcccatgagctcacatgactaggggacctgagttaacctgggctgcagtgggagaaggtgattggagaaagcctgacatctgcagaacagggagctgcacctgggagaggaggccggagaggggagtgacctggagaagggaacagcctgaatgcgaacagaaattggccccaacagagcgttcaagagtctgagagaaggctcctggggcttgagcacagacatttagtttactgggatatggagagaggagaagcaattggaaaatgagtaaatatatcatgcttttaaggaggcatgctgtacaagtaaatgtcaggtacagtgactcaggttattgatttgaaagattagtcagtggagacatgtgctggacttactcagtccctctgttgtcaaggaagtccaacgccaccagcactagatccttcaacaatgcagagtcctcccgcaaatgaatctgactttgcctgtaaaccgcggagagtttcaaaaactggaaagcattacaggtggccagtttgtttccatttatataaagtgcagcaaaaatgatctgtcagagagagaacattgggataaatttcttttttttttttttcttctggagacaaggtcttgctgttgcccaggcaggagtgcagtggtgcgaccatggctccctgcagctttgaactcttcatcttaagggatcctctcacctcagcctcctgagtagctggggccacaggtgtgcactagtatgtctggccaattaaatcaattaaatatatatatattttgtagaggcggggatctcactatgttactcaggttggtcttgaactcttggtcccaggcaatcctcctgctttggcctcccaaagccctgggattgcaggcataagctacatcacctggcctgaaatacgcttgaaggcatcctttgaaccactgttatcacagaagtgtggtcaggttcagtgtggagagtgaatgagaagctgggcaggagcctgtgcgagttgggctttgtggagacacacagaaagatgccccccactttaaccaccttcccttgcctcgtcgtttgactgctgaggtcttactcacactctgagactgtagctttcacgtggcctcctctaatatattttcagtgtagccttaacaatgaatcgtagtaacttctcaccttacatgctccccaaaagatgtcactttgggagaacatattcaaggaaccctccccaatcctgacccccatccccaccccagctcctgctgctgttgacacaactgccttagctgtgaggctgtgccatccattggaacctgggactttccaatgttgggatgcctcagcatcatcaagcaaaattggggttctttttgtgtatgctttaaaaaaaaaaaaaaaacttgaagcataaaactattactggaaagtggtcctgatccagactgcaagagagggctctcggatcttgtgcaagaagaaatttggggcaactccatagagtaaagtgaaagtagtttattagagaagtaaagaatcaaggccgcgcacagtggctcatgcctgtaatctcagcagtttgggaggccgaggcgggcagatcacctgaggtcaggagttcgagaccagcctggccaacatggcaaaaccccatctctactaaaaatacaaaaattagccaggtgtggtggtgggcgactgtaatctcagctactcaggagactgaggcaggagaatcacctgaacctaggaggctgaggttgcagtgagctgagattggtccactgcacttcagtctgggcgacagagtgagacttcatcttaaaaaaaaaaaaaaaaaaaaggattccaaagaatgtcaggtatggtggctcatacctcccagctctttgggaggccaaggcgggaggattggttgaggccaggagttcaagactacactggccaacatagagagaccctgtctctaattttttaaaaaagaagaaactaaaaaaatggcttctctgtaggcagagcagtctcgagtgctgctggttgacaattcttgtggttatgtcttgatcgtatggtaaacaagaggtggattattcatgagttttccggaaatggcacagggaattcctgaaactgagaattcctcttccttttagactatattgggtaacttccagaagttgccatggcacttgtaaactgtcatagtgctggtgggagtgtcttttagcatgctaatgcatcataattagtgtataatgagcagtgaggatgaccagtggtcacttctgacaccatcttggattgggcaggttttggccagcttctttattgcaccctgttttatcagtggggtctttgtgacctgtatcttgtgacctcctgtctcatcctgggactaagaatgcctgacttcctggggttgcagccaagtaggtctcagccttattttacccttattcaagatggagtcactctggttcaaatgcctctgacaaagccagcatagatgaagacctaacacccttgagcaaatgaaagatctgtgtgatggaacagttgcgtgtcttgattggggtggttggttacctgaatctgtacatgtgataaaattgcacagaaccacacacacacatacacacacacaccaatgaattggatgtaaaactggtgaaatctgaataaggtcagttatgcaaaatgtcatcactggggaacattgggtgaaggttttttaggacctctctgacatacaaacggatataaatcagcaattctctccaaataaaaagctaaacaacaaaaccgaccccaaacactgacaccttgtatccatcatccaaatttggtcaatgctaagatatatatttttttttttttttttgagactgggtctcaatgtgtcacccaggctggagtgcagtggtatgatctcggcttactgcaaactctgcctcctgggttcaagcgattctcatgcctcagcctcccaagtagctgggattacaggcacccaccaccattccaggccaatttttgtatttttagtagagacagggtttcaccacgttggccaggctggtctcaaactcctgacctcaggtgatccgcctgccttggcctcccaaagtgctggtattacagctgtgacccaccgcacccagccctaagatctttgtattagtcctttttagaaaaataaaacaaaaccttaaagattcagctggagactcctactcagtcctttttctttccagaaatgacccttgtcatggaattaatatgtatttatcttttccacatttgcttttactgtattatgtgcatagtcataaacaatctgtgatatcctgttatacatttcctttggtagcttattttgccactaaacatgttttcaggatttatgcatgttgaaacatgtagatcaattcttttaattttttaactgctcaaagtatttctaataggtgaatataccacaaattcttcaaccaatcttccactgataataggttgttttccatttttcagtattaccagacattgctatcatggccatccaggtataaatgcctttttgggtcaagagtttctgcagggtttttatctagaattgaaagtgctaagcagacagtatgcacatactaaacttcagtaaacattgagaaattgctatccaactgtgactctataaatttatggctgtcccagcaggtggtaataatcaccatttccttatattttcaccagccaacctgatctttccagactgttaaaagtttgccaatctgatggatgtaaagtagtatttcattgttattttattattgtgttttcctgatttccaatgaggttagacatctcttcataggtttattagctggaatttcctcttctgtgaatcctgaggtcgtacccttttgccctttttttttctattgtgttgtcattgtcataggtattttttgtattttgttcccgattgttttgtatgtttgtgtattataaatttcagcttgtggcctgtcttttaaaaaaagactttttattttgagattattgtagtttgcgtgcagttgtaagaaataatacagagatctatgtatgcctttcacccattttaccccaatggtgacattttggacagctaaatacagtatcaaagacaggaaattgacattgatacaatccattcatcctattcagatttcaccagatttatgtgtgtgtctgtgtgtgtgtgtgtgtgtatttagttctatacaattttatcatatatttagatttgtgtgactatcaacaaagtcaagatacagaacagttccatcacaaaggttcctcctgctacttttgtatagttacagttaccttgccccattcaacccctagcaacaacaattagttttctatttccataattttgtcatttcaagaatattaaagaaatggaatcatgcagtatataacctttttgagattggctttttcactcaccgtaattctctcaagatccatccaagttgctgtgtgtatcagccattcattccttttcattgccaagtaatattccattgtatggatgtaccatggtttgttttacccattgaaggacatctggattatttccagttacaggctattatgcttaatgctgctatgaatactcttatgcaaatttttgtgtgaacataagttttcatttctctgagataaacgctcaggagtgcagttactgagttgcttcaaatgcatatttagccttataagaaattgccaaactattttctagagtggttgtaccatgttacattcccattggcagtgcacaagggattcagtttcttcccatcctcacctgcatttggtgttatcattattttttattttagctagtctgataggtgtgcagtgacatcttgtggttttaatttgcattttctttatatctaatgctgttgcacatctttttatgggcttatttgtatgtccatctgtataatctcttcagtgaaatgcctgttcatgtcctttgtccacttactaattggtttatttggggtttttctgctgttgacttttaagagttctttatgtattctaaatacaggtccttgttgggtatgtggtttgcaaatatttcctcctagtccgtagcttgttttttcactttcttgtcaatgaagagtcaaactctgtaaaatatttgaagatacttattctgagccaaatggaagtgaataatgacctgtgacacagccctcaggagatcctgagaacatatgctcaaggtggttgggccacagcttggttttaaacattttagggagatacaaggcatcaaccaatatatgtaagatgtacattgatttggtccagaaaggcaggacaactggaagcaggaactttcaagtcataggtggattcaaagattttctgactggcaattgattgaaggagttaagttattgtctacagactgagaatcaatagaaaggaatgtctgggttaagataaggggttgtggagaccaaggtttcattctgcagtcaaagcctctgtgtagcaggattcagagagaacagattgtaaatatttcttttctttttttttactttttcttttcttttctttctttctttcttcttcttttttttttttttttttttttttttttgaggcagggtctcagtctgtcaccaagtctggagtgcagtggcacgatcacagctcactacaaactttgtctccagggctcaagtgatcctcccacctcaaccttccaagtaactgggactataggtgtgcacctccccacctggctaatttttgtattttttgtagagatggggtttggctgtgttggacagactggtctcaaactcctggcctcaagtgatccacccacttgtcttcccaaagtgctgggattacaggcatgagccaccacacctgacctgattgtaaatgtttcaatcagacttaaagagtctgttctattaataattccaaaaggaaggcaggtataatgaggcatgtctggctctcccttccaatcatggtctgaatgactttttcaggttaactttgacatgcccttggctgagaggagggctccattcagatggttggggggccttagaattttgtttttggtttatactcttcacagactcttttgcagagcaaaggtttttaattttgatgaggtctaatttatcaattttcccttttatagattatgctttggtgtcaaatctgggaactctttgcccccctttaggttcttaagattttcccttgttttgttctgaaagtattatagttttacattttacactaagtctgtgaatcattttattttttgtgtaaagcatgataattaggtagagatttatttttttggcctgtggatatccaatttgtccagtattgtttgttgaaaaggcttgacttcctccaataaatcatcttcacacttttttttttttttttttttgagacagatccttgctgtgttgcccaggctggagtccggtggtgcagtcacagctcactgcaacctccacctcctgggttcaagtgattcttgtgtctcagctaagtagctgggactacaagtgcgtgccaccacacctggctaacttttgtatttttttagtagagacagggtttcaccatgctggccgggctggtcttgaactcctggactcaagcaatcctcccacctcagcatcccaaagtgctgggattacaggcatgagccactgcacccacccttcgcacctttgtgaaaaataatgtgggcacatttgtttggggctatttctggattctctgttctgttccctcaatctatatgtgtattcttccaccagtaacacagtaacacagtcttgttaaagtaagctgtaggtatatgtaatcatttgtgattccttccagcttattcatatttctcaaattattttagctcttacaggtcctatgcctttatatataaaatttagagtaatatcgtttatgtcttcaaaaattaccttgcaggggtattgataggaatagcattaaacctacaggtcattttgagtgtaactgatatctttactatgtggagtttgccaatccatgaacacaatatgtctcccgatttattgagatattcttaattctttcttcagaattctgtaaatttcagcatacatatcctctacatattttgataaatttatatttaggtatttcattttctttggagtaattataaatggtaatgtgtctttaattttggtttccacatgttaattattagtatatatagatgcagttcatatttgtctcttgacattggatcttgcaaactttctaaactcttgtattagctctaatagttttttggtaagttattggagatctacgtagacacttaagtcatctgcaaatagggacagttttatttcttccttcctaatttgtatgccttttatttctttttcttgttttattgcactggctagaacttcagtactatattgaatgacagtagtgagagcagacattcttggctttttcccaattttagggagaaaaaaatcaggttctcaccattaggatgttagctgtagttttgtgtagatacactttattaagttgagaatgttctcccttattcctactttctgagactttttgtactacatgagtgttggattttgtcaaatgctttttctgcatcaattgatacaattgtatgattttttatttttaccttgttaatatagtggatcacacattgattgattttcaaactagctttgcatacctggattgtcccacttagttgtggtgtataattcttttcatccatcattgggtttgatttgctagtatttttagtattttgttgaaaatttttgctctaagttcatgaggaatatattggtctgtagttttcctttgttgtactgtctctctctggttgtggtatgacggtaatacaagattcataaaatgagtgatggagtgttcctttttctttctttctttcttttttttttttagacagagtctttctctgtcgcaaggctggagtgcagtggcgcgatctcagctcactgcaacctccaactctcaggttcaagcgattcccctgcctcagactcccaggtagctgggattacaggcacatgccaccacgcctggctaattttttgtattttagtagagacggggtttcaccatgttggccaagatgatctcaatctcctgacctcatgatctgcccactttggcctcccaaagtgctgggattataggcatgagccaccgcacctggcctcttttttttttttttttttttttttttttggagagggagtcttgctttgtcactcaggctgcagtgcagtggtgcaatctcggctcactgcaacctctccctcccaggttcaagtgcttctcctgcctcagactcccgagaaactgggactacaggcgcctgctgccacgcccagctaattttttgtattttagtagagatggggtttcacgatgttgcccaagctagtcttgaactcctgacctcaagtcatcctcctgcctcggcctcccaaagtgctaggattacaggcgtcagccactgtgcctggccaagtgttaccttttctattttccacaaaagattgtgtaaaatatgtattaattctttaaagatttgatagaattcttcaatgaagaattgatagagattcattttttttggcctatggatgtccaatttgtccagcgttgtttgttaaaaaggaataatttgaaagctcacaaagagaaatatccaggcaatttctggagatttctcctggagatttctcttttgggagtttttaaattatgcactcattttccttaatggttttagaactatgcagattttctaattcgtcttggatgagtttggtagagtgttgtttttgaggaattggtccatttcattaagttgtcaagtttctgcgtaaaaagttgtttgcagtattcccttgttatctactcagtggctatagaatctgtagagattatcacctgtttcatttctgatattagtgctttgtgtcctctctctcactctctctctctgtctgtctctttttagagataggggtcttgctgcattacctaggtgagacttgacctcctgggctcaagagatcctcctgtctcagcctccaaagtagctggaactacaagcatgcaccaccacgcctggctaattttttgtagagatggggtcttgctatgttcccctggctggtctcgaacttctggactcaagcaattctcccacctcagcctcccaaagtgctaggattaaaggcatgagccactgcacccagccctctttcttcatataagcatttagtgctattaattttacactgagtacagtctctgtatcacatatgttttgatatgttgtattttcattttcatttggttctattctttaagttttgttttagaattcttctttgacctagagattatttagaagtatgttgtttaatttccaagtgtcaggagattttctgttatatttctgttattgatttctggttttgttccattatggtcagggaatataacacataattttaattcttttgaatttgttggggattgttttttggccggggtatggtctatcttggtaaatgctctgtgaacacttggaaaaaaatatgtattccactgttgttgggtgaagtgttcccaacttaaatatcaattaagttgaatgttatgcagttattctatatccttgctgattttctgtctagtaagtctaccagttgctcacagtgggatgttgaagtgatcaattgtaactgtagatttgtgtacttctcctttcggctttatgaatctttgtttcatgcatcttcagactctctgttgtttggtgcatacacaggattgctatgtcttcttgataggttgacccttttatcatgatgtaatgtctctctggtaattttctttgctttaaagtctactttatctggtattagtagagccatcctggcttttcttttgattaacatttgtgtatctttttctatcattttactttgaatctgcctatatcattatatttgaagtgagtttcttctagataacatattgctggataatgttttcatgttcattttgccaatctgtctttaaactgatatatttagaccatttacatttaaggcaattattaatgtgttaggatttaagtctgccattttattgtttgtttctcctgtttttccttctctgcttctcttttcctactttcctacaggttacttgacatattttaaggattccatctttttttttttttttttgacatggtctcgctctgttgcccaggctggagtgcagtggcatgatgacttggctcactgcaacctttactttccaggttcaagcagttctcatgcctcagcctcccaagtagctgagatcacaggcatgcgtcactatgcctagctaatttttgtattttcagtagagatgaggtttcgccatgttggccaggctggtctcaaactcctgacctcaggtcatccacctgcctcagcctcccgaagtgttgggattacaggcgtgagccactgaggccagccagattccatctttaaaaaaaattattattgatttttgtgggtacataagtacccaaataagataaaactaaagttccaagccttcttctgttatcattacctttctgtttggagaatttcctttagcctttttttttttttttgagttgtagctttgctcttgttgcccaggctggagtggagtgcagtggtgccacctcagctcactgcaacctcgacctcccaggttcaagtgcttctcatgtctcagcctcctgagtagctgggattatataggctcctgccaccatgcccagctaatttttgtatttttagtagcgatggggtttcattatgttggccaggctggtctcgaatgcccgacctcaggtgatccacccgcctcagcctcccaaagtgctgggattacaggtgtgagccaccgtgcctggcccctttagccattctttaagggcaggtttactaacaacaaattctcttagtgttttctcgcctgagaatgtctttgtttcctcttcattcctgacatctatttttgccagatatagaattcacaattcataattcttttcttttacttcttgaaaaatattgagtcacttccttctagttgccatggtttcaaaggagaacttgactgtcatttaaattgatgttccctttcaaataatgttttatggctgggtgcggtggctcacgcctgtaatcccagcactttgggaggccgaggcaggcggatcatgaggtcaggagatcgagaccatcctggctaacatggtgaaaccccgtctctactgaaaatacaaaaaaattagccgggcgtggtggcaggtgcctatagtcccagctcctcgggaggctgaggcaggagaatggcgtgaacccaggaggtggagcttgcagtgagcagagatcatgccactgcactccagcctcggtgacagagtgagactctgtctcaaaaaaaaaaaaaaaaaagttttatttctttctgaatccattcaagatttttcttttttttttgtcagagtttaaggacatgtcttggtatggatttctttagttttatcttatttgggattttctcagcttcttgaatccataggttatctttcttcaaatttgggaagttttcagctattgattcttcaaataatttttcagtaccatattctttcttttctccttctaggaatacaaattaatttttatttatttattttgagacagggtctcactctgttgcccagggtggagcgcagtggcacaatcatagcccactgcagcctcaacctcctgggctcaagtgatctgcctgcctcagcctcctgaattgagttgctagaactacaggcatgtgccaccacactctgctaaatttttttgtgtgtgtgtgctttttgtagagacagggtctcactatgttgctctgctgatcttgaactcctggcctcaaacgttcctcctgcctcagcctcctaaagcactgggatttcagtcatgagccactgtgcctggcctttctcttttttattcttattttttttgagatggagtcttgctctattgcccaggctggagtgcaatggtatgatctcagctcactgcaacctctgcctccggtgttcaagcgattctcctgcctcagcctccctagtagctgggatacaggcatgcaccaccacgtccagctaatttttgggttttaagtagagatggggtttcaacatgttggccaggctggtcttgaactcctgacctcaagtgatctacccgcttggcctcccaaagcactgggatttcaggtgtgagccaccgcacccagcctttctcttttctttttaagcaggtagccttcctgttgagctatagtatgaggggtggttgggatgtatattcactttcccccttggtgctggggccactttcctagaaaatatgaggaacaaacctgacagtgctgcattgcttcctggtagggggtgtacgtttagttccttactgcgctctactgctgctggggagtgagaaatgatgagttgactcgtaccactttgttgatgcagggtgagggcagaaacttagctccccaatgggtcccactgacaccagcaggtgggggagtgaggcaggagtacagactagccttgcacaaagtcagaggacagtccaaaagaccactctcacttctgacaccagctgcgagtttgggggtccccaaaactgtcctcaactttcatgctttgctagagggactcacagaactccctgaaagctgttgtactcacagttacagtttattacagggaaagagttcagattaaaatcaggcaagggaagaagcctggagggcagaatacaggtaagttctgaacacagagatgacagtggagtaatgggcagctttaattgtcctggcaataacatgtgacaaaatgaatggagtatgtcaaccagggaagctcactcaagccttggtgtcactgctagaccttcctgatacttgtttggtaaagaaatcagagtgccacctccttccactgggtgggggatggagaatcagctctcaatttgttcccacccatgctaccccagcaggggaatcagactgttaccacctgcttctgccacatgggagttggaaaatcaactttaatctcctgtcaatgatgtgtgaaaatacacacaaagtattgccaagcagggaagctctcccaagccttggtgtccagagtttttattggggctcagtcatgtagacctggttgactgcccacattgctgacctcattctccagcccctctgaaggtggagctgatgccatgtgacccaaagctcccatcctgaatcacatcacttgactttctgatgtggtctaaagcccccctgtgaacaaacacacttttattaagcaggacattccaaaggctgagagatgacctcccaggagctgaagtttaaattcattactgcatatcctactttgtacatgtcattcacttttttttttttttttttttgagatggagtctcactctgttgcccaagctggagtgcagtggcgtgatcttggcttattgcagcctccgcctcccgggttcaagtgattctcctgcctcagccttctgagtagctggggttactggcgcccaccaccatacccggctaatttttgtagtttcagtagagacagggtttcaccatgttggccaggctggtctcgaactccttacctcaggcaattcacccacctcagcctcccaaagtgctgggattacaggcgtgagcccctgtgcccagcccacatctcattcacttttattgctgccaggtgggtgtggaggttcagcttcacagtgagctttgttgacaccagtgtaggtggaaaatgcaggcctggctggccatgacttgtgccacttgtccaatcttggtgatgctgattgggatggagactccggctctgccgggctctgccaacaccagggtgagaaggaaagaagagtcatggtgagtagcctcaccttgcaccagctcattaagtctgctgaaggggaggggagagagacgggagacccatcaccagaccctgatgacatggctgtggcaggaaaatcagggtaccaccttcttccactgggtgggggatacaggatcagcttcccactcattcccatctatgtaccccagcaggggaatcagagcatcaccacctgcttctgccatgtggaagctacaagaccagatccccagttggccctgctgaaatgacagggaaggggttgcagtttttccatcagtctttggctggcagggcagatatggttaaaaaaaatttctctataatctcagcattttgagagtccaacgtgggaggattgcttgaggctagtagttcaagaccagcctaggcaactgtattagtctgttctcatgctgctatgaagaaatacctgagactgggtaattataaagaaaagaggttcagttgactcacccttccacatgtctggggaggcctcaggaaacttagaattgtgtgtggaaggcacctcttcatagggcggcaggagagagaatgagtgcaagcaggggaaatgccagacacttataaaaccatcagatctcatgagactcactcattatcacgagaacagcatgggggaaaccacctccatgattcagttacctccacctggtcccgcccttgacacgtggggattatgggaattacaattcaaggtgagatttgggtggggacacagagccaaaccatatcagcaacatagtgagacctcctgctctacaaaaaatacaataattagccagttgtgttgatgcacacctgtagtcccagctgctcaggaggttgaggcaagaggattacttgagcctgggaggttgaggctgcagtgagccatgatcgtgtcactccactccagcctaggcaacaaagtgagatcatggcttaaaaacaaaaatgaataaaaaatcctgttgctggttttctttcttttcttttgattcaggggaactggcttttcttagagcgtttttttttttctgtgcttggtagtggttccaggtcagaggcttttcctttactgtgtctgggatgttggggtatatggaagacaataagaaaactcaggctgctcactgccacgagtgcccaaagtcccaggatccagaggtagtatgtcttctccttttcacctttcagaatctccttatgcttgtctgctgtgttatgtctgtgagttatcagttgtaagagagaggacctgggaagaatgacactactgcatcttggccagaaccagaagtcctgtagcttgactttcactttgcttatgatactgtatttagttttgacttttaatgagtcaaatgcattgaccttttcctctaaggtttgtgtgtgtgtgtctgtgtgtgtgtctgtttaagaaatccttctcgacattcaagtcataaagatagctcagactttttctctagtttttaattttttttagatggagtctcactctgttgcccaggctggagtgcagtggcacaatctcggctcactgcagcctctgcctctcccgggttcaagcgattctcctgcctcagcctcccaagtagctgggatttacaggcacacaccaccatgcccagctaatttttgtatttttagtagagacagggtttcaccatgttggccaagctggtctcgaactcctgacctcaagtgatcctcccacctcagcctcccaaagtgttgggattacagatgtgagccaccacgcctggcctttttctctagttttaaagtgctttccccactcccatatttaggtatttagtctaattggaatttatttttgggtgtgacagtgattttcaaagcatgatccaaggaccctgggtgactgagactctgtcaggaggacgatgaggtcaaactattttcctaatgatgccaagatgtaatttttctttattgtgttgacattcccaatgacagtgccaaagcattggtgggtaacactttttgcaccttagcacaagaaggcagggcaccccactctactcatcttcatattcttcatggccatgtattcacagttaaacaaacatgcaccagtttcatttaagaatgttcttgatgaagcagtgagagttattattgttactgactcctgatcccaagtatgtctttgagctcttctggatgatggaatgggaaatacacgaaaagcacttcttctggattctgaagcacaatggttgtctcaaggaaaagcacttatgcagtggctggaactgaactagctgccttttgtcttttgttttttgtttgcgtagaacatcattgaaagaaatactgagaaactctgatttttcagccttgggtatttgtcagacattctctcaaaaatgagtaaataagcctgtcacttcaaggaaaacaactgacagtgtttgttgctggtgatcaaacttgagctttcaaataaacaattagaattctggaacacttgtatctgttaccatgggcttgatggtttccaatagaagactttttgatgtgattggtcgtaatgttaatgaatgtgattttggggatgaaatgtgtcaaatgtggaagatcagtgtaaatcagtggcctaatgttttgtaaatgaccaatacatgatattccaaaatcatacttgagcaaaagatctttcaaagagtaagatagaccaatgaattctcatgtaacagagtatgaattgatacagtttcagattccacattgcaagtaaaccttaaaaatgactacttcttgagtttgggtgtcatagaaaataagaatattcacaataatctgaaaaggctattaaactactcctgcctttgctaaccacacatttctgtgaggttagattttccttatatactccaaccaaaacaatatatattaaaacagaccgaacatagaagcagatataagaatctagccagacattgaaacgatttgcaaaaatttaaaacaatgtcactaaaaattttttgttttgaaaaatagaagattttaaaattaaataacatgttacctatgttaccatgtaatgaatttatagtgaatttaaaaaataaattattaaggccaggtgtggtggctgacacttgtaatcccagcattttgggaggctgaggtgggaggatcacttggacctgggagattgagaatgaagtgagccattatcatgccacgccactgcactcgagcttgagcaacagaatgagagcctgtctcaaaaatttttttctaaaatttctcagtttcaatttatcatatagttttcatatatatatataatatatatataatatatatttaaaaagctctttgggtcctccatatttttttaaatggccaggaaatgttgatctatggcatgaaatagagatctgattttattaatttttttttttggagatggagtctcactcagtcacccaggctggagtgcagtgacacgatctcggctcactgcaagctccacctcctgggttcatgccattctcctgcctcagcctcccaagtagctggactacaggcacccgccactatgcccggctaatttgttttgtattttttagtagagacggggattcaccgtgttagccaggatggtctcaatctcctgacctcgtgatccgcccgtctaggcctcccaaagtgctgggattacaggcgtgagccactgcacctggccaatctgattttattttcattttctcatgtgaataaccagtttctccagtagctgaagtagtctatcctatccctactaatttgtaatataacctcttgccattagtatgtttccatattcatttgattgtgtgcctagactctttttctattatatatatttatttgttcatccatatgccaattccactgtctttttttttttttttttttttttttgagacagagtctcactctgtcaccccggctggagtgcagtggcacgatctcggctcactgtaacctccgtctcccaggttcaagtgattcttcagcctcagcctcccaagtagctgggactacaggcatgcaccaccacaccgagctaatttttctatttttggtagagatgggttttcaccatgttggccaggatggtttcgatctcttgacgtcaagatccactgacatcggcctcccaaagtgctgggattacaagcatgagccactgtgcccggccaggaattacacttttagaaatttgtattatacagatatttgcaggaatgcatgaagatctgtataagagaatttcattagagcattgtgtctaataataaaaaattagaatcagtctaagagtccatccatagagaagtggctaaactatggtagaactttagagcaaaatattatgtagctatttggaaaagaatgcagaagatctaattgtatcatcatggaatggtcttcaagatattaagtagaaagtcaccaagtggaaaaacaagtcacagaatatgtagagcatgttcccatttctgctaaaaaaaaaataataatacaaaaactcagccgggcacagtggctcatgcctgtaatcccagcactttgggaggccgaggcgggtggatcacgaggtcaggggatcgagaccatcctggctaacacggtgaaaccccgtctctgctaaaaatacaaaaaaattagctgggtgtggtggtgggcacctgtagtcccagctactccggaggctgaggcaggagaatggcgtgaacccgggaggcggagcttgcagtgagccgagattgtgccactgcatgccaacctgggcgacagagtaagactccatctcaaaaaaaaaacccacccaggtgcatgcccaactactaccagcgatttgtcacctctgagaagaggagtgggattggaagagagatgtcaagggaactcttttctttcctttttaaaacctacttctagattgtctgcattttctataacaagaattaattaacatattgcttgtgtacttattttctttttcttttctttcttttttttttttgagatggagtctctctctgtccctcaggctggagtgcaataatagcatgatctcgggtcactgcaacctccacctcccaggttcaagcaactctcctacctcagcctcccaagtagctgggattacaggtgcctgccaccatgcccggcaaatttttgtatttttttttttagtagagacggggtttcactacgttgactagcctggtcttgaactcctgacctcaagtgatctgcccacctcagcctcccaaagtgctgggattacaggcatgagccaccgcgcctggcctgctgtgtaattctaaataatcatcaggaccatgaacctgaccatctgtgaaagacagagatgtttcctggcaggatagggtccactgccattgatattggcaaggtgcctgctgctccttagcctgctgtaggtaccagattgaccttgagtagaaccagccttgagagaagaggaaaggagagccaggccctaatcatagggatccccaggggtgtagatgatgttaaggcaacatcttctctgtgtctaagagaaaaagaatctgccctgagtatgaactgacttgtgtgctttgaggtcagtgtcctaaacaggaagccatgaggtgagcagagacacttccctgctgcctggggctgggagttgggaagtgagaaaacatcctagtggccaccagaaccatccagtgggtggctctgaatcctgcattgatttgttgggagactttggaggaggagcctggtgtggagggttgagcctggtgagttggaggcagcagctggttactttccatgcagagcagcttggagttgagtcactcgacaatccaagggcacctgtggaagcagccatgactcatgctaccttcagtttcacatctggaggaggaaatcactgacaaagcaaagcaaggcgacttctgggggctgccgtgtaggattctcccatgtttaaaaaagaaaaaaagattgtacaggatttaaacatagcatttattgcctgtgttcttagttataaaattaatacatgtacataataattgttgtagttagttattttattcagcatttatcctatgtcaggtactgatgcttcaagctttacatgcgttgtctcacttagtgtttctgaccattcagtgggggagatctgttattatacccattttacagatatggaaactgagtctatacacacacacacgcgcgtaaaacacatagaaaaaaatcacccacaattctacccgccaaagtcaaccaacatcctgatgcgtgtttttctagtaaccttttaatatttttcctgtgtagctaatatccaactattttactttcccatatcctgcctttttcactcagctctaaattatgatcctagtcccaaatcatcacatattcttcaataacttaactagtccatatggccaaacattgtatgtttccaatttttccactgttataaaggttgctgttgtgagttatcttagtgggctaaactccgattattcctctaggaagaacatggaatgatacattcttctaaagaaatgttctgtgtttctatgctcttccctctactaggaggcacttgaacggagtggttgagagttgtaaaaacctatttttatttatttatttatttttgagacagagtttctctctgaagcccaggctggagtgcaatggcatgatctcagctcactgcaacctctgcctcctgggttcaagtgattctcctgcctcagcctctcaagtagctggggttatagatgtccaccaccatacctggccaatttttgtagttttattagagatgaggtttccccatgttggccaggctggtctcgaactcttgacctcaggtgatccactcgcctcggcctcccaaagtgctaggattacaggcatgagccaccgtgcctggccagaaaaatctatgtttgagtcccagctctctgctgatctacaactatgtaaacttgggcaagttatgtcccctttctggcccttgcatacttacctataaaacaaggctaaagtaatatttactacctcaagggttgctgtgaggattaacgatgtaattactgtaggtagaggtatcttagtccatttcatgttgctgtaaaggaataccggaggttgggtaatttataaataaaagaggtttatttggctcatagttctgcaggttatacaagaaacatggtgccagcatctgattctggtgaggggcccaagaatcttacaatcactgtggaaggtgaaggggaacagacatcacatgtcaagagagaggaagagaaaagaggaagatgccagcttctttaacagccagatctcttgggaattaagggtgagaactcactcaatcctgcaaacatggcatgaagccattcacgagggatctgctcccatcatccaaacacctctcaacaggccccacttccaacactggggatcaaattttaacatgagatttggagggaacagatgttcagaccacatcaaaagggcttagcaccttgttattaggcctagaaagcatctcccccttctcctgcctcttgaccaccatatctagcttcagtgacactccttttgtgaaatctctgatatctgcgtggttaaaattatgctcttcccccaacctcttttttttttttgagaaagagtctcgctctgctgcccaggcaggagtgcagtggtgcaatctcaactcactgcaaacttcgcctcctgggttcaagcgattctcctgccttagcctcccaaatagctgggactacaggcacacaccgccacacccggctaatttttgtatttttagtagagacagggtttcaccatattggccaggctggtctcgagctcctgacctcaggtaatctgcccaccttggcctcccaaagtgctgagattacaggcgtgagccaccgcacctggcctctttccccttttttaaaaaaagaaggcgaaattcacataacatagcattcatcattttaaagtgtacccttcagtggctttatgtacattcacagtcttgtgcaaccatcacctctagatgccaaacattttcatcatcccacaaggaaaccacttacccattgaccccttatccacagtagtcactgtacttcaaggtttcccatatcccatatccagcgtggctggatccaagggatcaaatgccatcagtaggactcagtttttctgcatctacttgtgttggcttcactctcgggcagatgctttccatatggcaatcccagtggctctaagcttacattagccatcaggtagcaatcccaacagagagagatcgtttcattagaagtttcaatggaagtcatgggactgagtattattgcctcaacttggataatttgcccatggctgaactgattaccatggtgggggagaggggaagaggtggcggtagaatattctgattggccaggttctgggtcgtatgttcattcctccaaattgcattcagaaaatgggtgctggatggggcaaaaaatcaggtgtcattcaaagttcactaggcttagggagctgggctcagaggccagaggcctgatcttgatcttgtcatcacttagcaaatctcctggccattcaggccttcacacttcctgtctgtaaatgggtttatcaccactcattcaagtcctaattattaccagcgctgagaaaccaatactttctttttccatctcgcttgtgtaatttcttcggagaagcatttggatggtctctgaaccatttttaccctgagaaatgggacttaggaaattatgcagccacattttatatccattctggtcatttcagtaattggttctgagacactatttccccgagcaccatcccaagtataaactactatttccatctgtgttactggaggaaactggggaaagacatttgtgggttttttcccccccaggccaaaaaaaaaaagcaaacaaacaacaacaagaaaaactaaagtagagcccaaaaccaatttgttggttcccagcttggcttaggcaccattctaagcatattccactagtccctccatctccaaactagtcattcttgggagctgacctacttagtgcacagcaaaggaaataaacagaaatccagcaagtccatcatttgagaggcccatgctgatgactcagagaatatataaaatggcaggttggccaggtgtagtggctcatgcctgtaatcctagcactttgggagactgaggtgggtggatcacctgaggtcaggagttcaagaccaggctggccaacatggtgaaaccttgtctctactaaaaatacaaaaattagccaggtgtggtggcacaatcgctggaacttgggaggcagagactgcagtgagccgagatcgtgccactatactccagcctgggcaacagagcaagactccatctcaaaaaaaaaaaaaaaaagccaggttgttttgctcttaatcgggttacgtttgaggattcttttggttctaggtgaccaaaacccactgggttcagccaaaagtggatattgttgaaggattctagggtgtctcacagaacacagggccatggttccactggaattcaggaaggggatagagtccattgtgaatcaaggaggtccctcccaccacctctacctcttgactgtttttctccatgtctcctctattcttctatctcatgggagagtgacagaagtcaggttgagactggaatcttaatctcagcaccaaaagctcagggaaggagcctattggtccagcttgggccagatgttgacacctgatccaatcaaatatggagaggggatgtgagttccattgtatcaacatgatcgtgttagtggtccagaaatacttctgagggaaaaaaaggtgtatgttacacagtgatatcaattaaattctaaactatagtgaaatattattgtcatttccacctcttttaaataaatctgagatggtctaacccctagcatagttcagtttctgggtctagattactggggtttgaatcctggccccaatatttgctgtgtgatcttaggcaaattacttaacctgtctctgtgccttcgttttgtcatctacaaaatgggtataataatattacttacctgacagcatggttggagccattaaatgtgttaatgtaagtaaaatgctcagaactctgcctggcaaatagtaaagatttaacaaatagctattattattactgtaaagttcatttcattatgacagattgtttttcagattattcaaaatatagaagatgtttaaaagggaatttctatgataatgggaaaatagggctgaataaccattactaagattgaatatatcattgctattgcccttgaattctataatttgaattcatattatttgaattctagacggtacttttgatttataaccttaaaagctttagtaagggtttcttctaaacagccttatataaaataatagcaattcttgccatcttacctagcaggaaaaaccaattgttttatcaagtttgccagcataagattgaaatttaaagcctttaatatcttagtttataaaagacaagttacagaatgtctctttcctggatgtcttagaattacagtatcttttagggcaggagtctgtgaacctttgcttaaaggactcatggtaaatatttttgtctttgagggccatattgttaaaggaaaggggtcccgatccagaccccaagagaggattcttagatattgtgcaagaaagaactcaaggcgaatccatagagtaaaatgaaagcaagtttatttattaagtttcttaagttattaagaaagtaaagaaataaaagaatggctactccacagccagaacagcagcttggactgctcaactcataatgcttaacagttttttctaaattatatgctaaacaaggggcgaattattcatgagttttctgggaaagaggtgggcaattcccacagctgagggttcctccacttttaagactatataaggtaactgacattgccatggcatttgtaaacagtcctggcgctggtgggcgggtcttttagcatggtaatgcattataattagtgtggaatgagtagtgaggatgaccagagatcatgtgcgttgccctcttggttttggtggcttttggccagcttctttaccgcaacctgttttatcggtcaggtctttgtgacctgtatcttgtgccgtcctcctagctcatcctgtgacttagaatgcctaacctcctgggaatgcagcccaataggtctccgcctcattttacccagcccctattcaagatggtgttgttctggttcaaacgcttctgacagtatggtctctgtcccagctactcagccctgctgtaacacaaaagcagtcatcaacagtacctaaacaaatgggcatggatgtgttctaataaagctttatttatagatgctgaaatctgaattttttgcagttttcatttgattccacgctgaccccttgccccccgtccaaatattcacaaatgtaaaagccattcttgtctcacaggctgcacaaaaagaagtgatgggctggagatggccttggggccatatttttcataccctgctttaggagacagtgcattagcattctgacagcaggcaggggaggtacaagatgactgtctactgcctcttgggttctaacaccccagatgcatgttgaccccctgctgcttctcatcatgcgtttctcttaaaagatacatagtatttgtggggctgggcgcggtggcccacatctgtaatcccagcactttgggaggccgaggcgggtggatcacgaggtcaggagagcaagaccgtcctggctaacacagtgaaaccccatctctactaaaaaaaaaaaaaaaatacaaaaattagctgggcgtggtggtgggtgtctgtggtcccaggtaccccggaggctgaggcaggagaatggcgtgaaccgagatcgcgccactgcactccagcctgggcaacagagcgagactccgtctcaaaaaaaaaaaaaacaaagatatatagtatttgtgtgactttcttggttttgtgcaacagaaaactcaacccaaactgcatatgcaaaaaaaaaaaaaaaaaaaaaggaatgtactaaccggggtttctacactctaggggtggttgaggcaggagtccaaagtctatctgtttatccctcagcttttatcccctccatgagggctttgttcttaggattcagggtttcttttcccccaggggggttcacagcaaagttctgggtctgactacttctggtgtgtatctgatcctatatctatctgaatctgaacgggaagggaacacagtgagcaccttaggccacacctgggtagggtaagccccattaaatttgcaagtcctgggagcggtggtgccagttggttccccaaaggaaacaggtcctattacctaagaaaggtgaatggatactgggaggcaaatcaacaaatgtccattgcacatgaggacatcacactgtgacatttagaatctaaatgctctgaacaaaatgtataggggaccttccaggaacgggaaattgctgttcctaccccctctttttggagaaattgctgttcctcccattggcaaaattcccctcgcaggttccagcttctttctcttagaacagaccttctggtttggcaagcccagtcccacatcgaggtttagttctggacttctgtgcagggtcatggcactcgcttgattgaaattttgtttggggaagcaatgacctgaagagcttacagcctgggtcaaccactcaccactctcaggaaaagcagacagagccaaactttctagctgggctcaaaatagctattttctgacgtgggtcctccatgactcatggtggagttttccaggctcgaggggactgttgacatttactctgctcctcccacgccacagagtctaactttttctatcttcccccaaacataactcattacctccagtttatcccatgtacacttctttttcaccccagttttcttttattttcagcgatccattccagatccaatatctttttttttgagatggagtcttgctctgtcgcccaggctgcagtgcagtggctcgatctcggctggctgcaagctacgcctcccgggttcacgccattctcctgcctcagccttccgagtagctgggactacaggcgcccgccctcatccggctaattttttgtattttttgtagagacggagtttcaccgtatgagccaggatcctctcgatctcctgaccacatgatctgcccacctcggcctccccaagtgctgggattacaggtgtaagccacctgcacccagccctccagatccaatatctttttcctccatcctttgccaaaccaggacttcagcttctggttactggtgcccacttcaagagatgccaggcagggaactctcaggacacataccaggcctgcactggcatatgtattttttggagacaggatctctgtcactcaaaatagagtgcagtggcgtgatcatggcccactgcagcctttaactcctaggctcaagtgatcctcctgcctcaaccttctgagtagctgggaccactggcatatgccaccacacctagctaatttttcaaaattttgtagagatggggtcttgctatgttgcccaggctgatcttcaactcttggtctcaagcaaccctcctgcctcaacctcccatagttttgggattacaggcatgagccactgcacccagcctcggactgctactttagaccccactttcttgtccaggtgtgatcctgggtgcgtgtgcccagagacgccctggctacctgggattcatccatcaaacacctggtcattcagccaattctgtgcgaacagcaccttcccggctgtcccaccctctgcaaagatctgtgatgctggaaagttgtgtgtggctaagtcggaagaagtgaagttcatctgcataagtgcagtagtgtatttattgatttttattcttattttttatttttatttatttatttgagacagggtcttgctctgtcacccaggctgtggtgcagtggcatgatctcagctcactgtaacctccaccgccttctgggcttgagcaatcctcccacctcagcctcccgagtagctgggaccagaggcacacccaccatgcccggctattttggtttttgtattttttgtagagatgaggtcttgatatattgcccaggctggtctcgaactcctgagctcaagtaatcttcccgcctcggcctcccaaagtgttgggattacaggcgtgagccaccacgcccagtccagtagtgcatttactgatagcacttactgcagctattttcttttattgcatttactgcattcctgctatgtcccaggctttgcacacattagtaggcgttcgatcctttaacaattctttgaggcagtagcaggtcttcctatttctatacttgctcccttagtagatcacactctcatgggaaacacagtgacttttttttttctttctttctttttttcagacagagtttccctcttgttgcccagtctggagtgcaatggtgagatcttggctcactgcctcagcctcccaagtagctgggattacctgccaccacgcccagcctgattgtattttttaaaattaaaattgaaataccatcaataggttgaccactaggactaaaatccaaacttttcagtgtggcctataggccgggcatcatggggccacttcctgtctctccatcttggaacaccccttcccttcctcattttgctccacccacatctgccttttctctttcttttagagacaggatctcactgtgttgtcacctctcacagcttctgcactcgtggatcctctatctgaagcattcttccccctccgtcttcccaggccagcttctgctggtcattcagtgtcagctcaaatgccactttctcatagaggtcttctgtgaccccgctatctggaggagtccccgggatcaatcactgtctacccccgtaatggcattttactctcttcctagccctgtccacctaaatgatgttgtttgtttatcttttggcttgctgtctgtcttcatcaggaggatggatgtttcatttctgcatgcctagctcctagaatattgcctggtgtgtggcgggcatgttgaataaacaaagagcccccaaatgacataggaggccatgccatgtgccccagtccctgcagaggagcgaccatccaccagcagaccctgtgtctttgaaaggaattccagagagagtaaaaatcagtgcctatgaaaagtatcccaactggctgcaccattgcctagcttttgtgctcagtgtttttggttttgttttttcgacatcattggcttttaaagccaggtcaacctttggacttgaaccctcaggttttgcatctcccgctgcactgctgggcagtcgacccttcccaaaccaccagttctagctgagacacacacgaggttctggatttttgctccaccagcaggtgatcctcttcatcttccattgcaggcatctttttctttaattataaaaataacaccatactccactctcaaggaagcactcataactccctaccctataagtgtgggctgtgtatagtgacttccttccaaagaggaagtgaaaggagaaactttacaatggagaaacctggcagacactccctcagccaggggctcaaggtcagcatcaacagtgccaactcatcttgatgggatgtaccacggatgtgaagtgatgagaatggtggccgggcaccatggctcacacctgtattcccagcactttgggaggctgaggcgggtggattacctgaggtcaggggtttgagaccagcttcaccaacatggcgaaaccttgtctctactaaaaatacaaaaactagccaggcatggtggcacacacctgtagtcccagctactcgggaggctaaggcaggagaatcgcttgaacccaggaggcggaggttgcagtgagctgagatcatgccactgcactccagcctgagtgacaatatgagattccatctcaaaaaaaaagaaaaaaaagaagaaagtgatgagaatggtgacttacctctgcagtcttctctccaaactcacaacttgtctcaccatcagaaaaactcaaaattaaagggtattccactacaaaatacctgtgcagtaccccttaaaactgtcaagggcaggctgggctcatgcctgtaatcccagcactttgggaggctgaggtgggcagatcacctgagttcaggagttcaagaccagcctgaccaacatggagaaaccccgtctccactaaaaatacaaaattagccaggcgtggtggtgcatgcctgtactgccccctactcgggaggctgaggcaggagaatcgcttgaacccaggaggcggaggttgcagtgagctgagatcatgctactgcacctgagaaactgtcacagtgtagaagagtctaagaagacacaaggactgaatgtcatgcactgtcctcgatgggatcctggaatggaaaaagaacattggcggaaaaacaaggaaatctgaacagagtatgcattttaatctttttttaaatcccctaaggatttccagtactgatgctttgcctttgtgcttgagatccctgtttagagccacatctcccttctggtgtggattttcagtccgacatgaatgcttccagatttgcttccttccttcttctgccatgatctgactctccctctgacttcacattgaactggacccgttcacgcctgcacacatcctgtttttcccctggctgctcttccctgcgtcccccctccgcagaccaccctcattcagatgaggatatatcccaccctatttcttgggcttacctttctgaatgaaaataatgttcctggtgcaatttatctctcctgtcaaatttccagcctgcagggaattaaatgaggcacatgattttcaggctaagcagtttttaaaaactgaaatattactttagacaggcccaatttattttcctctggattctcatcattttaaccccgccaagcacatggttttaagcagctccatctgctcctctaaccatccttgcgtgacctgggcccttgactgacttctgaattggtttgtaaattggaagaattagggagtcggttaagatgcatgaatcatagctcaggatagatttataattgtctgttttcatgaactcattctgagattgcagggatgggggatatttcagaacaaatggaccttgagtaacagaatgaacctacagaagtgccgaaaaagatttgttgtttatgcaattttaaccgggcaattgttgttattataggtttatcaatttccacaattttaattccacagccctaatgatttgctttgaattaggaagtatatactttattctctcatatggtcccaaagggccttagaaagcaatcggagcccttctgcttgtcattggaagaaatatgacagcatggtttggtgattcattgaaggtcactttgaagtgttggggagaggacactgagtaatgtaaaatgacattacaatttgttaaataatttgccggaactcttgtgtcatctctttcaaagtctcaccctggaaataacacacacgtaattcaaatgcaatctttctggaagtcccacctgggaactgcagtcccaatctgtggcaaagtcttgtgaatatccttaatgtgataaaactttgccttagacggagtttgctttttggaataaccaaagtcattctgggccaaggtgtttgaataaagtggttgatcaaatgaaatttaatgtaaagttattttaactgcttttcttgagtaacgcataaactgatttgaaagcaacaaagaatttgtttattactacctctccttattccagaaaggacttaatgatcttattggagccttaaaaaagttttaaaaggctcaagaaatgttggtaaatttccttttttttatcttttttttttttttttttttttttgagaaggagtcttgctctgttgcccaggctggagtgcagtggctcgatctcagctcactgcaatctctgcctcccgggtttaagtgattcttgtgcctcagcctccagagtagctgggattacaggcatgcgccaccacccctggctaatttttgtatttttagtaaaggtggggtttcaccacgttggccaagctggtctcgaactcctgacctcaagtgatccgcctacctcggccttccaaagtgctgggattacaggtgtgagccatcacgcccggcctaatttacttttattattattattattattgttgttgtttgagacggagtttcgctctgttgcctgttgccaggctggagtgcagtggcgtgatctccacctcctgggttcaagcgattctcctgcctcagcctcccaagtagctgggactgtaggcgtgcaccaccatgcccagctaagttttttgttttttgttttttgagacagagtctcgctctgtcacccaggctggagtgcagtggcatgatcttggctcactacaagctccgcctcccgggttcacaccattctcctgcctcagcctcccaagtagctgggactacaggcatctgccaccacgcctggctaattttttgtattttttagtagaggtggggtttcaccatgttagccaggatggtttcaatctcctgacctcgtgatctgcccacctcggcctcccgaagtgctgggattacaggcgtgagccaccgcgcctggcctacttttattatcttaatatcactcttctcatttctcttctctaagcctaatattagtatttgtggacattgcaggtgggacacaagacctttggtgcttctcatcttccaagagggcacagaatgggatggtgtatgaggtgggatattcccagccaagggagttctgggagggaggtgaagttggggcaaagaattcccatgggctaatgtcctctgtgcttccccaaccctagttccagctgatgtggaattctgagtttggctgctttttcttttgttgatggtggtgatggtggtggtggcaatgatgatgatagtgatgttgatggtggtggtggtggtgatagtggtgatggtgatgatgaaaggggtggtaatgatggtggtgatggtgatgatgacagtgatcgtgatgatggtgatggtgatggtggggatagtaatgatggtgataatggtgatagtgataatggtgacgatgacagtgatgtgctagtgatggtgataatgacagtgatggtggtgatagtgatagtggtgatggtgatggtaaagataatggtgatagtggtgatgattatgatagtgatagtgattatggtgaggatagagacagtgattgtgataactgacattcaccaagtcctcactgtccttatgatgtaccaggcaccacattaagagccttatatacgatctgtcattcaatcctcactgcatccaagggtaccctctattattatccccagttaacaggtaatgaagactgaggattgggaaagttacataactcacttaccagccacacaactagctattatgaaatgaacaaatattacaagctaaggattaatagacccactttacaagggaaatttttttttttttttgagacagtcttgctctgtcacccagcctggagtgcagtggtgcgatcttggctcactacaagctccgcctcccgggttcacgccattctcctgcctcagcctcccgagtagctgggactacaggcgcccgccaccacgcccggctaattttttttatttttagtagagacggggtttcaccatgttagccaggatggtcttgatctcctgacctcgtgatctgcccgcctcggcctcccaaagtgctgggattacaggcatgagccactgtgccaggcccacaagggaaattttttaaagtggaaactcagagaatttaaataacttgtccaggggcacaaagccaggcaggggcagagccaggcaggggcagagccagcctttcaccattcaccattgctggctttgaacatgaagcaaggggccataagccaaggaatgtaggtggccaaggaatgtagaagctagaaaaggcaaggaaactcattcttccttagagccccaagaaggacaggcaatcctgctgacactgttaccaaaacaccaggggattcgtctaggtcctgctgctcactgcacagaaggccgacactgagacaacaattattgctaaggaaggaggctttactcaggtgttgcagccaaggagccagtaactcagtctcacatccatctccctgaccaactaaaatcaagggtttatacagcagggaagagatgtaacaatgtgtaacaaaacaggaacttgggacgggcaaggaagcaatcccgatgaatgaggggtctggcatctcattgtctggatgctgtaatctggtgagtttcagttctttgatacttatttgagaggcaaggaattccctcctgaggaaggaactcagataaaacaaactttaagtttcaagagttaagaccagaaaggtcaatttctatgtttatcaagaaagaaaaaaactgtctatgggactacttgtgttggtttcaacaccctgattttcacgtccgttgggcctctgtcctccagaactataataaatgtgtgttgttttaagccactaagtttgtgtttatttgtaactgagacacagattggcatttttttccactgtcacccctcttgccttgtatcatcagttgttagtatttgttttagctggggaggcagctggagcatgaagtcaacaggaacaatgatgatctgcagggaggaaagccctaggatggcgggataatccccattgtgccccctcatcattagccacagtacttggctggcatttgagcagagtggttatcacagcagcgttcactctcctgcccccgggttcctgttcttccctctcttcaagagcactcaatgcatatctctccaaaccagtgcttctccacctttaatgtgagtgataatagctaacattcagcacactgtgctcaatgtgtgaatcccctcacttaacctccataccaacccttgagatagatgttatcattatccttcccatttcaggaaactgaggcatagagtgtttaatgaagaatcacctgcttgaagggcagcttgctgggtctcctccagggagattttgattcagtaggtccaggagaagcccaggtagatggattttttttttttaatcacacctaggtaagtctcatacctgtgccctgggagcacaataaaaaaactctgggtttaggctgtgtgcagtggctcatgcttgtaatcccatcagcttgggggtctgagatgggaggatcgcttgaggccggtttaagatcagcctgggtgacatggtgagactccgtctctacaaaattaaaaggacgtgatggtgcacacctgtagtcccacctattcaggaggctgaagtgggaggattgcttgagcccagaagcttgaggatgcagtgaggtatgatcacaccactgaactccagacttggtaatagagtgagaccttgtttcagataaaaagaggaaaggaaagaaaggaaaaaagaaaggaaaggggcaaaaggaaatgggaagggaagggaagggagaaaggaaggaaggaaaaaagaaagagaaaggaagaaagaggaaggaaggaagggaagatggaactaaggaaggaagaaaggaggaaagaaagaaaaaggaaggaaaagagagaaaggaaagaaggagaaagactctgagtctaaacccgtggttttcaacaaagggtgattttgtcccccaggggatacttgccagtgtctgaggacattttgggttggggagaggatgctactggcagccagtgggcagaggccagggatgctgctgcacagcctacagtgtttagcacagcccccagcacaaagaagcgtccaactccaaatgtcaaagcactcacaggctatggagcagcagtgagatgaagctcttgctctagccttggctcctgcactcagaatgagtcttcagatgttctcagattacacttccagaggattaggctggaatttgtctttcttgtgaaagaaactctttgtctcaagtgttgggtcctcccaggattcctccccaaatgggctatcttagtttctcctctactcctcaatctcacctcttcaccttcatccttatttcctatttcactgcaaaagtcaagggcccagcctggccaacatggtgaaactctgtctctaccaaaaatacaaaagttagtcaggcgaagtggcaggcacctgtaatcccagctacttgggaggctgaggcaggagaatcacttgaacccgggaggtggaggttgcagtgagccgagatcacaccactgcactccagcctgggagacagaatgagactccatctaaaaaaataaaaataaaaaacaaaaaaaaaaagtcaacggcatcaaatgctctcctctgctccctttgtcatttctttgtacttggacctcttagatcttggacttctatgaggtcacagaggaagagcatgtttccagaaagaaattcctacaatcagccagttctgcataatcttgtggttcacgagaggggaaggaccacagcttctccttgagtccacctgggaagggcatctgtggacaccttctctctgcctccctttccttcctcccagttccttcctagagggatggtgtttgatttctgaggccctggacatttcttccagctcatcattcaggttgttcagagcatttggaagacgagcttttctcttgccaacactgaccgcctcttgcgggaagatgtcgcagcattattatttaataacccgtgtctttcttcagctcatcaaagaccttccagctccagataaggagtcggggtagggagtaaggaaacaaagggatgagggtacaggaaaatcccagctgccccttatcacacaatcaatatattcaatcaatatagttaatagcaatgtgccaatgtcagtttcttggtaaagttaacaaatagtggaaattgagtgaggggggtagaggggaattctgttggctctttgcaacttatcactgcccatctccagttttctggtgcctttgctcagatgctgctgtggagtcccctccacagagatacctgtgtccttctccccaccttcctggctcccaacagactacactgcctgagagagctgaagtcaggcattcattctgcaggggattctgggtcacagctgagccagtcctattaggatttagggggcagccgacctgtggggcctgcaccgcacacactccttctaagggtttcctcacagtccctgctgaaggggagggtctcgtgtgacctgtggctccacccaggttgaacgtgctgaggccctgaccaaaggcagggccacccataggctgccaggggctggaggtgggacgagagggtccatcagaagtcctttcatgagagcagttaagagggaagcagaagagtcctgaaatggagaaacacctcagggagacagaatctttgaggaaggggaaggtatcagggagaaaagaaagaaggagatgaatggagggtcccaggatggtgaacaatgacttgggacttgggagcacttgaaatgtggccattccaaattgagatctgttcttcctttatttagttttgagacggagtctcactctgtcacccaaactgtagtgcagtggcgcagtctcggctcactgcaacctccatcccccaggttcacgtgatccttgtgcctcagcctcccaagtagctgggatgacaggcacgtgccaccagacgtggctattttctgtatttttagtagagatggggtttcaccatgttgtccaggctggtgtcgatctcctgacctcaagtgatccacctgcctcggcctcccaaagtgctgggattacaggcgtgagccaccgtgcctggcctgaattgagatctatttaaagggtaaaatatacatactggacttaagacttccatactccctccaaaaaggatataaaacatctcattcgtatctttaatatattgattacattttgaactgataatcctttagatctattggattaaataaaatatgttagtgaaattaatctcgcccatttctttttatctttttttttatttttaagagacagggtctcgttgctatgttgcctaggttggacttaaactcctgggctcaagtgatccccctgcctcagcctccagagtagctgagactacaggcatgtgcctccgcacccagctctttttacttttttttttttttttttttttttgagatggagtccgttctgtcacccaggctggagtgcagtgactcgatcttggctcactgcaacctccgcctcccaggttcaagcgattctcctgcctcaaccttctgagtagctacgattatagtcacctgccaccatgcccagttaattttttttgtttgttgttcttgttgttcttgttgagacagagtctccctctgttgcccaggctggagtgcagtggcacgatctcggctcactgcaacctccgcctccccagttcaagcaattctcctgcctcagcgtcctgaatagctgggattacaggcacacaccaccacacctggctaatttttgtatttttaggaagacgggctttcgccatgttggccaggctggtcttgaactcctgacctcaggtgatccaccgcctcggactcccaaaatgctaggattacaggcgtgagtgagccaccgtgctctgccacggctaatttttatatttttagtagagatggggtttcaccatgttggccaggctggtcttgagctcctgaccttaagtgatatgcccaccacccttggcctctcaaagtgctgggattacaggcatgtgcctccacacccagccttttttattttttagaatgtggttcctggaatgttcaaaattacatatgtggctagtgttctatttcaattggaccgcactgatctatacattctctcttttatgacccccgatttacagataaggaaactgagtctcaaagaggttagggcatttgccgaggtcggccgttagaaagatgccggaccatctactcatgtctgcttgacgccaatgcctgcgtcttcacgtgctgttggtgcgtcctcctgaattacttttgtgtcctttgacacgtcagatgtggctggggaaacagaaactcgcagaagttaaaaaaatgtgcttgaggtgccactggagaataacaatcatagccaggatgtgaagcctgtcagtttcctcagccgcaaattcttccatgtggggcgacctcacagagacgggatgtatgggacggcggagtgcaaagaaaggtatgatcgctcttgggggcccagtggcatcctctccacgaggcaggctgggagaaatcgagcagccaggagcttctgggttaaaagcagtgacttcatctctttgggaaacggtgactcattaaaagcaacgggcggcttcccattacattcacgttatagcaagaaggcgaggcacttggtgcatcccgtaataggatgcttgggggttggaatgagcttctttcctacatgaatgattgatgacaacgaagtctagagtgccaccaggagcctttgaaatgcattcagatattggctccctggtcatggggcgcagatctattcccttgggattcaagactctcttttgggtcaatagcagcaactggcttcttgacaaaaggctggagggggccccctctagattctcttctcagggcaggcatgggtctgttggagctgcggggctgtggtctcacctagaggggccaagagatggtccccatgaccatgagtctgtgttcttcaaatttgatggtggctccaattttattttctccccagtgttagtctggcttctttcagggaaaggcactgtgatggcaggaataatgctactgaccactctttgtgatgtctaggcactacaccaagcacatgttgtatacagttggtcctctgtatctgtgggttccgcatccttagattcaaccaattatggatggaaaatattcaggaaaaaaatccacaaattaccaagaagcaaaactttgagtattatgctgaatctgtgtaaatgaagtgatgtgtaggcatcctattagggattataagtaatctagagatgacttaaagtctacaggaggatgtgtggggcttctatgcaaatatttcaccctgttatatccgggtcttgaacatccaaggatttttttttttttgagacggagtctcgctctgttgcccaggctggagtgcagtggcgcgatctcggctcactgcaaactccgcctcccgggttcacgccattcttctgcctcagcctcctgagtagctgggactacaggcgcctgccaccacgcccggctattttttttttttttttttgtatttgtatttgtagtagagacggcgtttcaccgtgttatccaggatggtctcgatctcctgacctcgtgatccatccacctcggcctcccaaagtgctgggattacaggcatgagccaccgcgcccggccaacatccaaggattttggtgtccaaagggaggcctggaaccaatcccacacggatactgagggacaagtatatcatcccatttcatccctacagcagcaacttcatgaggcaggagttattagtcccattttacagaagaggaaactgagacttagggagatcaagtaatttgcccaggtcgcacaattagtgatagagccagggcttgaagcgacgtctgtcttaagccaatgacccctgcagattattagagcaactgttctccacaacagtgtaagcctcttgctagaagctcaggtccacaagggcagagatttttgtctgttttgctcattgctccttccccattgcttagagcagggtctgccacgaagcaggttctcaatgcatagttattaaatgtatataagagcaaacatatgttacagagaactttctgtatgcttgtcacttacatgaatcacctgtgagatgggtatgcttgttccccaatgttgcagatgaagaaactgaggtgcccagagtcactgatgcatggctcaagcgtgagagctggactctgaaacccaaaagcccatgcccagaaccactcccctctcttgccctcttcaagggctggcctggctccccatggtgcctgcacacgccaaccccttttcttttctctcttcttaattttaaatctattttgcaaatgtaacatctgaccattggtaaattgctaaaatttcaatgaatatagttaataacaatgcaccaatgtcaacttcttggtaatgttaacaatagtggaaatttaatgaggagtagaggggaattctttatgctctttgcaactcttcttaaattttttttttttttttattaaagatagtgtctcactctgtcacctaggctggagtgcagtggcaccatcatagatcactgaagccctcaaactcctggacccaagcgatcctcccacctcagcctcccaagtagctgggaccacagctgtgtgccaccacatctggctaatgtttacattttatttttgtagagatggggtcttgctctgttgcccaggctggtcttaaactcatggcttcaagtgatcctcttccctcagccttccaaagctccgggattacagacatgagccaccacatccagccacattttctagaaatataaaagtattaaaaaaaaaaagtatatttaaaaacccaaacaagagaaaaggacatattaggtgaaagttgattctcccccaacactgactccccctacctgagtccctcatgtccttccctaaatgcagcggctgtgacccaagtatattccaatgactgaaatgaatagcacccccacccccagcccttcatttaattgcctttgttatatgagctgggttgaaataatcgctcaaaatggctgattcctctttgagtaggacttaacccatggctgagaattgtccttctagcttgagttctcactgaagtttgaatgagaaccgtttgttgagggaccctgggaaccacatcttgccaagtcattttacatcctatccaacacaggtatgaggctgaccaaaacgtcgtttaagacctttccaacgcaaaggactggaattctattctacaacaggggatgggataggtacccccagtggtactttcatgcttgtaccatcaaacagcaatgaatttcccttcaggaaagctacgcattttctccccaattatcaacctttttgattacctaaaggagaaagccacaatttggtgctagctttgtctttaatgcccctagtacttgctgattcaccttgttaagaaagaaaattcaagcttcattctgaaccttaagcaggctatagtatttagcaagaatttaacagtattgctttgtttcctcaggtttattttcatggctattttctaattatgccaagtaagagtcatttattgtctgtggatgtcatgggacatttccgttagggagtttgagtaaaaaaagtcaatgtcggccaagcgcagtggctcacgcctgtaatcccagcactttgggaggccgaggtgggtgggtcatgaggtcaggagatcgagaccatcctggctaacatggtgaaacccgtctctactaaaagtacaaaaaattaggctggtgtggtggtgggcgcctgtagtcccagctacttgggaggctgaggcaggagaatggcgtgaattcaggaggcagagcttgcagtgagccaagatcacgccactgcactccagcctgggtgacagagcgagacgccgtttcaaaaaaaaaaaaaaaaaagtgaatgtcatgacatactgagtggtatatgacagagtacagaatatgtagctggggtaaattctatgcagtgttgagagttttggaaacactgttttgtagctcttttgaccttagagcatgggcattgggatcagatagatctgggtttgagtttcatttctaccactcattatagcactgccccaattgccccttagaactgatgtttacggtgttttgttttgtttgaataaacacaaaaatttaccttcctaatcttttgtttttcttttttcttttatttttgagacggagtcttgctctgtcacccaggctggagtgccgcggtgcgatctctgctcactacaagctccgcctcccaggttcacaccattctcctgcctcagcctcccaagtagctgggactacaggtgcccgccaccacgcccggctaattttttgtatttttagtagagacagggtttcaccgtgttagccaagatggtctctatctgaccttgtgatccacctgcctcagcctcccaaagtgctgggattacaggcgtgagccactgtgcccagccccctcctaatcttaaaattttagaaagttacattcattttacctgagttcctttctcaagaaactgacctctcggccttccagatagtattaaggaattgaaatttaccagatcactatatgtggacaatgagatgccagactcctcaaccatcacgattgcctaaccaaccacctgcatcctgttgaccagattctcttccttaccccttcctaataatttcccagaaaaaaaaaaaaagaatagggatgtatcacaatgtaacacatggttgcgtttcttccttgctacctctaattttagtgggttgaggagatggatttgagtctctttccatctcctcagctgcagcacccaattaaagccttctctggcaatactcattgcctcagtgattggctttctgtgcagcgagtagcaggatctagacagaacccttgatgttgctgcaacaattgagtgagtgagtttgaccaatcacttatgacctctctaagcctcattttattaatctagaaagagaggttgatatgagctagatcatggctccggtaaacacccaaaatgagcaagctctggggccagtactaggcacgtaaagttataaagcagaagtaaaggcagaggttgtgcagggcaccctgagcttaaattcctaccatgacccctgattggaaaagatgggctaggaaaggtatctctctggtccccagcagtttaaccctccaagcttgtatttaaactagaagtttttagatcaccagccctcatcctctatcacctccaccactcctgtccctgggtagccttactttttgttttgttttgagatcagtgattaaacctgctggtgcataccagggctgcccgggtgctcagctcttgtttgctggtgccaccgctcaggaagcatgcatctccctggggtggcatttggggatgggaagatggatttagctgcctcttcccccagaagtgactcagctcctggaagctcaatgacagcagtggcagttggagccctggggacgtctgtgccttcatgctttgctgtctccacacagcaagcaagctcttgcttggaagtgtgcgtgagagacttgttgtctctagccagcttgaaatgctcctcccgtttcttcccgtgatttgtcctcctcgtggagacattccttggcagctgtcggatgcctgccttctagttggaaaatgtgatcaagaaaggaacagtctagcaggctaatttctatcacacaagttcagactggaaagaagctgactgtgtgtgatattcatttattcaggtcctgtatcagcatttttcactctgatctgaagacctccttcattaaggtccctggacacaacaccccaacccaggtttatcctaatccttggaggtggaggcagggaattgtttcttaaacaacctccctagatattcaccttgcccactgatgtctgggaataactactccctctgtgtctaaagcaatacagtctactcagttttgttatgatgatgatggtacttacgtagggaggtagttcttacatgaatatggttgattacaacaagagctttggagtaagagagatcttgttttaaatctcacctccatcacttactccctttcctgagcctcgacttccccatctatgaaatgggataacagcactgaccacccagggctgttttgagaatcagataaggtaatgcacaggtgctggcatgtgataaatgctcgataaatgttagttattatcgttactgggtaaacctggctttcctaacttttaaactggagagattacagtataccacccagggaaggggttggccaactttttctataaagagccaggtagtgaatatttgaggcttcgtgggccagggagtctctgtggcaactactcagtttttgcaatgcaaaagcagccataaatgacatgtaaatgaatgagcgtgatcagtgtccagaacaactctacttacaacatcaagcatggggctgcgcttggtcccctggccatagggtatcaacccctggcctaaggtattgtgcagactaaatgagatgagattcattcctgtaatcccagcgctttgggaggctgagatgggcagatcacttgagctcaggagttgggagaccagcctgggcaacatggcaaaaccccatctctacaaatagtacaaaaaaagtcactgggtgtggtggagtgaacctgtaatttcagctactcgggaggctgaagtgagaggattgcttgagcccgggaggttgaggctgcagtgagccaagatcatgccactgcaatccagcctggaagacagagcgagaccctgccccaccaaaaaaaaaaaaaaaaaaaaaagatgaggtttacaatgagcccaacacagtgcctgatgcagagacagctcatggcaagaaaggattctaacgatttgtatctgattcaagctttaggcttcgttcctttctcttggggaagaaaaacatccttgagcaagacttttcaacataggtctttgttccattctttgccccaaatccaagctaagcacctggagcctggcaccaccgcctccatcctcccccggggatggaggtaaaatgccagttcctgggatgtgattaattctcttcgtcccacgcctcgccccagggtgtgttgccgttttcagcatctgtcccatggaaatcaggttgcccatctgaactgtgatgagaaaaacaaggatactcatatcgtggggtggttaactacgcactttcgcaggcacaaatgcattcagccctcaccaggaggctggattacgtggttaaggtcacgtggttgtggagtggaaggggggtggggggggagagagagagcacaagctgggtttgaatactatctctgcaatgatctggctgtgtgatgttgaacaagtcactttccttctctaagcctcagagtcatctcagtaaaatagagattaaatgagataatacacagaaagcctccagcacaggtaactattgaattcttgtacagaggaggaaagtgacgcaaagacataaagggactcattcgaggtcttgcggctgatgactagtgtcaaatgaggatttctgacactgcccccgcctagctgttttttgccagaccccacttcccccatgcacttccctcaccccctggtgactcccgctgggacccctgctgcttccagccaaggctgtgctctgtgtgcaggatctcaagcccctggagagagtgacattgttgtcaggaagcttgcaaggctgtggccattcattcttgtgggtttgtggcctcctgaagttcatgtgcatcttaaaacatcagaatgtgaccttatttggaaataaggtctttgcaggggtaattcagatcaggatccagatgagctcacattggattagggtgggccctaaatctaatgagacagaaaagaagacacacagagccacccggaggaagaacctgtgaaaacagaggcagaggttgaagtgatgctattacatccagtggcaaaaaccgtaattacttttgcaccaacctaatactacaaaccaaggagccagcaggggctgcaagggccaagaaaagatccatccctagagcctctggagagcgcgtgaccctgccaacaccttggtttccgacttctggcttcccgaactccaagagattaaattccttttgttttaagcctccccactggccatgaattgttatggcaccacgcttgactctgagataggaatgaatggggggtgtcggacttagaacagctgcctggaccagaggcagctgtgagggtcaaaaagcatgaatttgaagccagacctggactcagctctttcccttgccagcgctgagcctttgtttctttgcgaaaatgagaacctactgaacttgctggcttatggcgaggattaaaagaggtgatgggcagagcaggtgcggcggtcataacgagggcaattgcaagcatatattaaacgtgacgtgccggggtaattcatccctcacatctgttttgggtggtgggctcccttacagaggagaaacagagctgctgagaggttaaccaactccccaaggccacacagccagggaggggcagaactggaactcaaacccaggccatctgatctggtaaggctggtcttctagcttggtagcatcacagcacacagtagcactcagtattaattatctttttttttttagacgtagtctcactctgtccctcaggctgtagtgtagtggtatgatctcggctcactgcagcctctgcctcccaggttcatgtggttctcgtgcctcagtctcccaagcagctgggattacaggcacctgccagcatgccaggctaagttttgtatttttagtagagactggatttcaccgtgttggtcacactggtctcgaactcctgacctcaggtgatccgcccgcttcggcctctcaaagtgctgggattacaggcgtgagccaccgtgcccagccaatattaatatttcgatcctattcctccctccttccctcctttctcaagcctgtcctcactgcttcaatcccaggagccaccacagcatggtgtcagggacagtagtaggacccgaaattggattccaggggccttgaagcataaccagatggccccaggagatctttaggcagcacatcacatgagacatttcctacaaatcctctgcaaacagacatcgctccctctccccaagccacagcctgaggtggctcctctgacctctctccttcctgcttctctttgacactccctcctctccctccactgtgtctcccttttcacccttccctggcagaggctcggccaggtggccagataatcttcgggacccgccatctttagaaggcaaggaggaggtgattgtgaatctctccaatttcatgtttttcccattcacccacctccactctcttcctcccacttatacagttgttcagtgaccccctctccaacccaatagcagattctgcactatttatgttctgcacttatctatttcatgaagtattgttgctccctgaaaatataaaagaagcacacattgctctgagatgctgaactcaaagaggagaaaatcttcaataggctgatgactgacaggtcaaatattttcctctccccatataattgcttggccttttccattgcctttgttactgtttctcttgaaaactgggagttgtcaggccaggcacggtggctcgcgcctgtaatcccagcactttgggaagccaaggctggcagattacctgaggtcaggagttcaaaaccagcctggccaaaatggcgaaaccctgtctctactaaaaatacaaaaaattagccaggcgtggtgacatgcgcctgtagatccacatacttgggaggctgaggcaggagaattgctggagcctgggaggcagaggttgcaatgagcagagattgcatcaccacgctccagcctgggcaacagagcaagacttgctctcaaaaaaaaaaaaaaaaaaaaaaaaaagggggaattgtctcagagagaatgaagagaggccattcatttcaatgtgagaatcaactccagagaattaccttctttctgtctctttagcaaaataaggtgttttgattggtggaggggaagcagataattttggcacatggaacggacacatcacggggtaggtaatggaaaggaactccaatttactgagaatccaacgtctgctgaacaactcagggccgggagagtcccacaggtggacaaatgcatcaggtggactcctagaagagggcgctgttctatctagagatccaagcaggtagggactgacttcagggaagcctgcaaatcacagcgccctaaaccctgtgcacgtgtgcaagggccagggccccaggacatagaaggcagttggacaggtagaaacaggacaactttctctgggcacagtgactcacacctgtaagtaatcccagcattttgggaggctgaggcaggaggattgcttgaggccagaagttccagaccagtctgggccacatagcgagacctcatctctacaaaaagaaaaaagaagacctggtgtggtggctcacacctgtaatcccagcattatgggaggccaaggcaggctgatcacttgaggtcaggagttcaagaccagcctggccaacatggtgaaaccccaactctactaaaaatacaaaaattagctgggcatggtggcacgagcctgtaacccaagctactcaggaggctgaggcaggagaactgcttgaatccgggaggcggaggttgcagtgagccgatattgtgccactgcactccagcctgggcaacagagggatactccgtctcaaaaaaaaaaaagagaaaaaggaaaaagagaacaactttccaaatcatgggtataaggtataccaactttcattattccttgagtataaggaaaaagacagacgcccttgtagaactgaggtgtggggtgggctccatcttgggggcgggtgtggaaggaattagcagatacagatgatgtgatggtgtctcagggtacgccaaaaacatctcctgccccgagtctcccccactaccgatcaaaggccttgaatagcacatcacttatatctcagccattcaccctagaaacatagcccgaaggaaccctgtagatgtgtgcgaagttttcactttgagaacgttcttcactggaacattcttacggtgaaaataattcttacatttttttcctcatgattacagtggggaaaaaataggaaacaacctacatgtctgtggattgcttaagtgcttcgtgatacagccacaaatagaaaaccgccccgccttccatgctgctgccgaggaagaccatccaaggacaggcaggagcgctcaaggcatgttgctaggtgaaaagaacacataacgaaatagtgaggtcctaactttatattagaaaaataagacctacatcacagtggatatatgtatatgcatataatagtataaatatacattcacacgcatatatattaacattttaactgctaacattttagtggactttttcagtctttataaagtgtgtctgcccaggcgcggtggctcatgcctataatcctagcactttgggaggctgaggcgggtgggtcatgaggtcaggagttcaagatcagcctggccaacatggtgaaaccccatctcaacgaaaaatacaaaaattagccgggtgtcgtggcataaacttgttatcccagctacttgggagactgacgcaggagaatcactcgaacccgggaggtgaaggttgcattgagccaagatcgtgccactgcactccagcctgggcaacagggcgagactccgtctcaaaaaagaaaaaaaagtgtgtctgtgtatattacacatattatatatataaaaaaccacatatattcatatatgtatatacacacacatatttatatatccgtatgtatgctcacgcttgtaatcccagcacttcaggaggccaagttgggaggatcgcctgaggccaggagtttgagaccaaccttggcaacatagtgacacccccatctctacaaaaaaataaaaattaaaaagttacctaggtgggcctgtagttccagctacttgggagactgaggcggaagggtcccttgagcccagggttcgaggcggcagtgagctatgattgcaccactgcaccccagcttggatgacagagtgaggcctagtctccaaaacaaatgaaaaaatacttaacactacttggtagtagtattactataagataattatgataaaactttcttctgcctagagtcggctggtcttagaggcttagaccacagggcaaagtggtcgtggtcagggggagcagaggcttagaatctgggaccaggcaggagctgacaaggccttaatcaggcttttgtgagcccacttgtgagcctccactagccatcataacaaagttcccagccaggcgtggtggcctcacgactgtaatcccagcactttgggaggttgaggcgggcggatcacttgacgtcagcctggccaacatggtgaaaccccatcactactaaaaatacaaaaattagccgggcctggtggtgtgcacttgtaatcccagctacttataaggctgaggtgggagaatcgcctgaacctcagaggcagaggttgcagtgagctgagattgagatcacaccactgcattgcagcctgggcaacagagcaggactgtgtctcaaaaaacaaaaacaaggccgggtgcagtggctcacgcctgtaatcccagcactttgggaggccgaggcgggtagatcacaaggtcaggagatcgagaccatcctggctaacatggtaaaccccgtctctactaaaaaatatacaacaaattagccaggcgaggtgtcgggcacctgtagtcccagctactcgggaggctgaggcaggagaatggcgtgaacctgggagatggagcttgcagtgagccgagatcgcttcaccgcactccagcctgggcgacagagccagactccgtctaaaaacaaaacaaaacaaagcaaacgaagtaaattactttggaaaacacattttctggttcccaaagggtgtgctcacgaatacacatttgtggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgtgagtgttttggggatgtggccaaggaaagaagtgtgtggaggagagaggaaaacctaatatttgttgatcgtctactgtgtgccaggcactgagataaaggcattatgcacgtttttaaaagcctcatttgattctcaccaccacccagggaagtggatattgtcatctcctgttttaagcaagaccctgaagttggaattgaattcaggccaatctgactccaaaacctttgttctttctgtatcacccacggggaagaaagagggaagggaatgcagaggctgtaccctgtgctggtgtctttcacgagcgcacactctgctctcagataggcctgagttttttttaagcctgtcagcttgggcaggttacttggactctctgaatttcagttccctcatttctaaaatggggaaaaataacaagatggggtctctagcaacatcagagtcacatgggttgaacgttcattatctacagagcacagcattcctgaagagttgcaggtagtctttcaagacaaactctcatttaaaaagttgggctctgagtgtgtggtggtgcacacctgtggtcccagctactcaggaggctgaggtgggaggactgcttgagtcctggagttcaaggctgcagtgagctatgatcgcatcaccacactccatcttgggtgacagagagaggcactgtctctaaaaagcacaaattaaggccaggtgcagtggctcacacctgtaatcacagcactttgggaggctgaggcgggatgatcgcttgagcccaggagttcaagaccagacagggcaatgtagccagaccctgtctctacaaaaaataaaattagctgtgtgtggctgtgtgtgcctttgtcccagctactcaggaggatgaggtggggggatcggtttagcccaggggttcaagactgcagtgaactatgatcataccattgcactccaacctgggagacacagtgagagcctgtcgctaaaagaaaaaaattaaaaatacaaaaaatataaaaacatcaaattaaaatgaaaaagtttttttaaaaattgggcttttgccgacaaacagtgaaaggttacaagcaaaaccaaaccaaaccagaggttaagaggcaacctggctggaaaattccctgcgctgcctgtcagctcacccacccacccaccctccactggaagcagcaggaacatcaaatcttttaggcaggctaggcccctcccctattctttcactgatttttcacaacaccaagaggctgagtctgtgatcatcccattttgcagatgaggagactgaggcttgaagaaatgaaacagcctgcccaaggcctcccagctagtaaatggggagttagggttcagactcagctctttctgcttttaaaacacctcttctttataaatttttagttacttatttagataaagggtcttgctctgtcgtccagggtggaatgcagtgaggccgtcatagctcactgcagcctcgaactcctgaaagcccatactctcactgggacgttatatgaccttccctctcgccacataaaatgaactgcagtattcacagctgtcatttatccagccctttgcatgtgcaagaccgtgagctaaatgcttcccatgcataattccttttcacagacatctctgaggaaggttctagaacatttccacttcatggctaagaaatatcttcccttttgtctggaaataagctaaaatgatacgtgagcattcagaaacaatcctttcctccctgtgttttaaaaggaagacagagaggccaggtgtggtggctcacatctataatcctagcactttgagaggcggaggtaggtagatcacttgaggccaggagtttgagaccagcctggccaacagggcaaaaacccgtctctagtaaaaatacaaaaaatttagccacgtgtggtggcgtgcgcctataatcccagctacttgggaggctgaggcacaagaatcatttgaacctgggaggcggaggctacagcgagctgagattataccatttcactccagtctgggcaacagagagaaactatcccaaaataataataaaataaaaggaagacagagaacatgagtcttgcttttaagtaatcaagatcaagatccctttgtttaaaaaaaaaactacaaaaatacaaaaaatttaaaaatacaaatacaaattaaaaattttaaaaatatatatttatttttatttacctaatggtgctgctgcaggaacaatggttaccactgtgcacttactgacctttactgtgtgcgcgtgtgtgtggatatttgtgtggatgtgtgtggatgtgtgtggatgtggatgtgtggatgtgtgtgggggtgttcgtatgtgggtgtctggatgtgtgtgtatatgtgtattgtggatgtgtgtgtgtggatgtgtgtgggtgtgtggatgtgtgtgtgtggatctgtgtgtgtgtatgtgtgtgtgaggatgtgtgtgtgcatgtgtgggtgtgtgtgtggatgtgggtgtgtatgtgtgcgtgtggatgtgtgtgcatgtgtggatgtgtgtgtgggtgtggatgtgtgcgtgtgtggatgtgggtatggatgtatggatatgtgtgtgtgtatggatgtgcacatgcctgtcacttagcccaggcttaaggacaagaataactagcatttcttaagaggcagctctgcagtaagctcttgacttgtgatctcattgaatgtcctcatctagcccatgaatctgaccacttagggacaaatgtcaacagtagaccctaggataaatcaaattatctaaaggatacagaaggacctgagtgttgttaggacatagatcagggattctgtgacattttccaggggagggacccccttccaggcccccagatgtcttgctggaatggagtcctacagacagtattggatggtgatgacgctccccaaccaggctcagccttgtatggtgtgtagcttgcccagtggtgcacctgcctcatcaatctcagagatagacggtggacactaaggcaaccaggacaaaggacacagtatgctcagatctgcacaaagtcctcatccatcatcctcagccctccaggccaacaggctttgagccaaggccctgcttgaattcactttcttggctgttcctcagagatggtttttcccgaagctgtggggcttatcctgtgagtgtgtcctgttcttatctccattttggatgggaagtaatgggaggttacaaaatttgcctgatgctgcattagctaataagtagccaagctaggatgcagtctgactccagaatgtttattaagtgaatcagggaaggagggaagggagtgggagagaagggagggggagagggaggggagaggcggacaggggaagggagggaagggaggaaagaaaaggaggaaggaaggaagctttgagtataaactaccaagataattccttcaagtttataaactccatgagggcagagaccttatccaatttcctcacaacgtcttcccagcatttggaacaatgcctggcactgagtgtcatgaatatttgtcaaatgtgcaataaattattctttctcactccatccttaccccaacaatcctcttacacacacacacacacacacacacacacacacacgtgagacactcttggcacagagtaggagagaaaaaaatttcagaccctactgatcattttcaggctcaggcgaggaagctttaagtgacaggaatgtgacagccctgggctgaaagactcccggtggccgtagtgtaatagccgcggtgagatttgttttgtcacacctgctgcgaagtaatcaccttaatgcccatcagctgctgcagagaccatgtgagtcagcccctatttcatggttgagaatgtgtctcacttccaatgcttctcgcagcattaactcttttatttttatttcttgtgacagagtctcgctctgtcgcccaggctggagtgcagtggtgcgatctcggctcactgcaacctccgtctcctgggttcaagcgattcttgtgcctcggccttccaagtagctgagactacaggtgcccaccaccatgcccagctaatttttgtatttttagtagagacaaggtttcaccatgttggccaggctggtcttgaactcctggcctcaagtgatctgccctccttggcctccttgggattacaggtgtgagccactgcacccagcctgcattgactcttttaagcatgagtccgggggggactgcctgccccagccccaaagctctggcaccctcacatttagattatttcatgggcttcctttttctcagctgatttaacttgtcctttcccccaagatccacagcccctgcctgttcttcctcttttcctgccacgacagtgaggaagaagaggagggagatttccctactcccagggaatggtgagaactcgggagatgtgggatcagaggtcatcatcctggctctctgacgtccttggtctgtgaccttggacacatgagggagcacacagagttgctgtttcccgcgggcactgatatgccaccctgagtgctacgtcccctgcatgcattcaccccttaattttagcttcttgagtcctcgcaagaaccccaatagagtaagttctatctcttttattttatgaatgaggaaattgaggtcggagaggcaaagtgacttgttcgaggtcaccagctaggataaagtagtaccaggatttgaacccaaggtgtctgtctcgtgggggcagagcccttaaccttaagctgttctgttatctttattctcaatgccaggaccccttttctctttgccttactcttttacaacgcaaggacaaacccccgattagatgcccccagtcccacacttggtcttgtcttgttctgcaatgttgaattgtgtgtggtggaacttggacagattttactaagtcaggctttggacttttctgtaccattgaaactgacccaatagtcccatcatagatgttctttttttttttttttttttttgagacaagagtctcgatctgccacccaggctggagtgcagtggggcacgatctggactcactacaagctccacctcccgggttcacgccattctcctgcctcagcctcccgagtagctgggactacaggcgcccgccaccacgcctggctaacttttttttgtattttttagtagagacggggtttcaccgtgttagccaggatggtctcgatctcctgacctcgtgatcctcccgccttggcctcccaaagtgctgggattacaggcatgagccactgcacccggcccatagatactcttttggataaatacagaagttgacctttctgatcttaaagcttgaagccctcatttgtcttatctgagttatttcctcaggaagggacccccaggcctctcaaaaaatatcaaagaactgaaactcaccagattaccacatccagagatgagataccagacccctcattcatcatgattgcttccttgctcctcccgagttcctgttttcttcatgattgcttccttgctcctcccgagttcctgttttcttatacattgttacatttcttccctgctatgtaaactcctagttttagttggtcagggagatggatttgagactgagctcccatctccttggctgcagcacgcaattaaaatcttccttggcaatactcatcttgtcagtgatgggctttctatgcggcgagcagcaggacctagaccaaacccctggtgtttcagtatcaccatttctctgcacataaactgtttatttcagagaccaaaatgatgagctccaatgcagacagtcaaagtttgtgaagtcagtctgctgggaatgtgctgtagaaaaagaacccggttcccgtaataactcttaaggcccacaacagttggcatttacagaccccttattgtggacctaggcttgtgctaagccctttacacacatgctcacataacccacatcaaatgcttactaacagaaagatgcatcaggaaccaccccaacccaggacacccacttgccctgaatcaggcccaggaggtcaagttcacagaccagccataagtgagctcccagcaggcaggtgtgaactctgagtgtgctcctcactctgaatttccagtgtgtgttcccttgctgacttccctttgcttgacccctggtttccaatgtgcaaaatggcatttagagatctctttcttgaggcttggcaattttatcaactttactggaacagggcagtaacacaaaactgcctccggaaaacaggcagcaaacatctggcagataatgcttgaaacgcctgtgttttctcacttcttgaccctatgttccacccacctcctagtacctcccactgctaccccatctccctacccatcctgcccccatcttactgcaggcaagaactctcagaggctgtcaacaacctcagactcattttctcgccttccttccagcactgaatcacatcattagtttttaataattcttcttgcagcccctctggctcgcttcagcttttccacatctagtctaccaacccgctcctgctgtttatctgggtttcagataattaagtatctttggcctccacatggggcaggggtgtggttatcttccttttacacccgcttgctggattttcataaaaagggatagcatgccctgccactcagcttgctctgggcaaaagcaggttttaatcagccagagacagaactgcagcaggcagggaaggtaggcgtgcgaaggacatatttcaagagcacagcctttgagttccaatatttccagagcctgggcttgaaatccagtaacttcgttttattaagaggtaccaagtgtggtaaagaggacaggccctgggaacctggcagagattcaaaatggggtaatagtgcatgcattgtgttgaaaaccacacacacacacacacacacacggaaagtgtgtgcattgtagatagcagttcttttaaaacattttctatgctggctagttttctagtgttttattgttttgattcatataatcctcactatcaccatccaggcagaaaatatcacatagcctttattttatagatgaggaaactgaggcactgagaggtcaagtctcttgcccatggttgtacagtttccatgaaatagcattctaagtccagatgaaatgggaaaagttcccttgtccccctcgcagggtgtgtgatgtcggagtggctcgcttcttcagtgccccgctgctcaaacctctaggggaccatagagatgggccagttgtcgggatctgatcccacggcagtgtctaggggtggatgtttacaactcctgaagcttcagtgtgtgtgtgttacatggtgctcttttagttttgctatctataggcggcttgtgttaactagctcaattagaccctctacgttgtcccaaggacagagggctttctgtatcctgggttcttgccttggtgcaccagaagaatcggatcacacctggacttggagaatgagagcaaggttttattgagtggaggtagctctcagcagatgggggaagccagaaggggatggagtgggaaggtttccccctggagtcaggccgcccagcagcctgggcactcctccgactgcccaggccaaactccactttgttccgccagtagatggcctgccagcatctgtcatgtgctcttctgccagcgtgttcctcttgacgtcttcttgacatccagacgcttgtgtcttctttgccgatctgcagctcttgacgtccagcagcttgtgtgtcacctgctagggtcttggggtttttatagatacaggatgggggcatggcaggccagggtggtcttgggaaatgcaacatttgggcaggaaaacaaaaatgcctgtcctcacctaggactgtgggcacaggcgtgggggtggagcccttaccagggaccacaccctcctctacccagcacttcccttccttccttctgtagcatttaaagcgaccatgcccttcccttcctatcacctctcttgcatatcacagagtccatggtctcagtcatcaagctgtggggtctctcaactagctttgaattctacttcttaccaactgtgtggcctggagcaaatactttgtcctgtttcagcctcggcttccccatcagtacaagggggacagtgatatctccctgcagcatcatagcaagggatgaaaacagacacaggtatgaaattgggtggcccttcctaggtagtaagcaattcaaaattcccttctttcctttcattgttaacattgtgcttcgtgggagagtagggcatcagggctgcttatggttgtctccagagaattcccagaaaatattcctctccccaagagaagatgggattcactgtggtttccttgagatcctcttgggaggtgccaactctcttgagagtggctctcaaccattaagtgcaactctaccctggggccttgattttattatgatgattatttaagatttttttataaacctgcattttttcccctttaatgagctgataattctgaagtctgttaggaagagcttcaagccaagggcaaaatgaagcatgtgcgtttatgtaacttgacacatttcagccacattcaggagctctgcgtcactttagttgcacacagggttttaaatagcatcttccaggaacaggtcaccattgccggggccactgtacatatcggatgggaagagatgcccttaattgcagaagatctaagaagcagtttgtcttggacaaaatatacaagaagttggggtgtaggggagggaaaggaaggaagaagaaacggagagactaaagggaggagagaggagggagaatttctaagctagacttctgaatggaaggaccctcctcctgaatttctaaatgtactgggaggtggggaggaaggtgggaatctgtgttgattgaatggagaaatacatgttagtctgggcgcagtggctcatacctgtaatcccagcactttgggaggctgaggcaggtggatcacctgaaatcaggagttccagaccagcctggccaacatggcaaaaccccatctctactaaaaatacaaaaaaattagctaggcatggtggtgtgcacctgaaatcccagctactcgagaggcttgaggcacaagagttgctttaacctgggaggcagaggtttccatgagccaagattgtgccactgcattccagcctgggtgacagaatgagactctgtgtcaaagaaaataaataaatcaaataaatgttctgtacttgacaagctcttgctgctacgagttgcctttcatggtcagaacaagtttcgagaaggaaaatactctctagaagttccgtcttcctagaactgtattacattctgctcagaggaccacctctgaaccacctagactccattgggttgggagggagattaccatgtaagaccctggtgattatcaattttatgcatcaacttgagtgggccacagggttcccagatgtttggccaaagattcttcgatgtatgtgtctgcaagagcattggtggatgaaattaacatttgaattggtaaactgagtaaagcagactgccctccctaatgtagaggtgggtgggccccgtccaatcagttgaaggcctgactacaacagaaagggtgagtaggagggaactcctgctgcctgattgcttgggctgggacatgggtcttttccggcctttgaacgcaaactgaaacatcagctcttcttgggtcttgagcctgccagcctttggactggaacttaacaccgtcagctctcctgggtctccagctgccacctatagatcttgggacttcttggcctccaaaatcccatgagccaattccttatcataaatctttttccaggccaggtgcagtggttcacgcctgtaattccagcactttgggaggccaaggtgggcagatcatttgaggtcaggagttttgagaccagcctggccaatgtggtgaatccctgcctctactaaaaatacaaaaattagccggctgtggtggcgtgtgctttcagtcccagctactcggaaagtcgaggcaggagaatcgcttgaacttgggaggtggaggttgcagtgagccaagattatgccagtgcactccagcctgggcaacagagtgagatcccatctcagaaaaaaaaaaaagaaaaaagaaaagaataaagaaaaaacaaataaaataaatctcttcagtagtattggttctgtttctctggagaaccctgactgatagagccctttttattctcagaaattttcatttggatagtttatcaggttagcaaagacctagcaagttggataaaatgaaaatatagggaaattggccttatctctttggaaaacagttcattgttacctagtaaagatgaacaggtgattataacctgcagttttgctcctgggtctacccctggttagccagtagcttcatgtggctatttcagtttaaattaattaaaattaaatagcatgtaaaattcagtctctcggtagcctgagccatatttcaagcactcattagtaaataatggctagtggctaccctattggaaagcatacatttgtataggacatttctattgttgtagaacattctattcaccagcactgccctagagaaactacacatgagcatcaggaggcatgttccagaatgttcataactgcctcgtttgtggtctagctgtaccacagaatactatacagcagtgaaaaatgaatgagcaacaggtatgaacatgaaagcatctcaaaaacaagatgttgagcaacaggtttatataaagtgtataaaagtaaaaaatataggccgggcgtggtggctcacgcctctaatcccagcactttgggaggctgaggtgggtggatcacaagttcaggagattgagaccatcctggctaacacggcgaaaccccgtttctactaaaaatacaaaaattagctgggtgtggtggtgtatgcctgtagtcccagctagtcgggaggctgaggcaggagaatcgcttgaacccaggaggtggaggttgcagtgagctgagatcccgccactgcactccagcctgggcaacagagcgagactgcatctcaaaaaaaaaaaaaaaaaaaaactaaaaaatataattgttccgggcttcatatatgggtggtaaatgataaaaataaaaagcattaccacaagtttgtgatagtgcctacctctgagggaatgagaaaaatatgagggaatggggcacacggggccgtctaaaagtcacacacagatttttacttaagtaggatgttgggaaaataactgctttattattccataaaaataatataataataattctatgaagtatgaaataatagtaaataataataaaatataataaatcatattttattatattttattattattatagtatattttatataaattttactataaaaataaaacattttatgcacacttatatgtagtttgcacacacacttctattttttaaattgtggcaaaatatatataatatttactatctgaaaccatttctaagagtacagttctatgtcattaagaacattcatactgtgtgtaaccatcaccatccctccccagaatttttttcatcttcccaaactgaaactctgtaccattcaacactcactccccattttccctttcccctggctcctggtaaccagcattctgctttctgtctctgattttgatgactctacatacttcataaaacaggaatcaggccaggcgctgtggctcacgcctgtaatcccagcactttgggaggccaaggtgggtggatcgcctgagctcaggagttcgagaccaccctgggcaacatggtgaaactctgtctctactaaaataccaaaaattagccaggcgtggtggcgcacacctgtagtcccagctactcaggaggctgagggatgaaaatcacttgatacctggaggcagaggttgcagtgagctgaggttgtgccactgcactctagctcaggctacagagtgagaatccgtctcaaaaaataaaataaaaaaaaaagaagtggaatcacacggtatttttctttttggacacacatttctaaggggaaaatgctgagaaagacaggcaggggaaggtacagtatctgatatctccacttaaatgtctcaaagatacctgtaactcaatctgtccaagtcaaactcatgatccccccatctagtcccaatacccaccagccctagctcagcaaatggtcaagcatcaccatctatccatggaaatctcaaattccaaaattagacatcattcttgacccctcccaaccctccacctcatatattcagttcatcatcaactggtgtttgttttacctcctaaaataatgctcagctgtccatctttctccatctccatggccaccacccaggttcacatgcccatctctgtcctgcagccagagggattttctcaccatgtgaatctgattataactctcagatttaaacactgtcttagtccgttcctgttgctgtaacaaaattccttagactgggtaatttataaatagaaatttaattctcacagttctggagtctggctgggaagtccaagatgaagatgccagcagattccatacttagaagggctcattctctgcttccaagatggcgccttgcttctgtgatctccagagaggaagggcaccgtcttctcacaagcagaatggacagaagggcaaaaaggactgaacttgctctctcgagcacttttgttagtgcactgatcccacctcctaatggccctcaccccttaatactattgcattggaaattaagtttcaacatgaattttgaagagtcataaacatttacaccatagcaaacaccttccagaatttgttagcatgataaagcccatgagatcttgctggatctgctcacacctcttctccaacttcttttcttcatccattcctcacccccagctccctcccttacacacacacaccactcccttgggcctccttttagtctccacctccccaccccccgatacacacaccaggtcccctcctgccgtgggggcctttttgtttgtgatgttccctctgcctggatccctctcctcccacccccctctccttccctggtgctatgatctgaatgtttgtatcacccctaaatacatatgtcgacatctaattcccaatgtaataatatcaagaggtggggctttcaggaggtgattaggtcatgagggcagatcctcatggatgggattcgtgcccatgtaaaagaggcccagggtagcttgtttctccctttcactgtgtgaggacacagtgagaactcactatctatgaggaagaggtcctcaccagacactgaatctgctgacaccttgatcttggactttccagcctcttttaccatgaaaaataagtgtttgtttgtttgtttgtttgtttgtttgacggagtctagctctgtcgcccaggctggagtgcagtggtgcgatcttggctcactgcaagctctgcctcccaggttcacgccattctcctgcctcagcctcccgagtagctgggactacaggcgcccaccaccacgcccggctaacttttttgtatttattggtagagacagggtttcaccgtgttagccaggatggtcttgatctcctgacctcgtgatccgcctgcctcggcctcccaacgtgctgggattacaggcgtgagccaccgcgcccggcggtgtttgttgtttataagccacctaggctaagaaagggagaatggcagcccaaatggactaaggcacctgataaactctgtcccctcgaggactgagatctagggcatttctggagggacaccttcccagcacttccccagtccctgtcccattaccatccctgcaatcctttccttagaagccttttgtaaatttgtgttcattggtgtgagtgtatgttcaatatctgactctcctcctagatgctgacctccatgaggacagaggctgagctattttcactcccaaaaatgttgacggtacccagcacacagccaaactcagcgtaggcactctgagtgaagattgattgaatgaattaatgagggctcatcttcctgcttctcccacggtcacataatctcaagggttcccttccatgtggcaggtctgggtggtgagaactgcctggctctctgatggttagggtgaacagtgggtccattcataggaaggaacagagtgataatgcagctaagtgcgttattttcctgtggctactgtaacaaacagctgcaaatgtgttaaaacaacacacatttcttttatcttacagttctggaggctggaagtctgaaatcgatttcactgagctgaaatcaggtgttggcagagccgtgctttctggaggctctagaggagaagcctcttcctcattcattccagcttctagaaccgtactctttgcatttcttggcttgtgtttccctcctccatctccgaagccagcagcatggcatagtccagtccctctcgattgaggtcatcctgtcgcctttgctcttctgtgtcaaatccctctgtttttctcttaaatgtatgcctagcattccattattggaacactaagcatgtgggagttatttatatgctacttctcaaggctatcaccaggtctgatttctcaaattcaaaaaattgcaacctcaggcataaatgggtaggggcacttgtgatgacattgagggcccacctggataacccaggatgatctccccatctcaggaccccttaatttaatcacatctgcaaatttcctttttaaaaatatatatttttcagagacgaagtcttgctctgttgtccaggctggagtgcagtgacacggtcatagctcattgcttcctttaattcctgggctcaaacaatcttactgcctcagcctcccaagaagctgggaccacaggcacgtgccaccacacatagctaatttttgaattttgtagagatggtgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgtaagtttcctgaggccttccaagctatgtggaactgtgagtcaattaaacctcttttcttctttctttttttttttttttttttttgagacggagtctcgcactgtcactgggctggattgcagtggctcaatcttggctcactacaaccaccacctcccgggttcaagcaattattcgcctcagcctcccaagtaactgggattacaggcacccgctgccatgcccagctaatttttttttgtatttttagtagagacggggtttcactgtgttggccaggctggtctcaaactcctgacctcgtgatccgcccacctcagcctcccaaagtgttgggattacaggtgtgagccatcacgcccagccttaaacctcttttctttacaagttactccttctcgggtatttcttcatagcagcatgagaatggactaatacagttgggatctcatcaccttgcccaggctggtcttgaactcctaggttcaagtgatcctcccgcctaggcctcctaaagtcctaggattagaagcatgagccaccatgcctggcccaaaatcccttttgccgtgtaaggtaacagattcataggttcattaggacatggatatcttcagggaccattcttcagtctaccatattgagtgaccacagcaattcatataagggccaagcccagagcaggagccacagtgtggcagcaacaatgacagagacggccctggtgaggctggggaaaggggaagatgacacactacatggggcaccctcatagcttcatcctgtgccgggttctcatcatttttttgaaatctcccaaaaaagaagcttcttagaaagacagggcaatagataccagtaaattgcatgtaccgtggcctggcgattaagggtttttccattccctttgcttatttctggaaagctgctgatgtgagtggcagcagagattgagaagggcttgtccctatcacgtgatggtctgaattgaataggataatgcttggctgagcctccttcccacattttccttcaaataaaataccaaccctttcttgacagttctaggacaggatgcccaaagagaaatgggagggaataaaactgcaagtgacttagcagagctgccttggtgttttgggtctacacaaccagattcccgagcacccccttaaggcaatatcctgacttacatatttcatgttatgtaattggctgctattcattgagccatcagttacttagatcttgttgtctcctggaattccagtctactgtgtctgtcctcagtcccctaaactcctcggggatctcaagttatattagatcaatccaagacattcctggttgggttctgccaaacgtggtaggatccctgttttgtttttttgttttttttgtttttttttgagacaaagtctcactctgtcacctgggctggaatgcagtggcttgatcttggctcactgcaacctctgcctcctgggttcaagcgattctcctgcctcagcctccctagtagctgggattacaggcacccgccactgctcccagctaatttgtatttttagtagagaccgggtttcaccatattggccgggctggtcttgaactcctgacctcgtgattcgcctgcctcggcctcccaaagtgctgggattacaggcttgagccactatgcccggccttttttttttctttttctttttttttttttttttttgagacggagtctcgctctgtcgcccaggctggagtgcagtggcacgatctcggctcactgcaagctctgcctcccaggttcacgccattcgcctgcctcagcctcccaagtagctgggactataggcacctgccaccatgcccggctaattttttgtattttcagtagagacagggtttcactgtgttagccaggatggtctcaatctcctgacctcgtgatctgcccgcctcggcctcccaaagtgttgggattacaggcgtgagccaccgcgcctggccagatccctgttttttcattactagatatcctggtcttggatggggttgctttctgataaatagacctcgtgcctggtaagtgtgtttacttgctccggattaaattacacctagatttacattctacctctgccatttataggctgtgcaatcttgcacaaatatcttaccttctctgagcctcggtggcctcatctgttaaatagccatgcatccagtatctcgcagggtggtcatgaggagtaaaagagatcaagcatattaagtgctcagtccagtgcctgctaccacgtaagtgctcattaaatgttactttcctttaccaccaggaagaaattgagtttggaaatggatagatacaggcataagtgtagacactggtttctttgtttggaagaggagacacaagagaagggggagattagagggtggaatgatgatcttttccatgtcaaggttgttgaaacgacgagagaagtctcaaggggcacctaagatttgtctcaaaatatctgaaggatattacgtggaagaggaagttcgtttctttctttttttttttttttcctgagatagagtctattgtgttgcccaggctggagtgcagtggttcaatcttggttcactgcaacctctgcctcccaggttcaaacaatcctcctgcgtcagccttctgagtagctgggaccaagtagcagcctcaggtgtaggggggcttgagcctctcctcactcctctctgattggtccaaatttgctcagtctgggccaatcagagtctttctcctgggatgcagagagattagcccaggtggatgatgagggagtggcaaaccgaagtctatgcataagcagagaaagccagtctttgaagggaaagaggacagagcgtctgcctcaagaataacaagagagacagtgtcctttgaaagcagagaaggaactcagccatgacattcccattgcagtccagatgaactgggtagtccataagatgttgcaccttgttcaaccctgcgcatcctttctccagacccttggagaaatacctcccaccccgtgttgccaccgcctagggaaatccaaaatccagctgtacaatgtctgtacatttccaggggcttccatcctcaagtcttctctgctcctaggcttggttccttgagtcctgtacctccatccaactgaatatgaaactcagatgcttcactggtttccataacaacagaataaaacaatgccctatcctactcccacaggtcatttgaggagcaatacaatgaggatcacaaaaagggtgtcattgatctcttcacagcagacagcttaaaaaccatgaccagtgacaatcgtctcctggctcaccatgtaactgtccctccagccccagaggactagccccagccacagccctgcaaagaccttgattttttttttaattgcaaaaaaaaaaaaaaaaaaaaaaaaaaaaagaaaaggccaggcgcggtggctcacgtctgtaatcctagcactttgggaggccaaggcgaaaccctgtctctactaagaaatacagaaattagctgggtgtggaggtacatgcctgtaatcccagctattagggaggctgaggctggagaatcccttgaacccgggaggaagacgttgcagtgagccgagattgtgccactacactccagcctgggcaagagagtgagactctgtcttaaaaaaaaagtcaatgttccagtaaagggcatcgtggtatccatatggccataactaggagaactagaaatccacatttgacattcctggttaacaagatctttttcaccaccctgtgccataaggcagtggggtggtttcctttttcttggccttttccacacacggggtccagtttcatcacctctttttctcttctcctttatctcagctccctccattccaaggaagacacttacttctcctgtcttatccacagcagctttgccctcttctaagaagccacggcaccaatttatgctgagctcttgcaagtaccaccccaggtgtttgtcaagccataattccaagcaaaaaccattatctccccaagatacatatgggtaccatctgtcaagatgctagcatttcccttcattttcttacacctttactaaactatatttttctcaagtgagcttgagtggatttctgttccttctagtctgtgctgcaatattctattaaaaatttaggctgaatgcagtggctcacacctgtaatccctgcactttgagaggcttaggtgggaggatcgcttgagcctagaagttcaagaccagcttgggcaacatagcaagaccccatctctacaaaaaaactaaataattagctgggcatagtggtgcatgcctgtagcttcagctattctagaggctgaggtgggaggattgcttgagcccaggagtctaaggctggagtgagctatgcttgtgccactgcactccagtctgggcaacagagtgagactctgtctcaaaaagaagaaagagggccaggtgcggtggctcacgcctgtaatcccagcactttgagaggccaaggtgggtggatcatgaggtcaagagatggagaccatcctggccaacatggtgaaaccccatctctactaaaaatacaaaaaaaaattaggtgactacagtggtgtgtccctgtagacccagctgctcaggaggctgaggcaggagaatcacttgaacccagaaggcggaggttgcagtgagctgagatcgtgccacagtactccagcctggcgacagagcaagactccatctcaaaaaaaaaaaaaaaggaaagaaaagaaaaaagaaagcttagctataccgagaactttatttcccatatcccattttgtattagtccattttcacactggaaaaaaaaaataccaaagattgagtaatttataaaatagagaggtttaattgactcacagtttcgcatggctggggaggcctcaggaaacttacaatcatggcagaaggggaagcaggcaccttcttcacaaggcagcaggagggaataagagccagcaggggaaatgccagacacttataaagccctcagatctcatgagaactcaccctttatcacgagaacagcatggaggaaactgccgccatgatccaatcacttccctccctcgacacgtggggattacaatttgcagtgagattttggtggggacacagagccaaaccatatccttttccctgtagggttgtgggttaaaagtaggcagaagaggatggtgcgggagatttgggaagtggaaggaaggtgacatcagtgtttactctttgaaggctgtccagatgagacaaggaggtgatctgacagaggggccacagaggttccagcttgtcctcaccctcccctgtgtcccttgcagcttgtcttcctgaccgctgggcctgctgaccaacagcagcccccccgcctctggatgcttggcagacgaggcagcagccccctagggacccctctacctgtttcccctctgccactccatcttaacagctggacgcatctgactctcatatcagctgtcggtgacttctctcatcctctccacccttcccagaccgccatctccccagctccctggacaattgtagaaggtctaattcctataacgcatcccttgccccagagcacgtagtgaccctgcttccccgattgagcactgactaatatccctcaacagcctttacagaagtagccagaagttggaggcaatgtgtccatcttgcaccaggccaacatccccccatgcttccgcgtctcagccttgactgcctattgcaatcacatggagaactttaaagaaaatgctggggcctggtcttacagccagagtcttgtctagttgttccaaggcatagcctggtcattgagagtcttagaagcaggtaggctgatgccccctcacctcccacggcacagacatcccctcacctcttcgctggctgaaatagaagaaccctagtgtccatcagctgcttatagatgactcatcttcttaatcctttcttgacgaaaacttgcttcagatgttaataaaaagtacaaaatctgccctatgttagtttgactccttggcacagcagtgggagcctctctctctcccctgtagcctaggatcgtgatcagaatcataatgaaatgtgtgtttgtggtctcccgtggcgtcagataattccgatgccatctgttgtcttcatcatcacatccgttattgaagtccgttgattatgcctttgattgaacctggggctatatttatcaagaaaattataagcacaggctttctgacagtgtccaaccaaacagaatttgtcatcattcaatgactattgctttccatttgttcctgttttggacttctaaaaaccaacacagggtctccttttatttttatttttttaaagaaatcaagtgagctggccaagagcagagcagaagatagatttttcttattcttaattttttttttttttgagacagcatctcgctctgttgcccaggctggagtgcagtggcacaatcttggctcactgcaaccttgtctcccaagttcaagcgattctcctgcctcagcctccccagtagcggggattacaggtgcccgccaccatgcctggctaatttttgtatttttagtagaggcggggtttcaccatgttggccaggctggtctcgaactcctgtcctcaaatgatccacccacctcggcctcccaaagtgctgggattacaggcatgagccaccatgcccggccgagaaatatatatgtatttttaagagacgggctttcactctgttgcccaggctggagtgcagtgatgaatcatggcttactgcagccttgaactcctgggctccagtgatcttcctgcctcagccccttgagtagtggggactataggcacatgccaccatgcctggccaattttttaatttttttgtagagatggggtcttgctgtgttgcccaggctgttatcaaactcctggcctcaagtgattctcctgcctcagtctcccaaaatgatgggattacaggcatgagccaccgtgcgtggctgaaaattcttaaatgtctgccacctatgaaagcattttggagctatagtttgacccaagacgaaaactgctcatttagataatgaagtttaatttacctttgaaagcaacactttgggaaatgcctgaataaactgacatcttgagtcgataggaggcttccccacgtggagtttggtgagctataccaggtcattaaaaagcccttagatgggccggatgcgttggctcatgcctggaatcccagccctttgggagcccaaggtgggtggatcacttaggtcaggagttccaaaccagcctggccaacatggtgaaacaccatctcttactaaaaatacaaaaattaactgggcatggtggtgtgcacctgtaatcccagctacttgggaggctgaggcaccaggatcacttgaacctgagaggcggagattgcagtgagccgagatgtgccagtgcactccagcctgggtgacagagcaagactctgtctcaaagaaaaaaaaaaaaggctcttagattggaagtcagtgctctcattcccccttgaagatggtgactgtttgctactgttccatgtcttcaatgctcatgctgctgcttagacctgttagaactgaccttgagttattccagaggaaaattccagcggatcctagaacaatcagagtattctggactgaagcatagtccagaatcgctctggtgattaaattcggaaagcttgcccagggcatcattaaccgcctggaggagtgagccctctcaccatctgttgtctgccatcactatttggtttttctctttggtctcatttagagccaagttgagaaatttccagttcctctccacttgctgcccgacacagttaaccagaaacacaatgtggtgaaggggcccatgttgtagctaaaacagccctagacttggaggcaggagcctgggttgatatcttggctgtttgactttatagcagcgatccccaacctctttggcaccaaggactggtttcatggaagacaatttttccatggaccagggatggggtgggggcatggttttgagatgattcaagtgcattacatttactgtgcactttatttctatcattattactttgtaatctataatgaaataattatacaactcaccataatgtggaatcagtgggagccctgagcttgttttcctgcaacaagatggtcccatctgtgggcgatgggagagagtggcagatcatcaggcattagattcctataaggagcgtgcaacctagatccctcacatgcacagttcacaatagggtttgcactcctatgagaatctaatgcagccgctgatctgacaggagggggagctcagccggtactgtgagcatggggagtggccgtaaatgcagatgaagcttcactcactcacccgccactcacctcctgctgtgcggcctggctcctaacaggccaaggacctgtactggtggtggctcaggggttgggaacccctgctttatcagacttagttggtccagtttttcccaaagttgggtacgctctgggatgattttaggcagcatttaggaaaacattaattaagaattttttttcggccaggcatggtagctcatgcctataatctcagcactttgggaggcctaggtgggaggatcatgaggtcaagagatcaagaccagcctagccaacatggtggaaacccagcctttactaaaaatacaaaaattagctgggcgtggtggtgcacacctgtagtcccagctacttggaaggctgaggcaggagaatctcttgaacccgggaggtggaggttgcagtgagccgagatcgtaccactgcactccagcctggtgacagagcaagattccgtctcaaaaaaaaaaaaagaaaaagaaaaagaatttattttcaggcaaggcctagtggctcatgcttgtaatcctagcattttggaaggccaaagtggaggatcacttgagcctaggagtttgagtccagcctgggcaacatgacgaaactccgtctttacaaaaaattagcccagtgtgctggagtgcacctgtagtacccccagctacccaggaggctgaggcgggaggattgctggaacccaggctgcagtgagctgatatcacgccactgcactccaacttggacgacagagtgagaccctgctgaaaaaaatatatataattttcatgtcttttaggaacaatattaggtttgcatttatggtgatgtaaaaaagagaatcaacataaagaaaagtattaaatagacaataaaagagaacacgcctgtaatcccagcactttgggaggctgaggtggggagatcacttgaggccaggagttcaagaccagcctgtctaacatggcaaaaccccgtctctactaaaaatacaaaaattagcggctctcggtggcatgcacctataatccaagctactcaggaggctgaagcatgagaatcacttgaacctgagaggtggaggttgcagtgagctgagattgtgccactgcactccagcctgggtgacagagtgagaccctgtctcaaataataataataatagagagggcttgaggcatagcaactgttgccatggtaacgtgcaagtgactgatgttcaggaaacactggctttgctaccctgagccacacttttccttcttgcctgcaaggcgataaggatgttgcacctggtggctggtgtgaggaggtcaggcgcagcaagaggcagcacacgtagcagttacagtcacagactttgcctgcgccagggtctgtgtcccagcggagatgcttaccggctgtgtggtcttgagcaaattgctcgacttctctgttactctgtgtggtgttttctgacgccacttctgacaccaaatgtgttttttctgataccaaatacgtgccatttttctacactaagtctctgattcttggatgccaactgggtgcccaagcaattcaattcagctatcacactatgtcctggagttagcatcaggtcctgcaagttaaaagaccccatcccaccagactgcccctatctcagatgccagtcgcaagtccggagccacccacccttctgcctggccaattacaaacttgggggttcccacgaccacctcctcgggtttgatagtttgctggaatgactcacagagctcaggaaagcccttcacttatgtttactggtttattacaaaggacagaactcaggaatagccaaatggaagagagatgcattgggcaaggtgtggagagggagccgtgcagagcttccatgatgccctctctgggtgcactgccctcccagcacaccagtgtgtccaccaacctagaggctccctggatctcactgttcaagagcttttataattcagtcgccagcctcctcctcttcctggcaggtcagcgagtgggactggaagttgcccgccgaattgttttttttttttttttttttttgagacagggtctcactctgtcacccaggctggagtgcagtggtgagatcatagctcactacagccttgacctcctaggagtgagcctcctgcttcagcctcacaagtagctgagactacacaggtgggtgccaacatgcctggctaatttttaattttttttttttttttttttgagacagagtcttgctctgtcacccaggctggagtgcagtggcgcgatcttggctcactgcaagctccgcctcccaggttcatgccattctcctgcctcagcctcccgagtagctgggcctacaggcgcctgccaccatgcctggctaatttttttgtatttttggtagaggtggggtttcaccatgttagccaggatggtctcgatctcctgacctcatgatccgcccgcctcggcctcccaaagtgctgggattacaggcttgagccaccatacccggcctaaattttttttttttttttttttggtagagatggagtcttgctatgttgtgcaggctggtctcaaactcctgagctcaagtgatcctcctggctcagccacctgagtagctgggattacaggcatgagcctctgcatccggcagtgcccccgaccacctgtctttttttttttttttttgagacggagtctcactctatagcctaggctggagtgcagtggcatgattgcggctcactgcaacctccgcctcccaggttcaagcaattatcctgcctcagcctcccaagtagcttggactacaggcacgtgccatcacacccagctaatttttgtatttttagtagagacgggggtttcaccatattggccaggctggtctcgaactcctgacctcgtgatctgccggcctggacctcccaaagtgctgtgattacaggcgtgagccaccgtgccctgcccacccctctcccctgtctttatcacacatttgctcttctggtgacgaggccccaacctgaagccatctctctagggaactcagcctgagtgccctcattagcatacactcagatgtagtacaatggggattgctatggataacaaaagacagtcctatcgctcaggaaactccaggggctttaggagctctgtgctgggaaccagggatgaagaccaaatagatattttattaaccacactagtggcttaatgaattacctcctagggattttttttttttttttttttttttggtcaggagcagatgagataagatacataaaaaagatattacaatacctaaccacataataactgttcagtaaatgttagcagtgaaatgggggagctcccctgtcccctttgcaggacttgtgacaggggtgtggctcgcttacttggctgccactgcatcaaaccccttgcaggagggggagcatgcaggtgagcagattggggctggggtgagtgcttttgggctctggtcccatggcagcgtctagggatgtgttacaattaatactcttttagcagttgctgtacgcagatgactaagtgttaaccagttcagtggagattcagggtgatagccttttacaccctgccctcttggtacctgggttcttgtctggtgtccaggaagaatcaggtcacatggacttgaaggatggtgaatacaaattttttattaagtagtggaagtggctctcagtggaaggggagctggaaaggggatggagtgggaaggtaatcttcccctggagttcagccatcctcagatgatctcctctctgactgtccccagccaaactcctctcgatgttcagacacttcttctcttctctccttctctgccacgccactctggtgctattctgattgtggagcctggggtttggggttcttaagggcataggatgggggcagggtggtccagagcggttttggaaaaggcaacatttgggtgtgaaaacaggaatgcctgttctcatttagggctgcaggtccaggcttgagggtggagccctcacctgggaccctgtccttctgccgcctgtccgtatcagcaggatgctactgctgctgctgatacctggggaattgccaggtgtgaggtgggcattagaaaaatttcaggctgggcacagtggctcaatcctataatcccagcactttgggaggtcgaagcaggaggactccttgagcctaggggtttgagaccagcctgggcaacatcacaagaactcctctctacaaaaaattttgaaatgagctgggcatggtagtgtgtacccataatcccagctactcaggaggctgaggtgggaagattgcttaaacctgagaggtcaaggctgcagtgagctatgattataccactgcatgccagcctggaccacagagcaagaccctgtctctaaaacacaattaaaacaaaaatttcagttgaatatgttcctaagaagccacaaaagagtcttttgttatgattcttaaatgaaaattaactaaaaattggaaataaggaagaatgtcttttccatgtcatactgaggcactgcttaatgacctgcccacggatgattaattatcttggagagagtacatgtatctgactttgttatttattatttgattagagcactgacatagtgaaattacacgttaacttgtagatttctgtccagtagaaaaaagacgacattaaaggttatggttttattgcccttatagcatgttaaccagatttctctcgaatttagcaatcttatgctaaggttttcattaaagatgctgatgagtccactttttaaatgcccttggagcgagctttaccattttactggttccctcattaatgggttaaataaattttttgacaagtgttcattccacatttgtatgagtcacattttaaattttgaaaatatacttcagcatgatcttaataatgccaagtcccagagagttctctgtgcccataatttagttcactgggcacattcccagagcacgttcagtatgcaaagcatcatggtgggccccgcagggaagactaaaatgggtaggactggtccctatagttgcagatttagtaattacttatgggcagaaaagaagtatataaattacttcctacactgtgagaaagagaaaagctgcccctggcagccgggagctggcttgacactcacagcttggccaaagtgttctcctgttgaatgtaaacaattttgcagattgccggcatcagacaaggccatcctgagaccgtgatagatcaagacaaaataacactactcctgaaggcagataaagacatgaacattgtcccagccacaaaaatcacccaatagccccatttcctagctcatatgagtgactgctagttctccatcaatcacagtttcagtcttactctgttcttctccctttaaaggaaagaattaggaagacactctatcagagaattacctccacttcctgacaacatccaatccagagtaaatgctcacttcctttaaactgtcccccaaagcacctaacacaagcccaaattttcttttcttttctttttctttttttttgagacggagtctcgctctatcacccaggctggagtgcagtggtgcaatctcggctcactgcaacctctgccccccgggttcaagcaattctcccgcctcagcctcccgagtagctgggattataggcacccgccaccacgcctgactaacttttgtatttttagtagagacggggtttcaccatgttggccaggctggtctcgaactcctgacctcaagtgatccacctgcctcggcctcccaaagtgctaggattacaggtgtgagccaccacacctggccccaaattttctaataagtgctttctaacaccctcttactgatatctgcccacagctgattaggtgcaagctagcccagtaccaatcgatagaagacagtacagactcactaaagtgatatatgatggagaaaattgtccccatccagacttcccttagagagaagacccggtgtggttggtgggaacactctgacgcttcttttggttagggttgttggccacaagcaacagaaatcaactctgcctgactcaaccaaaaaatgggattgtagaaggctatgagtggggatgggggctcaggagtcggaaggacaggcttggaaatgagtatggatcaagaaagccccagagactggccacaggaccaatctggccaggaagccgccattgctggacagcacaagtctaatccctccatccttttatctctgtcatttgctctgtggtcaaagtcttggacatgagcttctgattggctgagtctgaggaagtgggggtgctcccttgttgaacttctctaataatgactgacacagtgaatgctttccctaaaactagggtttggaggttgagcagccaaaaattccaacttttttccattacaggagggagacacaaccccacccaagaccatgtgtaagtaacaataggtagtctgtaaacagccttccatggccaggaatggtggccaaagaaggtcttctttgacagaggtcaaagaagagggtgggggccaggcacaggggctcacgcctgtaatcccaacaatttgggaagccgagatgggaggattgctttgaggccagaagtttgagaccagactgggcaacatggtggaaccccctctctataaaaaatataaaaattagccaagcatgctagggcacgcctgtatttccagccactcaggaggctgaggcaggaggatgtcttgagcctgggagattgaggctgtggtgagccatgatcaagcaactgcactccagcctacatgacagagcaagaccctgtttccctgtcacaaacaaacaaacaacaaacaaaaacacatacacataaaccccgtcgttctaagcaaagtgagtcctgctatctgcaggattttgatttttttccaagagcattatgctgaactggtatcagaattaaattgcttggaacaattgttcctggatcaaactgagggttgggctgcttattctagtgacccaataacgagatgcaaataaactgggaaaggagggagtttctatttctgttaccagttacagggaaaaagcctggaaaataccaccagaccaactcaaaattacaaagtttcccagagcttacataccttctaaactatatgtccacgtgtaagtgtgcgttcacctaaagacctaaataatcagcttcttctagtctaactaaggtctgagtcctgaagaccttcctctgaagcctcagtaaatttacttaatctaaatgggtccagttgctggggtgattacccttatcttgtctcctgctaaatcatggaggtttggggacttccttcacactcccaataaacttgtttgtggaggcctggggagtttcttcacacccccaataaaacttgtttaatcctaaacgtgtcctgttaagaattgcctcgttatctcgtcatgtttcaaggcccaggaaaggcctgagcaaaactgttggaggatttctgttacattccagcctttgtataagggcactggctcttttagctttttttttttttttttgagacagagtctcgctctgtcgcccaggctggagtgcagtggtgcgatctctgctcactacaacctctgcctcctaggttcaagcgattctcctgcctcagcttccgagtagctgggattacaggcatgcgccaccatgcccagctaatttttgtattttttgtagagacatgatttcactatgttggccaggctggtcttaaactcctgacatcaggtgattcacccgcctctgccttctaaagtgctgggattgtacaggcatgagccaccatgcccagtaggctccttcagctttgtttttttcttcttcttttttttttttttagtgacagagttttgctcttgtcgcccaggctggagtgcaatggcaggatctcggctcactgcaacctccgcctcccaggttcaagcgattctcctgctgcagcctcccaaagtagctaggattacaggtgcctgccaccacgcccagctaattttttttgtatttttaggtgagacggggtttcaccatgttggccaggctggtcttgaactcctgaacaaggtgatgcatccgccttgggctcccaaagtgctgggattacaggcatgagtcactgcctgcccagccactttcagcttttaatgtttaacttaaccacacagtccctgctgaaatagctgtcatggaggcctgcgttagtgagacctgacctgccacacaatgaaggagatgttcttcattgagataatgtgggtgtccgaatcaggatccacaggtcagtgtcccagctccaccattgactagctgtgtgattccgatggagccacttaacctctctgagctgtgggatcttcctgtataaaagagacaaccacgtagtgcccacctcaaacagtggttatcaggattgagatgatctgtgtaaagcatttagtgcctatgaagcacttcttagtgtataaagcacttagggtgtaaaaggtgcatggtaaattctgtttgtcgcccgggctggagcgcagtggcatgatcttggttcactgcaacttctgcctcccaagttcaagtgattctcctgcctcagcctcccgagtagctgggattacagctgtgcaccaccatgcctggctaatttttgtatttttagtagagacgggatttcaccaggttggccaggctggtcttgaacccctgatctcaagtgatctgctggtcttggcctttcaaagtgctgggattacaggtgtaagccactgcacccgccctgtgcgtggtgaattccgagtaaatggtagccaaaatcattgtcatcatcatcgccacaggtaaccttttccccaaataatactcagcttctcttctaagtaaacgttgaatgaatactttagagtgttgaagaagcacccctaaatctgcccacttgttgattctagccagtgatgttaaatttttaggaatctggagaaccagttgttcaactgtgggtagctcaaaatctgcagcagtgggagtatttacaccgtggaaattggcaaatgattcacagcaaggcttctacctccctcccctgcttccagccagttaaacattccccagcacatcactcattctagtcctagcctgccctactttggggcatccaacagagattacttgcgttttctttgtggtttatcaagccccagggtctcgcttgcctacaaaggagaccactaatcactagcatgctgaataaacatgaagttgacttaaacattaatttacttattatcaaaagcttatctgcttctgctggtgcaatgactctgatgggaattgccagtggtgatggtagataggtgatggcttcagagaagtgtgctctgtgctttggcaggagcagggctaagctgagacagtggtcctagtggcccagtccatgggctaagcaggaatgggtgggaagagggcaggggaggcttccccggggcctgcagattgtgttcttaagagttttttccttcagtccttagaagctcagctgaaaggaatgactgcggccggatgtggtggttcatgcctgtaatcccagcacttagggaggccgaggtgggcagatcacctgaggtcaggagtttgagaccagcctggccaaactggtaaaaccccaactctactaaaaatacaaaaattagctgagcatggtggctggtgcctgtaatcccagctacttgggaggctgagccagaggaattgcttgaacccaggaggtggaggttgcagtaagcccagatcaagatcacaccactgcattccagcctgggcaacagagcaagcaagattctatctcaaaaaaaaaaaaaaaaaaaatggagtgattgctttaaaattcttaaacagggccgggtgcggtggctcacgcctgtaatcccagcactttgggaggcagaggcaggcggatcactaggtcaagagatggagtccatcctggccaacgtggtgaaaccctgtctctactaaaaatacaaatattagctgggcgtggtggcgggcgcctgtagtcccagctactcaggaggctgaggcaggagaattccttgaacccaggaggcggaggttgcagtgagctgagatcacgccactgcactccatcctggcgacagagtgagacattgtctaaaaaaaaaaaaaaaaattcctaaacaggaggggcttagggccagccagttggtcacatgaaacaatcaggggacttaccttagagctgccttcgcagtagggagtccatggtttttagtgagatttgtgtcgtacaaattaattaaaattgcatagtttctatcaagtttttttcttacactttccacaaaattgggaaaaatgtctatttcccatttctttatttcattttctcttattgcttctatcctacctgatatttcccatttcaaaagcacgtttttttttttgagatgcagtcttgctctgtcgcccaggctggagtgcagtggtgccatctcggctcactgcaagctccacctcccgggttcacgccatgctcctgcctcagcttcccgagtagctgggactacaagcacctaccaccattttttgtgttttttagtagagacagggtttcactgtgttagccaggatggtctctatctcctgacctcgtgatccaccccgcctcggcctcccgaagtgctgggattacaggtgtgagccaccgcgcccggcccaaaagcactttttaaatgttgaggtggtttgaaggctaatggaaattacgaggtgggactgaaaccattccctgccatccctaagaaagcccactccttggaactgccactggtgaaagtctcactctgtcacccaggccagagtgcagtggcacaatctcagctcactgcaacctctgcctcccaggttcaagcgatcctcccacctcagccccgcaagttgctgggactacaggtgcccaccaccatgcctggctaatttttttttttttttttaagtagagacggggtttcaccgtattgcccaggctgatctcaaactcctgagctcaagtgatctgcctgcctcagcctcccaaagtgctgggattacaggcatgagccaccgcgcccggcctgaaagcattttagaaggctcctgactgaaagaacgggataaagtaagggggtatgggaacagaagatgacagcctggtatatctgggtgacatgcgtaggcagtctgttgtagtggcaattgtcagggctctggagttagactgtcttctttcaaatcttgcaagctgtctgatctcgggcgatttacttaacctctctgagagttctgtaaagtggagaataagaataccaccctacagatgatgaggattcaatgagattgggctggatacaaatcagcttttgttggcatcagcttgagaggagggatggacttgggagtggagagggtggatttgggggagaggacgccacacagtggcaggaactcgcagcaggtgactgagagtggaaggcacaagagagcccagatgctgagccagctcagaatagaaacggtattgatagcagaatgcaaagcagtatcactcgaatgacggatgtttaattggatttctccagggctgactcaccgcctttgatagatgcgattgccctcgtggtgtctatcatgagacttgaaatttttccacctgcacctgcagtctttaggccttgtttcaacaaaatgcagtactgtgtgtaccctccatgcctgccagccttccttccttccttgtgtatttactgcaatgtatcagggacggggtggtgtgctagaaccatgaaggaaaaaggcaaagtcccttaaaggaggtgcagtctgttgaggcagaaacacaaatgcctagatggttctggaatgcctagatgtcaatgggataacaagggggctatggctgcaggaaggaagaggacctgatgtagctgagggcatcaggaagattccagaaggagaagggattagtgaagctgcagagcacttagtttgagacaaagatttctgagctgagggaggagttgggcaaaggcttgagtgcaggagttcaagagaactccttggggccaggctttacacagggatgcacatgggctgtgtaccagtctgttctgacactgctgtaaagatactacccgagactgggtcatttataaaggaaagaagtttaattgactcacagttctgcatggctggggaggcctcaggaaacttgcagtcatggcagacggcgaagggaaagcaagcacgtcttacgtggcggcaggagagagacagcacaagagaaaatgagtgtaggaagtgccacatttaaaaccagcagctctcttgaactcctgcactcaagcgatcctcctgcctcggcctcccttagttctgggataacaggcaggagctgctgtgcccacctggagcttaatctctgttcacatctttaattattctgggccagcttagccaaaggccttaggggtagggttagggacaccaagggccagtcttctatccacttcacagctcgctgggccctccaagggaaggactatgtgtctcattctaggcactggtaagagtctgggggaaaaaaaatcaaaaataacaagtggacgcggtggctcacacctgtaatcccagcactttgggaggccgaggtgggtggatcacttgaggtcaggagttcaagaccagcctcgtcaacatggtgaaaccccgtctctactgaaaatacaaaaattagcagggtatggtggtgtgcccctgtaatcccagctactcaggaggctgaggcacgaggattgcttgaacctgggaggcagaggttgcagtgagctgagattgcaccactgcactccggcctgggcgacagaacgagactccatctcaaaaaaaaaaagaagaagaagaagaagaaatgaactcacaacacttactgtctccttcaaaggagtgaaggatgtgcagagggctaagtgcggtcccagaaactgccaggtagcatcagtgagcaggtgcaggaaatctgttggccaaccttgcatgcactgggcacggcccagttccctgccagagcccagagaagaaaacaagctctggtctcagtcgaagcagtggggtgggaagagccctgctgtctcgccacatggccttggtagctggcctatgtctcaatgtctcttgaaagtgaaaatagatcaggagggctgacacgtagtaggcgctcaagaactgttttctggatgagtcagtgaattggtgaacagcattcacctctctgggcattgatttcttcattcatgtaaggtgagagctcttctagctgcagaaatttctttagagccaggcacagtggctcacccctgttatctcagtactttgggaggccaaggcaggagaatggcttcagcccaggagtttgagaccagcctgagcaacatagtgagacccccatctctaccagacattttttttgagatggagtctcactctgttgcccaggctggagttcagtggtacgatctcagctcactgaaacctccatctcccaggttcaagcaattctcctgcctcggcttcccgagtaactgggatcacaggcatgcaccaccatgcccggctagtttttgtatttttagtagagatggagtttcgccatgttggctaggctggtcttgaactcgtgacctgaattgatccacctgcctcggcctcccgaagtgctgtgactacaggcatgagccaccgtgcctggcccaaaacgtttttttaaaattaccaaggcgtggtggcatgcgcctgtagtcccaactacttggaaggctgaggcaggaggattgctctagccaggaggtcaaggctgcagtgagctatgattacactcctgtaagttcagcaaaatatttctgtaaagggccaagtactaaacaccttaggctctacagagtgtacagtctctgtcgtgattactcacctctgccactgtcgggaaaaacagccacagacaatgctgaaatgaatggacatgacttcgttccaatagcatgttattcacagatgctgaactttgaatttcatataattttcatttatcagaaaatgttatgattttgattttccccaagtatttaaaaatgaaaattaaactattcttagttcgtgagttgtaccaaaacaggcagtgggccagattttgactgtgggctatagtttgccaaccccagctaaagattgaggagcaaacgcatcttccaggaattccttggatcgtcttagacagaaggtcaaagggagagtgcactctctccttggtgtggaaatactgatcaccatgtcttccaaactgggtttcatagacacatctccatgccatgctctcactctagaacctaagatggctcccatgttaaggttctttacaacgcagacacatatgtccctgatatgtcctaattgggcagactcttcattgtcacctaccctggcataccacacccattcctaatatttgtctcagctcccccttctctctgagtgcctggaatcttttcctgacccctccaagttgtgccctcccctgtaagttgcatctcgatttgagcagccttctcccagactatcctgatctctgtcttccttgaactccagtcactggctggagctttcacagtcccagtcgagagcatgggctcagatcagactgcccgagttcaagttcctaccacttactctgtgacgttgaacaagttctttatcctgtctaagagataataataatagtccttacctcatagagttgctgcaagagttcactgagatgatttgtgtaaaatgcttaatccagagcctgacaccaatcatatgaaagcattcaataagtactagcaattatacttctgtattgtttgatgtttttatagtgagaccatatttatgtaatatttgtataattttttaaatagaccaagctgggtgtggtggtatatgcctgtgttcccagctacttgggaggctgaagcaggaggatcccttaagcccaggagttcaagtccagcctgggcaatatagtaagaccctgcctctaaaaaagaaaaaaaaaaggaccaagtattcttttttttttctttttttttttagatggtgtctcgctctgtcgcccatgctgcagtgcagtggcatgatctcagcgcactgcaagctccacctcccaggttcacgccattctcctgcctcagcctcccaagtagctgggactacaggtgcccgccaccacgcccggctgattttttgtattttcagtagagacagggtttcaccgtgttagccaggatggtctcgatctcctgaccttgtgatccgcccgcctcggcctcccaaagtgctgggattacagacttgagccaccgtgcccggccaggagcaagtattcttttaggtctaaaacaaaggtaactaagcaatactggtgtttgtttgttttgagacagggtctcactctgtcaaggcagacagctggaaacccacgtcaagaaaattgactattttcaaaagtcaatccttgcctcccaggttggagtacagtggtgtgatcatggctcacccaggagctcaacctcctgggctgaagtgatcctcctacctcagcctctctggtagctggaaccacaggtacacaccaccaggcatagctaatttttttattgtgtagagacagagtctcgctatgttgcctaggctaatctcgaactcctggactctatcgatcctcccatctcagcctcaaagtactgggattacaggcatgagccactgtgcctggccataatttttttatatcatacatacagaaaagagcagtattagtagttgttattgtaagaaaaatgaaaactaaggcagtctagaaagcccttggaagagagaagaataaactgcgcttgaggaagttgacatttgggaacagagtgggaacaagggtcttgaagaaggtgacatttgtttgggaacgagtgtctgactgcaatcaaaggaaaggccagtgtgacaggtggatgtaaatccacagtccattaaaatggccacagagagaaaacagacatattggccttccagggtgcaacatgagggcattcccttcctatgtacactggcaggcacctctccggtcccttggtccccagcaagatgctgagaaattgctgaggccaggggctccctggacacttatcaacacttatccttacccagggatagcgtttaagctcatgaatcctacgaaagctgaaccaatgcacatgtttatcatcttggaaccatttgatttgaggaaattgtaatagcacatgctggccaggcgcggtggctcatgcctgtaatcccagcactttgggaagctgaggcgggtggatcacctgaggtcaggagttcgagaccagcctggccaacatagtgaaatcccctctctaccaaaatacaaaaatttgctgggcatggtggcaagtgcctgttatctcagctacttgggaggctgaggcaggagaatcgcctgaacctgggaggtgaggttgcagtgagccaagatcccgccattgcactacagcctggacgacaagagcgaaactccatctcaaaaaaaaaaaaaatagcatgtgatagtgagatacacattttgcacagaaatgttggctgagatagtccaggagagtctctgtgagctgactttttacctagggtggaggagtggatggaagtggctgttcctacacacccacactgcctgtgcaaaaccgtgggctgcctgcaccacacacacaagcctgtttgattctcatacaaccccaagacaaaggtgtaatcccttttcaacagtgacagcactgaggctgagagcagcaaagtaggtcatagccagtcaatgggggtactgagatctgcattgagatctggctgtgtctaaagcgggttgtatcctctctgtgcttgcagaatggggctcgagggctcatctaaacccctcatcttatttatttatttttatttatttatttatttattgagacggagtctcgctctgttgccaggctggagtgcagtggtgcaatctcggctcactgcaacctccacctcccaggttcaagtgattctcctgcctcagcctcctgagtagctaggactacaagcacgtgccaccacgcccagctaatttttgtatttttagtagagacagggtttcaccatgttggccaggctggtctcgatttcttgacctcgtgatccgccctcctcggcctcccaaagtgctgggattacaggcgtgagccaccgcgcccggcccagacatgacatctttttctcacctgtcttaagatacctgcagcctctgtaacttatttttaaaaggagacaataaagactatttttaaaagtcaatccttgcctctgaaaacctacctctgcctttgtcgtggtctctgctgggtttccattaggctgcaactcaagctgctgatgcctccatttcatgtcgttttcacaaacattttgtaaagcagcagctctattattccagcagggcctgatcacctctccgcacccaacgctgataaaaatgacccgctttcccctatcgtcccagcgtgaaagaccaagatgctgaatgacacgggttggctttcttttccttccgaacattaatcaggttcttgaagataacatctctctctggaacgagccggcagcagcagagtttgatttccaggttcagccctaatggtacagagacctggactaatgtggcttattcaaagttccagccatgcttctaaagcatggcttattcgaacttccagctatgcttttaaagcactttgcatgaactattcacatgtcttttgaacaatatgatttaatggcattggaaaatcatcatgatgtcatgcttgcaatgagcaggacagctgtatgtcttgatccaatacacattaaaaatgcacctatccacacatatgtatctgtgaaaatgtcttcagctgcaagtaacacagcgtccgacgactagtgtcttaaatcttgggtgaccagctgtctctgtttgcctgggactgagaggtttccaaggatctggaaactgcagtgcagaaactgggacagccccaggcaaaccaagtcagttgttcacactacttaagtcataaggacatttaatatttacttgaggctggacacagtggctcacacctgtaatcccaacactttcggaggctgaggcaggtggatcacgaggtaaggagttcaagaccagcctggccaagatggtgaaactccatctctcctaaaaatacaaaaattagccaggcttggtggtggatgcctgtaatcccagctactcgggaagctgaggcagagaatggcttcaacctgtgaggcggaggttgcagtgagccgagatcatgccactgcactccagcctgggcaacagagctagactccgtctcaaaaaaaaaaattttttttgacttgataagcagtccagatgcaggtggcccgagggtcagtggggtggccccaggatgctatcaagggtctggctgtttcctttcctcccctctgccctagatagcgaacctgtccccttctgcccatgggtagtaagccaatcgctgttatgatggatttggcaaaagaaaagaatttattcacaccaacgcagccaagcaaggaggcaggagaaaaggtctcatacttgcctccctgaagatggaatttagggatctttatggaataaaggagcagggtggtctaaagtgtgggaagaggtgattggaggcaaggaaaagtgaggtcattggcaatctgcacatacatagccaagcttcctggatcttcatagggtgcatgtttagaaaatggcagcattagcatgatctcggggagttttgggccctctgacgtcaaaaggtcacttctccggcatttgcacaggttcagttgaagggtcattgatctcaacgggttcgaactggacaggagctgcccccatagtcctgaaaaacaactttaagcaaccattaccgtagtcacatatgtgtcgtagcgacatatatgtgacatatgacatatatgtaccataatgacatatagtgacatatgtaaggaagccggtgggggggttaggtatatatcatttggctgcttgacttttagctatataagttttaagaccagctagaagtaagtggttaaaagcaagcaaggcaagttaagtttggtgggcttcatcaggttagcgttcggtttcgccattctcacgtgagtggctgtaggagcttaggaccaggacaggggagaaccgaaggccctaattatccttcccagaagcctgcccaagcggagtttctcttaagggctttctctaagcccaccaaacttaacttgccttgcttgcttttaaccacttacttctagctgatcttaaaacttatatagctaaaagtcaagcagccaaatgatatttaactaaaccctccactggcttccttatatatgtcactatatgtcattatgttacatatatgtcatatgtcacctatatggcactatgacacatacgtgactatggtaatggttgcttaaagttgttctcttacatttcattggcccagagtagatgtcatagctacctccacttgcaagagagcctggaaaagtatgtgtctagccaaagcaaatgggattctgtgactggcttccatcaaggcagggcaggttgcctcctggacaaatcagagctctgggagaaagcgggaggggaaggtctacaaccagtcatgcccgctgcaactcatggagccacatggagaggagacaacacggtgaaattgtcaagagcaggagctagggctgaatctggaaggccacttaccagtgcagagctttgggtgtgttgcttaacctccatgtactcatctgtaaaatagagctaaaaacaatgtttctcttcctggactgctgtgacggtctagaagagtttatgcacagaaagtgcatttacatgtaaatgctccgtaaatgctgacttcttgtttgccttaatggcagaacccatccttccatattccagaaaaagacttgatttttagttacgtgaatggacacctaaccctgatggacagcttggggtcgggggacaagcttctttcttggaaggatgttcaaaggaccatgaagcttttggttttgccaactggggtttgtaagttgaagaacagagctgagtaattcaggacaggggtgtccaatcttttgtcttccctgggccacattggaagaattgtcttggaccacacataaaatacacttatagtaacaatagctgatgagcttaaaaaaaaaatcacacacaaaaaaaatctcatgttttaaaaaggtttacaaatttgtgttgggctgccttcaaaagccatcctgggcctaatttggacaagcttgatttaggacctgatggtcctcctttagcggaaggtgtgtggaggaggtagagagagagagagaagagatgagacatgaggaaaacagagccatctcatagggacgttgatggagtcctgcagcgtgaatcccgtcagcagttctgtagagctccacctcgcttgtcaatgggttgtgggcttggatcttttgggaggattcaatgacatgctaagggcagccttggaggtggacaaagggccagggcaaaggcccccagggcatgcccgccacccttaggttacatggaggaaaaagattgctgtgaaatacaccagaaccctcggagtagaagtggcctctgctacacgtaggtcaaggttctgcatactttcatcttccttctttgtacttgtttgtattttccaaaatttctacaatgattagggatccattctataatcagataaaattgccatttacaaacttttattggccaggcatagtggctcatgcctgtaatcccagcactttgggaggctgaggtgggtggattgcttgagtccaggagtttgagaccagcctgggcaacatggcaaaaccccttctctaccaaaaatacaaaaaattctccaggtgtggtggcgcctccctgtagtcccagctactctggaggctgaggagggaggatggcttgagcccaggaggcagagattgcagtgagctgagattgtgccactgcattccagcctgggtgacagagccagactccatctcaaaataaaataaaataaaataaataaataaaaataaaaacttttacaaagaagagtataagcactgaaagttatttttaaaaaggttttacttgttagctccattcctcagaaatagtgcttcttccacatcattttctctttccttttttctctgctgcttttttttttttttttttttttgagacggagtctcgctctgttgccaggctggagtgcagtggcacgatctcagctcaccgcaatctctgcctcctgggttcaagtattctcctgcctcagcttcctgagtagctgggattacaggcgcccactaccaaccatgcccggctaatttttgtatttttagtagagacaggatttcaccaagttggccaggatggtcttgatctcttgaccttgtgacctgcccacctcagccttccaaactgctaggattacaggtgtgagccaccacgccggccattttttttttttttttttttttttttttgggagaaggagtctcactctgttggccaggctggagtgcagtggcatgatcttgactcactgcaacctctgcctcctgggttcaagcgattctcctgcttcagcctcctgagaactggggattacaggcatgtgccaccacacctggctaatttttatatttttagtagagaaagggtctcaccacgttggccaggctggtcttgaactcctgacttcaagtgatccttccacctcggcctcccaaagtgctgggattacaggtgtgagccaccccacccagccattctctgcttctttctcacagctaatgataataatagtaaaggccaagggtggtggctcatgcctgtaatcccagtgctttgggaggctgacatgggaggatcgcttgaggctaggagttctagaccatcttggccaacatggcaagattctgtctctacaaaaaatttaaaaattagctgagtgtaggggcatatgcctaaagtcctagctacttggaaggctgaggcaggcaaatccttttacccctggcgttcgaagctgcagtgagctatgattgcactgctgaactccagcctgggtgatagagctagaccctgtctctaaaaaacataataatagtagatagcatttactgggcatttgactgtgtaggtcccaggcactgtgcttaatgcttgatgtgcataataatcccagcaaatagtactgccattattcctatttaaaacatgacggctaggtgcggtggctcacgcctatcatcccagcactttgggaagctgaggcaggtggatcacctgagatcaggtgttcgagaccagcctgatcaacatggtgaaatctcgtccaaaaaaaaaaaaattagctgggcctggtggtgcatgcctgtaatctcagctacttggaaggcttaggtaggagaatcacttgaacccgggaggcaaaggttgcaatgagccaagatcgcgccattgcactccagcctaggcaacgagagcaaaactctttttcaaaaaaaaaaaaaaaaacataaataaataattaaaaatgagttaggtgagacagaaaaggaagtcactgtaccatggccctttgagccagagttgtttggtgccaaaactctgcctcctaatcactacctgtctctccttttgtcctttctccatcttctcctctcttacctctcaaaaattatcaataatttgataattctgtggttagaatccaagattcctcaacttcagtgtgattgacatggtggctggctcactttctgttgtgggagctgttctgtgcacagtaggatgtttagcagtgtccctggtctctacccactagatgccagtagcaaccacacccctccccaacacacactcaattataataaccaaatatgtctccaggcattgccaaatgttcctggggaccaagattgccctgatgtagcctgatctctgcaaaagcgtctggagtctctccagttgaacgatcgctgatagaaactcacgggaacagtctgtgccctcccggcaagtccacgctcattcgaggcagctgtcacctgctaggacattccagggcacgacttgaaaaatgcttggcgtgcctctgacaacaagagatgcaggctgaagcaaggcattcctgcctcttgtcctgaaactgggatgctggcattagaatggacagcatgagttgttcttgagtggcaaaaggcaaggggtcctgctgtggtttgtatgtctgtctcctccaaatctcatgttgaaattagtctgttctcgcatttctataaagaactacctgaggccgggcgcagtggctcacgcctgtaatcccagcactttgggaggctgaagtgggtggattgcttgagccaaggagttggcaaccagcttgggcaacatggtgtaactctatctctattataaagaaacaaaaaaatttttttttgggacggagactcgctctgttgcccagtgcagtggcgcaatcttggcccgctgcaacctccgcctcctgggttcacacattctcctgcctcagcctcccgagtagctgggactacaggtgcctaccaccacgcccggctaatttttcgtatttttagtagagacggggtttcaccatgttagacaggatggtctcgatctcctgacctcgtgatctgcccacctcggcctcccaaagtgctgggattacaggtatgagccaccgtgcccagccagaaaaaaaaatttttaaacaggctacctcagattgggtaatttatacagaaaagaagtttaattgacttgcagttccactggctgtacaggaagcatggctggggaggcctcaggaaacttacaatcatgatggaaggcgaaggggaagtcttacgtggctggagaaggaacaagagagcaaagagggaggtgctacacacacttaaacaaccagatctcgtgagaactcactatcatgagaacagcaagggagacgtccacccccatgatccaatcacctccccccaggcccctcctccaacactggggattatgatttgacatgagatgtgggcagggacacagatccaaactacatcataggccccagtgggaggtgtttgggtcacgggggtggatcccccatgaatagattaagctcttcctgggaggtgggggtgagtgagttctcactcttttagttcctggacagctggttgttaaaaaaagcctggcacctccccctctctcttgcttccactcttgccctgtgacttctgcacacatgagctccctttcaccttctatgaatgtagccagcctgaggcccatgccaaatgtcccatcttccagccagcagaatcatgagccaaataaacctcttgtctttataaagatattatttcctcttcattaaagaacagcttttctaaatgttgggggaaatgtccatagtcattactcaatcaaaacttgtgttcccataagcctaaggaccattctagattttttacatgtttttttgtgtgtgtgtatctataaaatgcatacataaatttttttttgtttttaagcattcacccaaacaaaaaatcacaggtaaacccatatttctgagatgccattattccgagctaaataagagataatcacttcaaggtaaattgaaaattttcctgaagccatacatttcaagtgaaataagtaattctaaataggacaatttaaattggataattttaaagcgtctataattggtttatttgcaaaattcctgaaaggaaaaattttatcactgccatcacagcaggtttccacatccagatgagaaaacaagacaaatgctagtgtgttttaactagctaaacaaaactaagttaaatgaatatttaaaaatttccctagtgggccattccttaacaaaatgttgaaatccctgttgctacattgactaaaagatcatgttgaatggaatatgtaagacttggctcatagaaacctaatcagatggttagagatgctggcagtttaggacctgctgccataaatgtgtgaacaaccttttgtaatctaacctactgacctgcatgttttttctttaccccagctcattccttacatgtagcctcaatcttcagtttgctttactggttcagcaaaagccaggaagaacaactttgtagtaatcagaatgttatccaactgtatattgtttactttatcgtaaatactggtgaacagtggttaataaatagttttatattcctttatgcaaaaaaaaaaaaaagcactcagccacaggcattccttgatagcaacactcaggggactaagatagggccccatgctggtatacagatggcactgctgaaaggagtcagcagccccggcccttgatggagacgctgaggaacgaggcagaaagatcagtggactcagactccgaagggtcgatttctagttctggtcctgcccccatgagctgtgtgtactcagttgagcctctttacctgtttccgcatgagtaaaatgaaaatatgatttctgtcctctggtttttcctaggatagttgtcaggagcaaagtaagatactggctccaagctgacccactacatcccttacctgcttcagtcttctttgtaacatctgaaatattgtatttgggtttaccttctgtctctgctagcaaaatgtcatcttcctgagggcttggtcttctttgctgttgcaagcctcagagatgacaacaatgcccaacatagtagatgttcaataaagacgtgcaggccaggtacagtggctcacgcctgtaatcccagcactttggaaggccaaggcgggaggatcacttgaggccaggagttcaagaccaacctggtaaacagcaagaccccatctctatgaaaattttaaaaattaaaaaaagtatgagctgggcatgatggctgcacagctgtagtgccagctacttcagaggctgaggtgggaagatcacttgagcccaggagttcagggctgcaatgagctatgactgtgccttgggtgatacagcaggaccctgtctcaaaaaacaaaacaagaacaacaaagacaaagacacgcagagtgaatgtgaacctgtgtatcacggggaagttatttgaagatacatctcaacagctatggaaatatcaagccctttgtacacagtgattccacttctgagaatctaaaccccaaataatccaacatggagaagaagccttagaggaactgatgttcatcctgcagtggccaaaattgctcaaacctgaaaagccagccttagtaatcaagatgagggtgtaattagcacaatcccgatgaatctcatttgtgaaattgcagacagccattacaaatattgtttacagcaagatgagttaatttttgtagcacacacacaaaaccataatgtgtaatgcaaaattataatgtgtaatgcaaaactaggttgcaaaagcaacccaattactgagatgacaggagccagcacccactgtcccccatggccacactgttggtaatgtcacacatgatctctccggagggcaatttggaaattcctactacaatgtaagtgttcatgccactagacccagcaattgcatttctatgaatctatcctagaaatgtattaggaaacaacccagatgtctatgaataggggaatagttaaataaattatagttaaatagatcactgtataatcagctgagtgcagtggctcacgcctgtaatcccagctactagctactctggaggctgaagccagagaatcacttgaacctgggaggcagaggttgcggtgagccaagatcacaccactgcactccagcctgggtgatacagtgagactgtctaaaaaaaataaaaataaaaataaatttaaaaaataaaaatagatgactgtatatcaatataatggtatactatgcagccactaaatatgtggagatttgcatatactgatatggaaagatgatcaagactattaaagattattaaattgaaaaaagcaaattgcaaaaaatttttgtgcaataacaatggtgtcatatatgatattataagcatacgctttttttttaaatctggaggaggctgggtgcagtggctcatacctatatcccagcactttgagaggctgaggtgggaggattgcttgaagccaggaatccaagaccagccgggcaacataacgaggtccctctctctacaaaaaactgtttaaaaattagcctgtagtcccagctactccgtagggggctggggttgggaggggttgtgcagaggtgggaggatcccttgagcccaggagttcaagtctgcagtaagctatgatcacgccactgcactccatcctgggcaacagagcgacactctatctccaaaaataaaaaataaaaaattaaacattttcaaaataaaaatgtttttaaaaaatccagaggaatacatactaaaccgttgacaatgattctctccgaaggacagagggagactttcctctatgttgtgaatttctgcagtgtttaaaaaacgtaaactttagctgaaaaacgaaactgaatatgccatatgaacccacttatataagcaaacctaagtcaggcacatgaagactggaaggagctctatcgaggtgttattaacagtgactgatggccaggcaccgcggcttatgcctgtaatcccagcactttgggaggctgaggtgtgcagatcacttgaggccaggagtttaagaccagcctggccaccatggtgaaaccctgtctctactaaaaatactactaaaaatacaaaaaaagttagctgggcatggtggcaggcacctataatcccagttacttgggaggctgaggcaggagaatcgcttgaacccggaaggtggaggttgcggtgagccgagatcatgccactgcactccagcctgggcaacagagtgagactctgtcacaaacaaacaaacaaacaaaaaacagtgatcatttctaggtggtgggataattgagcagtgtttggctttttccttttgagggaaaacctctacaatgagcatgtatggcctcttcaaaagataacccacctttaatagcttctttgtgttaaccgggtgatgctcagggcgtaatgctctgctgatgtaacctgctgttgatggtgtcctgtttccccaggatggatgacatccagctctgcaaggacatcatggacttgaagcaggagctgcagaacttggtcgccatcccaggtaaccatttgcaacttcaccttgtgctaaacaggtgcttgggggcccccagcctggcccatctgtacgcctgggtctggaagacagagcctcattcttgcaatgcagtgctccctgactgcatgtgtcaaacacaacttcgagtcaggaagacctgggttcaagtcctagtgaattctggtcaccttcttgtccttggacaagtcactgtacttctctgagactcaatttctcctcctctgaaaattggctagtaatagtaagagggtctaattcattgagtataaatatcctaaagaggctgggcacggtggctaatgcctgtaatcccagcactttaggaggctgagatgggtggcttacttgaggtcaggagtttgaggccagcctggccaacatggcaaaaccccatctctactaaaaatacaaaaattagccaggtgtggtggcacacacctgtaatcccaggtaaccggcaggctgaggcaggagaatcacttgagcttgggaggtggaggttgcagtgagctgagattgtgccattgcactccagcctgggcaacacagcgagacactgtctcaaaaaaatatataattaaattaaattaaatatcataaaaatcgatgagatgatgcaaactaagtgcttagcttgatatttggcctcaagagtccagtaaatattagcaattatgaccattattatcctacttgggaacagatgaagtgtgtacaaactctaactttgaagtcaccccagatttggtagttaataatgcctgacttatttggcatcttctccaaaaaattttcccctgcccatcaggctgtgttagttgccctctgtggggcttacccttatcaaaatgctagtcccaggccaggcatggtggctcacgcctgtaatcccagcagtttaggaggctgagagggcagatcacttgagttcaggagtttgagaacagcctggcaaacatggtgaaaccccatctctagtaaaaatatgaaaattagccaggggtggtggcgggtgcctgtaattccagctactcaggaggctgaggtgggagaattgcttgaacccaggaggtggaggttgcagtgaggtgagatctcaccactgcacttcagcctgggtgacagagcgagactccgactcaaaaaaaagaaagagagaactgagtaatttataaagaaaataagtttaattggctcacagtcctgcaggctgtaccagaagcatgatgctggtgtctgctcagctgctggaaggcctcaggaaacttataatcatggcggaagacaagggagcagacatgtcacgtgcccagagcaggagcaagagagtgaggcgggaggtgccacacacttttaaaagaccaaatctcatgagaactcactatcacaaggacagtaccaaggaggatggggctaaaccatcatgagaaacctccatcatgatccaatcacctctcatcaggccacgcctccaacactgggtattacatttcaatatgagatttgggcggggacacacatccaaactatatcagaatggatgctgctgattggttggggatgcaatcataggtgtgtgaaaaatgattctcaggggtgctaagtccacttctgggtggcaggtccacgtggatcatcattcatcagaaatgcaaaacctaaagagatatctcaaaaggctgatcttagattctgcaatagtgatgttatctgcaggagtaattggggaagttgcaaatcttgtgacctctggaataatggcagtagtcatttatgtctacaccttagcagaattcagcctcctcccatccttctaacatgggggccttttattagctttacaaaggcagtttagttggtggaaaaggttataatcatttaaactataaactaaatgtctcccaaagctagcatggcctaaacctgggaatgattaagggcagcttggaggttaaaggcaagatgggggttggttagatcagatccctttcactgtcctaattttctcactgttatcatttttgcaaaggtgttttcaaataggccagataagcacccaccattacccttgacttgaatgtttttgccatgctgtcagttcaataactatgtcccaagaggctgttctgcagcaagctctgaacctaggagccgggcttgcagtgatgaacagagaacggttctccactctcaaggagcccccaggttagcagaaagagactgggcccagcacacagtgggtgcccataagtggcagttcttactgagctacaagtgcagcatgatgagccttaaagcagcgtttcccaaccttcaactattgacatttggggttgacaaatgtcagtatcttcctttggggttgatcattttttgttgggggtacggggctctgtgttgtgtcttgtgggatgttgagtttcatccctggcctctacccactacaggccattagcacaacgtacctctccgctacccctcaatggtgatgttacctgaaagggatcctgatccagaccccaaagttcttggaccaagagcaagaaagaatttagggcgagtccgtaaagtgaaagcaagtttattaagaaagcaaaggaataaaagaatggctactctgtaggcagggtagcagcttgggctcctcgattgattgtacttatagctatttcttgattatatgctaaacaaggggtagattattcatgagttttctgggaaaggggtgggcaattcccacaactgagggttcctcccctttttagaccatgtagggtaacttcctgatgttgccatgacatttgtaaactgtcatggcactgatgggagtacctcttagcatgctaataccttataattagcatataatgagtagtgaggacgaccagaggtcactttcatcgccatcttggctttggtgggttttggcagccttctttactaatgctgttttatcaggaaggtctttgtgacctgtatcttgtgccgacctcctatctcatcttgtgacttagaatgcctaacctcctgggcattcagcccagtaggtctcagccttattttacccagcccctattcaagatggagtcactgtagttcaaacccttctgacagtgacaaccaaaaatgtctatagatgtacagatgttgctgaatgtaccccaagcgaggtcaggggggtgtgcaacattgccctatgaaaggaaaataaagtcccaggaccccaattcactataccaaaaggaaaagttaagcttgggaactatgagtcatacaaaaacctacttttttttttttttttgagacggagtctcgctctgtcccccaggctggagtgcagtggcgcgatctctgctcacagcaagttccgcctcccgggttcatgcctcagcctcagtctcccgagtagctgggagcctgtaggcacctgccaccacgcccggctaattttttgtatttttagtagaggtggggtttcaccgtgttagccaggatggtctcgatctcctgacctcatgatccacccacctcaagcctcccaaagtgctaggattacaggtgtgagccaccacacccagccaaaactgcctttctttttttcctaaacagatagctgcaagatagaaaggccacctatcttcccaggggcctccctcaccctgtcaatgtaaattaacagcttatcctaacaggtaggggactaagacaagactataaatcatcgtccctccgcccacccggagacaaatgcacatttgacttcctcctctactccgcgtttcctttatcctatgtaaaatgcaaattcactgagggccagagaatgcaatcctccccttcctgccctctctttcccctttaaatattgaagtccttaagatcctctgcagaaaaaagcacaggccggggatcctattgctgcctgtgtctctttttcccaggtgcctcctcgactttggcaaaataaacctccagattgattgagaccttctcagacactttgcagcttacagctcccacataagaactactactttagtaattagagtgcagcaatctgggtttgaattcagccttagcaggcaggtgaacttcgtgaaagttcgcgacttaatttctctgagccttgaattccttgttgggaaaatgaggccaataatactaccccccgcatggttgttgtgaatatcccataaataacaaaggcaaggtgtaggagtcttccacacagtcttgttgtaagggtagtgtgcgcaatgacagtagaactgaatcctctagctttcgtgagcatttactaggtgcccagcactgtgtaggccctaaggataaacgagtgaatagactttcctagttgaaagagagcgacagctagtgggtatggggtttcttctgggggtgattaaaatgttctaaaatggattgtggtgatggttgcacaactctgcaaatacacttggaacagatgaactgcatggtatgtgaatcatattgcaataaagctgttaccaaaaaaagttaaatgtcaaacataaaacaacgaaggaatgagggaaaagtaccaaagtctattctccacccactagaaaccccaatgcaattgatctggcattgttggctttggactctggcattgtaatagaactcaacttgtgatatggtttggctgtgttcccacccaaatctcatcttgaattgtagctcctataatccccgtgtgttgtgggagggacccagtaggagatgattgaatcatgggggacagtttcccccatactattctcatggtagtgaagaagtctcatgagagctgatggttttataaggggtttcccctttcgcttgattctcattttctgtgctgcctgctgccaagtaagacgtgccttttgccttctgccgtgattgtgaggcctccccagccacgtggaactgtgagtccattaaacctctttttctttataaattacccagttgcgggtatgtttttatcagcagcgtgaaaatggactaatacaactagggtctgctttcctggcacagtaagaccagctgtctccccagagtttttgcagtggtaaaaaggaaacagtttatttgcaaggctccaagccaggaggactgggcagctaatgcttcaagcctgacctcctcaatggcttataggtaatgttctgtccaacaggttcaccttgccctctgcctagacaaacctgacttatcaagactggggaattacaatagagaaagagtaattcatgcatagccggctgagggagactggagttttattattcctcaaatcagtgcccctgagcattccaggatcagagtttttaaagacgatttggtggatgggggtgggggtgcagtgagaatggagtgctgattggttgggtcggagatgaaatcacagggagccgaagctgtcctcttgcactgagtcagttcctgggttggggccacaaggtcagatgagccactttatctgggtggtacccactgacccatcaagtgcacggtctgcaaaatacctcaagcattgatcttggtttttacaatagtggtgttatcttcaggagtaatctggggagggtcagcatcttgtagcctccagctgcatgattcctaaaccataattcctaatcttgtgcttaatttgttaagtccattttcacactgctgtcaagaactgcccaagactgggtataacggaaagaggtttcattgactcacagttcggcatagctggggaagcctcaggaaacttacaatcatggtggaaggtcaaggagaagcaaggcactctcttcacaaggtgacaggaaggagaatgaacgcaggaggaactgcccaacccttataaaaccatcagatctcatggaactcactcactatcataattcctaatcttctggttaatttgttaagtccattttcacactgctgtcaagaactgcccaagactgggtataaaggaaagaggtttcattgactcacagttcggcatagctggggaagcctcaggaaacttacaatcatggtggaaggtgaaggagaagcaaggcactctcttcacaaggtgacaggaaggagaatgaacgcaggaggaactgcccaacccttataaaaccatcagatctcatgggaactcgctcactatcacgagaacagcatggggaaactgcctgcgtgattcagtcacctccacctggtctctcctttgacacgtggggatgatggggattataattcaagatgagttttgggtggcgacacaaagcctaaccgtatcacctacaaatgcagtctagttcccaggcaagaagggagtttgttttgggaaaaggctgttatcgtctttgttttaaatgataaagtaagttcctcccatagttagttcagcctatgcccagtaatgaacaaggacagcttggaggttagaagcaagatggagttgattaggtcagatctctttcactgtctcttataattttgcaatggcgatttcagtgcaggtttttaaaggcaggggtaaatttcagtcaagcagaagttacaggcaaaattgtaaatcaatacattgagattacatatcaattttggcctaaaagggctgcatacgttgaagctggggctcacaggtcataggtagattgaaagattttctaatttgcaattggttaaggaagagaagctttgtttaaaaatcgggggtcaaggccaggtgcagtggctcacgcgtataatcccagcaccctgggaggccgaagtgggcagattgcttgaggccaagagttggagaccagcctggccaacatggcgagacccccgtctctactaaaattacaaaaattagccgcgtgtggtggcgcctgcctgtacttccagctactcgggagactgaggcaggagaattgcttgaactcgggagaggggggttgcagtgagccaagattgtgccactgcactccagcctgggcgacaaagcaagactctgcctcaaataaataaataaataaaaataataaaaatcgggggtcagcagaaaagaatggcatccctggcccatgggtgtgactccctccaggcctctctggaagacacttagaacaaggaaagatggtcagaattcagtccttagtcttcctttatctgacgtctatatgccagtggatccatttggtagggtcctgggtttctgaaaaacaactcagacatatatgctaagatgtttatcttcagtttctatagaaaacaaaacatctccagattctaacttccttggctattgttttaggctactattaccttcttactgataagttgcttattgacttttcaaggctagctaggtgcctagaatttcctttgagggaactcaagattttcctttatttccatgcttggggtgggggtctcccacagaccccaaaagggagtccctgtgttactggtggaaggtgtccaggttcttggtgttttgaacaaagaattggacaaaatgcacacacaaacaaaataagcgaggaaagaatgaagcaacaaaagcagaaatttattgaaaatgaaagtacactccatagggtgggagtgtgcctgagcataggggctcaggagccccaatacagaattttctgaggtttaaataccctctagaggtttcccgttggctacttggtgtacaccctatgtaaatgaagtagtggcccacaattagtctgattggtcgcagaaagcttttgcagttgctttctgcgaccaatcagatatactttcaatttctcatgtgacacacagaaaaggaggagggtttgcaaagggagtagcctccagtccttttgttacttatgtgtggaaagttggggtttttcttttgatttagttctaggaagttggccctaggttccctgcctccagaccatattctcctgcctcacctgatccatctcagcattagtaatttttttttttttttttttgagacagagtcttgctctgtcacccaggctggagtgcagtggcgagatctgggttcactgcagtctccgcctccggggttcaagtgaagtgattctcctgcctcagcctcctgagtagctgggactacaggcgcccgccaccatgcccggcaaattttgtttttgtatttttagtagagactgggtttcactgtgttagccaggatggtctcaacctcctgatctcgtgatctgcccgcctcggcctaccaaagtgctggaattacaggtgtgagccaccgcgcctagccgagcattggcaatttttaaagctttgcacctgattgtgataagcagggacggttaggaaccgccaggcctgttcccctctctcatttcacaattctccaaggattagtctggctgaaaggtacagaaacccatccaagcttatgtaagcacaaaacaaacaattactggaaggacagtggagtctcctgaagccctagggcattacattcatttcccagagctgcctaacaaattggtgcaaactggatggcttaagcaacagaaatgtattctctctcggttctggatgtattctctttcggttctggaggccagacatccaaaatcgaggtgtcaacagggccttgttccctgctaaggctctagaggagactcctttgcctcttagcttctggtagtgttagtgaagtagtgttgttgactggggtaaatacccaaggttcgttgtctctctccaagcagattaaggacacagacactgacatacagaggagtgagtttaggagtggaggtttaataggcaaaagaaagagaaaagggaacagctctctcggtctctctcgagaagtccctgaatgggaattccggcctgtggcagactgcaccaaattttatagacaagcttgaggaggtggtgtctgatttacatagggcccacagattggttggagcaggtgtgacgtttgcatagtgcatgggaaggctggccaccccaccctaatcttatcatgcaaatgaactttccacttgggcggcgccatgttgtcttctccttactgtacacatggctggcaaagagaagggagcgtggagccgccattttgaacatacctagaccaggtggccttttcctatgggcacagctgccagcattcacccgtgtaagcttccagctcccttgactatgtctacagctcgattttactggctgctccttgttagaaaagaaaatgatttgggggttgcttttcattaaaaggaaaaccttaccgaggacttccttaccctatctgcctaaataatttcttcttcactcctgtatcattagcagtagcaaatccatacgagtctgaagcaacttgatacttgcctcctcagaggaaataattccaccagcgggcataaggcagagtgagagaccgaggcaagttttagagaaggagcaaaagtttattaacaagttttagagcaggaatgaaaggcagtaaaggacacttggaagacggccaagtgggtgatttgagagatccaagtgcaccgcttgacctttgatttggggttttatatgttggcatgttccggggttttatatgttggcatattccagggttttatgtctctcctcccttcattttccctcagggcaggttgtgcgcatgcgcagtggcctgccagcgcttgggagaggctgcaaacacagtgtatttacagaagtcatgggcctgattatttgagatgtttttccctcaccagttgagtgttcctagaggaaggtcatataccagttagactccgccattttgcctcttaatgtgcatgcttgagcccagttgcccaactcctgagatctcatcgggaaaccgctgataacttcaggtgttttctgtctgttgggagatggcctttccctggcaccagctgtgaccaattattattttagagagacaattttaacaactgcctgacatcacctgatggttgcctggcattccttgggggggaaatcccctctcctttcttgctcatggctgcctggctacctactctaacagtaacacacacaattcttggcattgcttgccttctggttgcaccacttcaatctctgcctccatcttcacgtgaccctgtgtgtgtctgtgtgtcttctcttctcctctttttttttttttttttctaaaagacagggtctggctgtgttgcccaggctggtctagaactcccaggcttaagtgatcctcctgcttcagcctcccaagtagctgggattacaggttcaggccaccatgcttgggtctctttcctcttctcataaggacacaagtcattgggtttagggtccatgctaataagtatgacctcattttagcttaactattataattacatgtgcaaagcaacttacaaattactttggaaatagagtatttccaaatagaagagatataaactggggaaaactatttccaaatagggcacacatgaactttgggggtgccttagtctctgtggcttgctctagaccgggggcttgtaaacaacatttattacagttctggaggctgggaggtgcaagatcaaggtgttggcagatacagtgcctggtgacggcctgttccttatagatggtaccttctcactgtgcctttgtgtggtggaaggggcaaacaagctcccttgggtctcttttataagggcactaattccattcatgagggttctaccttcataatctactcacttcccaaaggcctcatttcttaatactatgaccatggaggttaggatttcagtgggtggcacctgtaggcaagtggaagatgatgggaaaggtatgtggcacacacgcacgtgagcagcattggccaatgacttggagacttgggctagtcataggtctgtgagctgacgcaggccacttgtgtgagtaggtggtttctcctgggagttgctgcagctgaggctggggaatgcctctattggtgagtgacagaacacatggatgaatggcttggagacagaggtttgcagatgttgggggcccagccagttgttgggtgattctggctaagatctagagagcagtggagggcacttgggaatgtcagagtgctgtcaatggttatttggagagtaaagtcacaccacgagctcctgagtgagcaggggtcctggtgagtcgatgggtgttggtgcgtgcttggagagggcagggagcggctctgcggtgctgacgagtgatttggggaatcagacccaacccacaagatttaccacggcaggagcagtgacaccatcatccaatgcaccaatggctgggaatggggagcggctggcaagcctattgcccttcttcgtgcagtggtggactcctggttaatgagagaaaccaactttctgtcctatccaaatattatgttctccttacccctggttctgcttccagatccagaaaaaatgatcaacgtcagtcgtgggcaggcagacaagctgtcccacattttttattctgaagggatttgagcagaaagagcccaagtgggtttaagtttttgcctcttaattttctcaaacctcatcttcagccctctctcttttttttattttttctctttggcatcctagcacttggtgtttgggacagggttagtgtcattggcatggatgattttcttctgataaattggtttaccttcaccaaagggaaaaaaacaactagttccctcccagcacccctatctgagcctctcctcaccccctgcctttgcagaagaccctggctttgtcatgaccatttactgaaggctctcagccaaggccaagcactccactaagccatttactaacactactgcatttcaaaattgtatgcaatttagtatgcaggatgtgcaggtttattacataggtaaacgtgggccatggtggcttgctgcacctgtcagcccgacacataggtattaagcccagcatgcattagctatttttcctgatgctctccctccccacactcaccctgccctctcaatttttttttttttttttaagagacagggtctttctctgttacccaggctggagtgcaatggtgcaatcataactcactgcagcctagaactcctgggctcaagagatccacccacctcagcctcccaagtagctgagactacaggaacactccatcacatgtggctaatttacagagaaaatttttgtagacataggagggtctcactatgttgcccaggctggtcttgaactcctggcctcaagtgatcctcctgccttggtctcccaaagtgctgggattacaggtggcaggcactatgcccagcccattactcccattttaagcctcactgtgtattttacagatgagaaaactgaagcttgaagaggtcaagttgcttctccaagttcatccagagggtggaagggcagagtcaggtctccaatcaatcctggccgctcagctcaagtgcttttttttttttttttgagacagagtctcgctctatcacccaggctagagtgcagtggtgcgatctcagctcactgcaagctccacctcccgggttcatgtcattctcctgcctcagcctcccgagtagctgggactacaggcacccgccaccacacccggcgaattttttgtatttagtagagacggggttccaccctgttagccaggatggtctcgatctcctgacctcgtgatccgcccaccttggcctcccaaagtgctgggattacaggtgtgagccaccgcacccggccagctcaagtgcttttagtggtcaccctctcatctgtctctctgtaattttttgttttttttttctttcttgaaatgaagtctcattctgttgcccaggctggagtgcagtggcgcagtctcagctcactgcaacctccgcctcccaggttcaagcaattctcccgcctcccgaggtggtggctgacagcctcccgagtagctggaattccaggtgtgtgccaccacgcctggctaatttttgtatttttggtagagatggggttgtttcaccatgttgaccaggctggtctgaaactcctgacctcaagtgatccgcccacctcagcctcccaaaatgctcatctgtctccttgttgatgtcttctttccagaaaaagaaaaaaccaaactgcagaagcagagagaggatgagctaatccagaagatccacaaactggtgcagaagagagacttcctggtggacgatgcggaggtcgagcggttaaggtgagtgcactgcgggtacccgatcactgggctgcaggacagcaaccttctgcttccttccagaacccatcttctgctcctgggactcacagccttgcctaacaggcatggccttgatccacagtctctggacactgaatcccaaggaaccccagccttctggcttgagaattcattttgtatataagagaatttcaaatctgtgcctcttgagggaatgttgttccaggaagtgaccagggaggagtcacatcccataatacatggcagagcttccttcacatcctgtcactcctgaaggcaatgtcttgaaacttctgctatcagtttctaccgaaactctgccacctgaactgacttgctcccaacctctgtcctcccaacctcccagctttgttctcccctttcccttccccttagtggcgccaatgcccttttctaagtatcagggtcttctctttgcatctgctgccttgacctcgacaaccacagccctggagctgcagtgtaaaaacatgttgtaaatgttgaaaatgtggaaagctgtacatgttggttcttgatttttgtttccttacaccagagcaaagcttttagggcctttcacaaggaaaaaggcccttccaacccagagggcaacttgctctttattgtctgtgttctcagagacctttcttcaagggtcctgggactagcagttccactgcccttcttcatgctgcaatggacttctggttaatgagagaaaccaacttttccctcctatccaaatattatattctatggtcgggtacagtggctgacgcctgtaatcccagcgcttctgggaggccaaggtgggtggatcacctgaggtcaggagttcaagaccagcctgggcaacatggtgaaaccccgtctctactaaaactacagaaattagccgggcgtggtggtgcatgcctgtaatcccagctacttgggaggctgaggcaggaaacaatcatttgaacccaggaggcagaggttgcagtgagccaagattgcaccaatgcactctagcctgggtgacagagtgagattccatctcaaaaacaaaacaaaacaaaaaatacagaaaactacaacaaatattatattctccttacctccggttctgcttccagatctagaagaaattatcaatgccagtcttgggcaggcagacaagctgccccaacatagtgagacccccctatctctacaatttttttttttaattaactaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctcttcaaggcagttcagcaagtctgcacccacctactttatcttggtgatccttggaagagctggggtgactcgctctctgagacctgcctcatactttgtgggagcacaggtgaatagggtggcttcaaaatacaaggtcaggagaggtgctgcctcactcactgaccccccagcagggtcctgtaatgtccctgcctctgccctggggtcacatacctacctctgggtaagcatttaccccatcattgatatgtgtctctggttcagagcaggttcaccagatacaacatatacatactgtacacgcataacacgtgacaacatacatgccccatccacaaagcctgttgcttaacctattggtttatttcattggttccttgatgctttccttgcttgctgtgtatcttcttttcttttacccatctactttcacagggagcaagaagaagacaaggaaatggctgatttcctgagaatcaagttaaaacctctagacaaagtaaccaaatctccagccagtgagtatatacattattcattcccctcccccacaaaagagaaaagtatatttcaggccaggcccacagtggatcacgcctgtaatcccagcactatgagaggccaaggtgggtggatcacctgaggtcaggagttcgagaccagcctggtcaacatggtgaaaccccgtatctaccaaaaatataaaaattagctgggcacggtggcacacacctgaaatcccagctactcgagaggctgaggcaggagaattgcttgaacccgggaggtgggggttgcagtgagctgagattgggccactgcactccagcctgggtgacagggtaagactttgtctcaaaaaaaaaaaaaaaaaaaaaggccatttcagagaagtctgggagccataaggggcgcaacaaaatgctttctagagatcagatctagagatcagatttcagcatgggatgacagcaggcaggaccagcctcacgggcctgcaggcagttgcctggggcctcatgcctgaccagcctcatgggcctgtaggcagttgcctggggcctcatgcctagaagggtgccatgcttggtttaatgttctcctgttgctgtctagaaattgttaatacgtttggaacatggggccctacattttcatattggattgaactctgcaaactacgtacctggtcctggtagttgttcctccctaattgcaaagtttggtgcatttcatagaaagaattgggtagctactgaggctcagggagctctggcctctcttaggtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtcaagaaactgtcttttctttgttgacccagcgtttctcaaatgtgtttaactgctgtattagtgaggcctctttcagttagaagaaatggatgcctggctgggcgcggtggctcacgcctgtaatgccagcactttgggaggccgaggcgggcggatcacaggtcaggagatcgacaccatcctggctaacacggtgaagccccgtctctactaaaaatacaaaaaattagccgggcttggtggtgggcgcctgtattcccagctactcgggaagctgaggcaggagaatggcgtgaactggggaggcggagcttgcagtgagccgagatcacaccactacactccagcctgggtgacacagcaagactccatctcaaaaaaaaaaaaaagaaagaaagaaaagaaatggatgcccaattcaaactggtctaagcaaaaaaaggaatttgttggagaaagagcaacaagaactagagcctcaaggactgaacactattacctcccctccttttcttctttttctcatctctgcctctctttgcatgtaagcatcattttttcctacaacacaggccttctccatgggaccagaaccctagaaccatagcttagcaactctgaagcaataccacaggttcttttccctggtatcgaaatacataagtctcagggaaatattctcacccgcccttctgggattatgttcccacctcttagatccattaccatcaccaagaggctgggggtactgggattggccaggaatgtataacatgcccactcctgcagccacagggacatgagctgttagaggaagagggacttgaaatcttgctgggaagacaaaaaccaaaagctgccactgtctataaaactacaaacccagttttcattaacatcctgtgaaagatggttggagggagtaaggaaagagaagggcaatgatctcttctgctggctcctataaccacaaggcacgtgatcactgccgaaggccagcatcctcagtggaccctttcatgaaaggcaaggtagaaaaactccacttagcagcatggaggaggagcaaggaaacttgccttctctattggattatgggtggaaaaaagaaatgattctggcgagaaatcaaaacaccaagcatgcaccacatgcaaggggccaactttacactactcatctggtactggaattccaagttgaaaaataaaaactattgtaaaaccagtgaaatctctgggatcctagcagatttagcaaatgcaaaactgctcagtagggattcttctggatcccatggtatacagtattctcacagaaaaaagcaacccccttgaagatgagccctcaataaaaatgaaaaacccggccgggcacagtggcttatgtctgtaatcccagcactttgggaggccaaggtgggcagatcatgaggtcaggagctcgagaccagcctgaccaatatggtgaaaccttgtctctgctaaaagtacaaaaattagccaggcatggtggcgcacacctgtaatcccagctactcaggaggctgagcaggagaatcgcttgaacccaggatgcggaggttgcagtgagccaagatcacaccactgcactccagcctgggtgacagagcgagactccatctcaagaaaagaaaagaaaagaaaaacccatgaagaactgaatcaccatgaggagaatcagtagatgcaccaaagagaatgtcctcccaagaaccaaaaatatagaactatttaaaaaggaaaataaactaagtacttttaaatgatcaaagagctaagagaaggaataaaacccaaaatgaaatagtaagatgctatgaaaaaagaataagtagacatgcaaaaaactggccttctgaaatttttttttatcaataaagtaaaaactcaatggattaaatacagagacacagctgaagggagaatttatacattggaagacagccctgagaaagttacacagaatgcagcacaaagagaaaaagagatgagaaatatgaaagagaagttataaaaccgagaggatagagtgagaaggtccaacttacatgtgataggcattctaggagataaaacagagaatgggaggtggaggtatctgaaaagacaatgtatgagcattttcaaaaattgaaaaatatgagccctcagattgaagtgacttgaacaaaatttcccatttatctatttaccaaatacttcttggatgtcaggccctgtgctaggcttggcaggtacaatgatgataacagctgactaggagaagggctgaaagttagggttggaagctgagcattgaggaccatataaaatgaggactataaaatgaggaccagctgaggatcatatgaaatgtgcatcagctctccataccacctgaacaaggcctggaacaagacctggccaggggttgcagtggggctgggctgcagatggtcagggctctgctcacctcacctctctctctctgttcctttctccccctctccctgtgcccacatcttgctgcaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatcatgccaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctacttgggaggctaaggcaggagaatcacttgaacccaggaggcagacgttgcggtgagccgagatcgtgccattgcactccagcctgggtgacagagcaagactccatctcaaaaaaaaacaaaaaaagtgtcttgggccaggcgctgaggcgggaggattgcttgagtccaggagttcgagaccagcctgggcaacatggcaaaaccctgtctctactaaaaatacaaatagctgggcatatgcggtggcgcgggcctgtgatcccagctacttgggaggtgggaggattgctggagcctgggaggttccagctgcagtgagccatgatcacaccactgtattccagcctgggcaacagagcaagatcgcaccccctggaaaaaaaaaatagtgtcttgataaacatctagggggataaggtttcatctgaattttttattttttccttaagataaactcctagaagtaaaattattgggccattcataagtagcattttcaaaatatttgtaaattggctgggtgcggtggctcgcatctgtaatcccagcacgtcgggaggcagaggcaggctgatcacttgaggccaggagttcgcgaccagcctggccaatacagagaaaccccatctctaccaaaaaatacaaaaattagctgggtgtggtgacttgtgcctgtaatcccagctactcaagaagctgaggcaggagaatctcttgaacatgggaagcagaggttacactgagctgagattgcgccactgcactccagcctgggtgacacagcgagacttcgtctcgaaaaaaaaaaaaaaatttgtagatcaaaaggtctttggttggacaggccctcccagcaggctgctagaccccagtcctcccactctgcgtgttcgcggctttggtctgcacaccacttcccaccattctgatgctgaaaagggtcccttgggctactcagtgccaccacaatggcctcagaggaccccgtgtcctccttcaccaacctagaccaatcatgaagccagactcttcgtgtactggggatgccataatgaatgaccttctactgggtgacttaaaacagtggaaccgtctcctttcacagtcctaaaggccagaagcctgaaatcaacctgtctgcggtgctctgctccctctgtggggaagaatcttcttttgcctcttgcagctcctggtggctcctggcaccttggcagttccctggctgcaccactccagtcttcacctctgtctccacgtggccgcctccgctgtatatgtgcctctgtgcaccctctcatcttaaaaagacaccagtcattggagtgagggccacccgaatgcagtatgatctcatttggaccctttccttaattacttctgcaaaaaccctctttccaaccaaggtcacattctgaggctccacgtagacatgcatttggggaggacccaattccacccaccacagacccctcccgctccaacgtgcagtgaaaactcaggctgcaaagggcccaccgccctcttttccccataaaaaatgtgggtcaaggctgggcactgtggatcatgcctgtaatcccagcactttgggaggccgaggtgggaggctcacttgaggtcaggagctcatgaccaacttggctaacatggtgaaaccccatgtctactaaaaatacaaaaattagcaagtgtggtggcacatgcttgtaatcccagctactcgggaggctaaggcaggagaatcggttgaaaccaggaggcggaggttgcaaagagccgagatcgcaccattgcactccagcctgggcaacagagtgagactccatctcggaaaaaaaaaagggggggcttggggggtccgggcgtggtggctcaagcctgtaatcccagcactttgggaggccgaggcgggcggatcacgagttcaggagatcgagaccatcctggctaacacggtgaaaccccatctctactacaaatacaaaaaattagccgggcgtggtggtggacgcctgtagtcccagctactcaggaggctgaggcaggaaaatggcgtgaacccgggaggcggagcttgcagtgagcagagcttgcggtgagcagagattgtgccactgcactccagcctgggcgacagagcgagactccatctcaaaaaaaaaggggagaggggagtgggggggtcagcgaggtctgacctcaggccagttatacagcagtcactcacagatccaacgaaccagaggagatcaaaccctcatcaaaatcctgcctctggtacttccgctaagctctgggtacacctactgtatgttcctgtaattcctactgatttttttaaaaaaagaaaacattaaaaaatccaatttatttaagctgtcacagacgcttccagattaccagggccaccttccaagctgggaaaccttgcagactgtggggtcctgcacacctagacttgctccttttagaagccatggaggaggttgataatgggaataacatttattgtagcttatctctatgccttgagcaatgtgctcacactggctggttccctcctcacatcagcctgatgagtcagatcctgttattacttctcactttacagatgaggaagtagcagtaaatccattacccttttcaagcggaggttgcaagaggttgcaagcggaggcagaataaacacttgaaacagtgagtcagatcctgttatcacttctcactttacagatgaggaagtggcagtaaatccactgcccacggtcccaggggttgttagtgacagagtcatcattcatctccctccctccccaccactgtagccccaattgttctttctcttcccatcggagggatttaaacaggtctctcccatttaaaagcaaacagggctggacacggtggctcacgcctgtaatcccagcactttgggaggccgaggcgggcaaatcacgagatcaggagattgagaccatcctggctaacatggtgaaaacccatctgtactaaaaatacaaaaaaattacctgggcatggtggtgggcgcctgtggtcccagctacttgggaggctgaggcaggagaatcgcttgaacctgggaggcagaggttgcagtgagccgagattgcgccactgcactccagtctggagacacagcaagactttgtctcaaaacacacacacacacacacacacacacacacacacaacacaacacaacaacaacaacaacaaaaaaagtgtcctcttccttttagagaatttaaaaaacagggtgaaaccccatgtctactaaaaatacaaaaattagcaagtgtggtggcacatgcttgtaatcccagctacccggaaggctaaggcaggagaatcggttgaaaccaggaggcggaggttgcaaagagccgagatcgcaccattgcactccagcctgggcaacagagtgagactccatctcggaaaaaaaaagtgggggcttgggggttccgggcatggttgactgtgtgactatattatatctatacataatatatagatatatatctatatataatatatagatatctatatattatatatagatatatatctctattatatataatagatatatctatttatatatagatattatagagacatctatatctatatctatatataatatctatattatattacgcctgtaatccccgcactttgggaggccgaggcaagtgaaccacttgaggccaggagtttgagacgagccagagcaacatggcaaaaccccgtctcaaaaaaaattagccaggtgtggtggcagcatctgtaatcccagctgttcggaggctgaggcatgagaatcgcttgaacccggtaggaggttgcagtgagccgagatcgtgccactgcaccccagtctgggcgatagagtgagactctgtctcaaaaaaaaaaaaaatgtatttcctgattcttgccacacctgcccttgatgcatcagactctggctgctgaaataccaagggcggcgaccctgcagccccagtgtggatttgtctgcacttgctgataccagaaactgcagtgggggcaggtgggtggtaggagcgggggttccctcatgcccaggccctgcacctgggaagcctttggaggccatcacatgagctgcctgaggcggatggaagagacggtgccaagcaggcccaatatgttccctgctggccctggtactgctcccctgcggatgctcctggttggttcaccacctcgtgcggagtgaggagctgagcagcccagccactgagcaggatttccctctaagaacggccccttccaccctgcaatgccttcttcctctgcacctcagctcccccacttccaaggcgttccttcccggaacgtgtgtattcttctcttcatcttgctaaggaaagttctggctcttggtgctctggcttggcaccttctaagctctctagcccttttccccccgccccccccccccccaaaaaaaagcgttctcagccaggcgtggtggctcatgcctgtaattccagcactttgggaggctgagcccagaggatcacttgagctcaggagttcaaaactagcctggccaacatggtgaaacctcatctctactaaaaatacaaaaatttgccagtgtgatggtgcacatatgtaatcccagctactcgggaggctgagacaggacaatcgcttgaacctgggaggtggaggttgcagtgagctgagattatgccactgcactccagcctgggtgacagagtgagactgtctcaaaaaaccaaaaaacaaaacaaaaaaccactcaggcttagccatttctctggggtcttcatttccttatgaagactctcgcaaaactggtatgaagtaaaatttgtttgcttttttcctattaatgtctttgtcagtttaaggcccagccagggacactaggagaattgaggaagttttgccgcccaccgcccccccccccagcaatggggacagcaggtgggtggaggccgctgagggcttctgcgccatgactcaccctctgcccatggaagcagctagaaagtgaaggtgaatcccaaagcgcaacgctccttctggcaaagggaacagagagggaacagatcttcttcaatcagcgcagccccctctgctacggacaggtctgctctcccccagacagctgtcttctaggcccccacctctgaatcaccttcctaggtgggaaacaaacaaagataaatgcaaagccaccgttccagccccagtccacacctaacaagacctcctgacgccgctcaaaaggggcacgatggctactcaactttttctgcacaaatttgccatcgtgaaatgtttggaaaggtctttagcagcttttaacattgctgaacttgaaaaaaatgtcatcaagaagcaatttactcaagtctcttctgggtccttttaaattcttgccagagggtgctggtggcaggggtgacggggtaatggcggtctcaggggatgggagggcttcacaactgtatctgtggaataactcttttccaaattggcttattcaaaaagcatgcttagcagtgaccaaaaacgagacagcgggcacgctggatttctttcacaagaagagagagcctaggaattaatagagttttctaactggaaggtttttgtggttactgtattttcccacatgtaattataagctggaacaaaggctggaaaacttggaggatcctgacgacgaagggcccaccatccagccacctgcttcggcgtgtgctgagtttaaaaggcctctaagatgtagacggatttactctccacctcacaattctatttccagaaggggagagaagttgaggagacccaaaatgaaagatggcagaactgtattggtttgtaattcctccccacagacagacagacagacaaaaccactcacttgggaaactcaaaatagatgctcgcttgtaaagtttattgacaactgtttggtcccaacacacaaaacagcacttgaaccacaacaaaagtgttcaaacaaagtagacaactaagaaaaacatctctttcccccaaacccaatccaaaacaaacagtgcaagatgggaaagggggttttggtgataacttttgtcatttttttaaacagataaatttaatccggtatatctttccacccagaaataaagaattacattgtcttaatgctcaaacatcattttaccacatcatttaattaagcctctggataaaaaaatagatagcaattggactggccattgtggagtacattatgaacacaatgtgcttccgaagtcttctctctcattttcagacagcaattgttaagagtcacacacacgtcccagacctaagcagcaactccagtgaatggtactcagacacactcacgggacagcacagaacttgattcttctttgtctgttgcccaaagaacctgttctttgagtctgttccaggtgacttgtaatgatacctcttacggttttaaagtccaccactctttacatgctagcagaactgaagtccaagcgtgcaaactcagccttatgaaatcttagaataaggcaactgatgttctcaacaccaattattattactttgtttaaaagctcctttaaaaaaaattgcacatttgcatttcacttcctgtaacactatgtctgtagaggaaatgccttcaggaggattcggagagtgccataatacttacagggttttttccatggtgttctgtcttgactggggccatgtgttgagaactgggagtcactggcttcatttaaaagatttggggaacaaaaaatctgacttgtaaaaatctctctatagcccttattttgtggcattttatcaaaatgctatgaaatcagagtccattttctggctttctagaagttaccaaatataaacatttccccaaaagaaaccatctaactagtggaagaccttacgccaacaggttctttctgctctatgaatgaatccgccttttttgccggacaaatacaatccattgtaaatgtcaggtttctctagaggggggtgagaggccacccgtcagcggacacctcaggcacctagagaggaaggccattccacaccagacgccacaagaaacccagagatgcttccaacagcgagaagtaacgagagtaaaatcagacacgattaaaagatgctgagctgacatacacacacataaagcttcccagctaccgataccagctttaaaattacaataacaaggttaagtggatcaaccttggccttcctatgtgtaggtagaattcctgtctcttcccagtggaaatcgtattgatcccgctgctgctgaagcacctccccactcagctctgatttgtaatttatgcacttgatgcatattttagaaaatcaggctctttccaatgctgcctctcgacacacaataatgtgtgttgtaatccaaatgctgactttaaatccatgacatcgagaccatctccttttccttaacctaacccatatcaaactggaacacagaagggaagcttcaaacatcctcaactttctagaaagctcctaaatggaaccccaaagtagaaacgtttaaaaaaatttgtgatgaagccacttttgtcaactacagacatagtttaaataaaaaacaaggcacacttacaagtcacatggaagccaggaaccttcacattccaacctgaaaatacactccgaacccctcgcctacccttctcctttggtgtgtgaacacacaggctagcgggacaggctttgcttcaaagacatgccacgcactgggttaatactgtcggaaacaccagtaagcaaaggctgagagactctattatgctacatgtaggatgacaccaccgacgtggctcaatggaagcaaaaccgcttcctgctagttgagtttttagtgctttcttcttttggaacaccattgtatttcataatagttactaaaaatttggtaaaatatattaaggattctttaacaaatgccacaagttcttcaaataattgaaaaaagaaagaaaaaggaagaagaaaagaaagacttcagctcaaagctgtgttcaatggaaaagaaaaacatgatagaacacaggtaagatgaagtcaatggcttcggggggttttcatgacacagaaaaggatgtatttttgaaacccacttttgtgtgcagaatcagacagtgttttcccatcctaattctatattccaaatgggagttaaagcttggttataggtgctaaggaaaagttggctgccaatttgactctatttttgggttgctttttggccgggctttccacggggtccttgctgagcagtgactcggaggtttccgaggaggggcagggaggcacggggacagctgctgagatgcaggacgagctggagtcagaggtcagagttttgctctttcctggtattggaatctccattttttcttcttggtttaaaatcataatttctgtaaacacagaaaagcaaacagattcagatccaggaactgtaagaagtgtgggttttctcttccttgctcatattttctcaaaagataataatagtaataaaaagcttctaaatgctacatctatgccacagtttacatatgagttgtgtggccagtgaacttggcacagaaatcaagtatctataaactgcatcccacctctcccactggattacaaagttggaaagatctctattttgagctataaatgaatgagcaaaggttaaaactttttgtttttccattttggattctctgcccattcattctgcctgccagatattaaggacccataaagctatccacgacttagagacttcctgaggcgggaggccgtgggtggtagggggtggggtcggagcatctgggtgtcagggagctcctggcctgctccatttagagaggacctatgctccccatgggtctattaccggggataaggaaggactacgcagagtgagaattaccctcagaacccaggaagttgagcacagccagctttcccacagtgcttctggactgccatttctgtggctgagccacatgtaattcacctgctctacacacagggccacgctgcttgaaagagatgcatcattatgccttagactcccactgcatagggcacagggctcctgctcccaaaggcccatggaaggtgagagtggcagaggggacagcagagccagctccctgcctaggctgaccctcaagagaagagcggctgacagaactgcccacagtgttttaattattttcctctcttgtccggtgcatgcagttgaacttgcccagactgaaggcacaaaggccacaaccccacaaacgagctaacatcaatgtgccaccaaccctaggggggcactgcacaggagcagggcatggtctaggtctgactgcacaggctggttctatccgcaggcagttacttccccatctcctattttccaagtcaacagcctcagttcttttcctgggcaacagtgctgaacgctgccaagaacaaccaagatggtaaaagccaagccaggagtccacgggttgttcctggtgacctggaaagcagcaccagcagtggggaggagttgggttccaacagatgaagagcagggagggatctgtacagggcagatgggccatcctctccagaggccaggagacaccgcaggacaagagggcttgggttccaatgccggctctgcccttgctagcccagcagcccggggccactgcctctctagtgacggcaccagctgtgccttagtcacgcagcctgtggaataaagcagctgcctttattccacggctctcacctggagccgtggtaagagttaaatgtgatggtgtctgtcagccctgagcacagggtcagtgccaatgcctgcactaggctgggactcagtgtgctcagcttcctgtctgttatatcactgggcagagtccggggctccagccacagacacctccctccattcacccctttataaagcccttgggccctctggacccccaccatgggtgacgtgtacatctggtgacaggtgtgcctgagagcagctgaaccttcacaaagtctgggagagcagaagcccaggaggccccacccacccctgtggactcgcccacagccccgagccaccagccctccagagctgccaaatcgcccttgcctgatgctcgccaggcaacctcaggctgtgcatcccattctgcaggaacccaggtggggaaagaaggtcgaataatcagcacagtgttttccacctgaaaaggggtagtcccttcccacctccgtcatttactatatcagtatctcatcgtggttttgttttaaaccccgaagaaaatccccatgacaacatggagtcacccaccagaaggctcttgagggcgctcctcaaactgaatgagatcagcagattggaggataacggggtctggtctcagctgaggggacggcaggcacgaggggacaggcgcacacaggaggtcgacgggggagtcgtcggtcaggcggagaagctcctgctctgtgtgactgggccctgggcaaacaaggagggccgtgacaccacaggacctccacgcccacccccagcacacaccctgggctcacacctgaagttttccttctaagccttaaagataagagagtcaagaagtatttaaggtattaaaaaaaaaaaaaaaaaaaaacaaaaacccaaaacccactaacaggaagatcctggtaatggaacgccttaataagctagttcttctgaagatccgtgttcttaggaacactggcccctcaaaagacccaaccagagaaaagggtcctgcagtcagcttccaaagagaagggacagcctgagacggggtgtacgtagttaacagcaagtggaagctcagaatccgaagccctgggcctggttccgtggcttcctagctgctgactctgggtgagctgtaatacgtgactgcctgagatttccgagcctccgctgcacaacggaggtcagcactgctgaaggctgtggggcagcttcggcagatgattcccaggagggcgcttcataaaacgtcaaatgctgtgtaactcagttatcctaagggcacaggggacggtaacgtgctatctcgccgcatgttatgaagacaaaattctcacctataacgatgaattcaaaagtccttcagaaaagttagaactgctataacattccaagaattggcctctatctactacagaggtggatctatctgaaatctatgtgactcagtgtaattttgggtaatattaatgcattagtatatcaaatcctgcctagggctgtcctgtgacaaagacgccttgaccagccatgagtcaggcaccctgagccctcttccggatcaggcctgaccttggccttccatgtctgttgctgaacttgccggctcgctctagagtcttagcttgagtcagtttagtgagaatcccctcacccttcacagctgatcgaattccttattcccaaccactgatgtctagatccttggctggcctgcatgcctatagcaagaatcctcttagtaattttccacccactgagccctcactctgctcctaggctatgtattgggagttggctctctctcccctgttgcaagtgtcatgaatatccattataataagtgtcggaataatttttttcttcaacatctgaactggggtaagatgatcattatgggggtgccaacatccttcagggactttaaccagtcaaccatgcaatgctaacagataaaggtcaattttatcctgttactaactaaataccaaaactgctttgaaaaatgtgtggctatgtaacttcagcagattggatgacttgctggagtcctttccctcgctctccccgaccccaaagccgtttctcctagaatttcacaagctcctatgtctctgcttttcctctcttaccactgccgtcagctccaagcttgagttccgaggctgtgtgcgattcgggcacctccaggatgcgctcgccctccgagggctggttttcatgattggcaggggagagactgagtgaactcaaacgacctacaggacaaagagcacccgtcagagagaaatgtcagtgagagaaccgtgattttttaaggggggaggggatgggtgcttacttacttttcatgtcattttttaacactacaattctcttatgaccatgtccttttatccagaccacctgcacacaagacatactactggttaagcagcggaaaaggaggggacagaagccctaacattcaggaagagtgtgacctacggagcctgccttaggctagaatttaggagctgagttactgccaagaagcatgtttctctactctctccttagcttttaaagcaacagaagctgacagaaacatacccctataaaaagcagagtagttcaaaaatcatgagacacagtttcagaaatatcctttataattcttaaaaagactgtcttccaaacaccagctttggcatataaattaaggtagttctcacatgagagctctttgccatttttttgcagaaactgaacaaccacctaaaagaattaagagcaatctctcagaccctttaaactaagttcattatcagcatcttaaagtcctctccctgatggtgccgctctccatctcagccaagcagagtggtagtagtggagctaggctcccaggccccctacatgtgcacaccgtcgccaggtcactgatctcagctcccaggcaagctttgcctgggtccttcctacttcctctattctactatttttactctggctcaatccctccatctaacactgacccagacctctgcagtggccaggatcctagcccagttcccttctccatgcctgcttctctcggctctaccatggacagcaccactggggtgcttttcaaatgcaaacctgggctccagctctctccaacacagtcctccctccttacctggaggagccacgccctccctaaccgagctctcagctccctcttagcctctcgacactccatgccacttgtcacaaccctgcatctgctcatgtcatcatcccctttgcccagaatgctctctcccctccttgtcacgtgcttccctcaggcacatccttgaaggttttgcaacaggctccccaggcttgggaagtgggccctgacacggccctcctcagcgcgcccactgccctgaccgccctgactagttgcctgcttgggggtcttgactctcccattaaccaacacctttctagagttacagcctgaaacttactcacctggcatatagggatttaataaaggtttacagaaagaatcaaggagaaatgctaaaatcatttactttagaccaacagtatgttttgaaaggatcaattcaaaatgcctgccgttccattattctggcagcattttatttttctgttcaggacagttagcctgtggctgttcagaagatgctctcccggaagctgagaaaaatgcccacctgtggaattgctcccaagagctcctccacgctgctgtggccgtaggtcttgggctgcagagtttctccgacatacttggtataggccatggaaaactcatgaaggaaaatctgctggtagtggtaagtatgaagtaaagaccgcacattctttgcaaacaaatacagacttgtgagcttcacacattcttccatcttatcattagtgaaaacctggttaaaaagaaaacgcagcattagaaatattagtgactggccctgccccgtggaaagtgaaggcctcccactgagggaaaaggcccagagttgaagacgaagacaaagaagaaaaagaaggcaacgaagatgagaagatgaagatgaagaaggagacaaagatgacgaagaagaaggagacgacaaagataaagaagacaacaacaaagaagatgaagacaaagacgacgagacaaaaacgaagataaagacgacaaagatgaagacaaagaacaagaagacgaagacaagacgaagacgacgatgaagaagacgaagacgacgataaagaagacgaagacgacgaattggacaaagacaaagatgaagaagatgaagatgacaaaaaagacaaagaagaagaaaggaggaggaggaaggaaagaaggaagaggagaaagaaaaggaggagggatatattcaaggatttcctccaagagaaggctatagcctccagcaaacttcagttctatttgcaagtcgaaggctgcagcggtctgaagagacagtgtgtgagtagggaagaaatcgggggaggcaaactgtgttggcaaatcacggtacacacagtgaacactggggccattaaactgcacctccaaaccagttttccaagaaacactgtgataagaggatgacactagcattctttaaaaacacatcaaaagcaacaagaaacaaacacaaaacccttgtgtatgcagggtaaggaagcagatttctttaccacaaaccttttcaaagtgtttaacatgctatggaatcgccaagagaaaggatattcccaatcttagctggacagggaaagtcctttgtcctgaaatatgcattaacacctgtccagaactggtgttcttaggatagatattaacagagtttagaaaatgctggatgtatatcctttcattatttaatgatgtgtcccacagttagatgataatggcatatcattcttttaaattgctggagctcatttgttaatatcttatttaggatcattttaagggactatcttatgtttttggtattaaatttattttggcttcgtaaaaataaatggtaagctttccttttttctttttcagcagcctagaacagtattttttttcttggggatgggttcttgctatgttgcccaggctggcctcaaactcctgggctcaagtgattctctagcctcagccttcttagtagctgggattatagacgtgtaccaccttgccgggccccagaatggttttttaaaaggtagatttatctgttcttttagggttggttgaaattcaattgttatctcacttggtcctgatgcctttttcactggtatatttcagtgatcttttatagtctcttttatggtaattggtctaatttttaacttcttgagtgaattttggtaacttattttttccaggatttcatttatttactctaggtttttatatctgtcgcccgagaattgcatgcagtattctcttaagattctctcaatcttggagcgccattcttgaaaggctgcctgggggactggctggccaaccttcctttctgccctcaccttactcatctctctcttcaagccaccacataaaccatctcattcagaaagataaaacagtagcgaaatccatcctggaatgggacaaacacaccccagagccaggatcaggagaccaggctttcatcctagaacgggacaaacacaccccagtgccaggatgaggagaccaggctttcactggcttctgccacccatttaggcagggctgcttcactgcctgaggtctcggcgtgttcatccatgaaatggtctctcgggtcccttccagctctacacactctaatctagaccatcaggtaatccggaaatgcccaatcgatagttttcaatgatagttctaaagagccattaacgtgcctacctcaaccaagtatggcaggctcttcagcagttcggtcaaggtcatgaatccatattcacaggggttaaggggagtgttgtgggtactttcgtaatgtctcttgagctcctcaacagaaagatgggtggttccttcccaagacatcaacaataccagcaactgggcagtgagagatcgcagagactttcggttgatcagctgaatctgtctgccagattctatatcggcaacctggggaaaacgagaattcacacttttcagagctcaagagagacaccctaggttatacccaactcagctcacttcattttggttaatgagaccaacagatgaaaaatctctaatttttttctcttacactgaaataaagcaagtgggtttgtttttagcgtctttgggacaccagaccaacatggaagcagaaactgtcctccccctgccggtccataactgaaaactctcaacaagataataatgggggaggaaattgcatcattctctttatttttcattcattctttccaaaccccactataagaaggacacagactggccagctgatggccagtggtccaagcttgtgaagtgtgggttgctgtgctcgaaggggggtagggatggggaggctagactctaagcaacactcacatggcttctgtgcagacccgacttgcccatatgcgtccccagggcgggctggggaggtgagagagggcctactctgattacaaggcaagctgcatttttctagtctgctattactcaccacaaagctggtattttcatctgactagtaactgtccactcctcaattatttcagattctcaaggagataaagggtttaagcggttaaatgcgctgagagggaaaccttacaaaaaagacagagattgtcacttggggaccaaacaccatgtgaagaaacacgcatctggtgactgagccagcaggctgtgggtggcgagggtgaggctgtggcgtgagcctttcctggcacaaaaacaggcagagctttggcacacacacggctccggcactgctctcacaaaccaatgctcatcctgacagcttgtttgccccctttatctggttttcctgccagggccaaaggtcttggcagggctaagtcaccacaagttggcactctttggaccgtggattctgagaggcagagagaggtgggtggcacttgaggagccatcccaagaccagggcatctttatctggttctgacatgtgcccagagccaaggcaggagggaggctggcagggtcccaccctacttatcatgattatgggactgtatagatttcctcctcagaagcgggtttaatcaaccaaccgatacaagtccaggggatcccagtcatcttagccacccagacccccaccatcactacagctgcttaggaaagaaaccaaaccagagcctgctcctctggtgcgacttggatccatcccttgattctcaatcccggctatgcattagaattgcctggggagcttttaaaaacaccaatgctcagagtgtgctgggactaattctataagaatctgaaaggtaaggttggagaagctcccaggagacccagtgggcagccagggaggcaccacggagcctctctcagctctccccattcttgctgctcacaccccagctgcccacccatcacactcacccagcaaagccctaggtcatggcgtggggtcttcctatccacctgagtccacccctttcatcatcctgggcaactgaacacccagggacctgtcccacaccacagccgtatagcctttcaatgccttgcctctgtcatctccgacgacatcctcctgtgttcaatttcactgcagacacccatctccagggtcacagtgcaaacctgtcattaccccatccaacataaatcattcaaacctcctgagcatcccacttgcaaaagcaagtctggagctgctgttggggtgggagtgcagaaagagactctacccgctcaactccgccccttctcaaacctcagcagcatcactgcctcctatctgctcccaatttgccagcccactcccttgcttcactctcctcttttgtcatgctggcactgacattcttgtcaatatttaaattcgctcatcccatgccttttcctgacgcccatcggtaaactcccaccttgaatccaaccacctgctttccctgaaccgacacctgcatagccacaccccaactgctgctctcccagagtctacggtgccaacttgcagtgagctctcgatacccctgcactccacgtgacatcctgatcaagccactctccactcaccatgacaactgtggaccttctccccactcctaagtcctgagccctgcctctcctctctctctctaagcagagatcagtccctctctctagtggaaaaccactcttggaagaggactcccttctattcctgatgataaacatcagacctgcccatgcctgcccccagcctattgccctgtatacttcctccttcctctgtgtgctgtttcctagtctcccacacctcaaggccctcctgtcttaccccttctcgcccttgtatgttcatcttctctctctagacagatccacatcaatggctttcagacatgctcaagtttttccaggtaggaaaaccaacagcccaaatcctcccttgctccctcagccccacagcctctagctgctgccacagccctccatcttcacaagcagacaaaccaggatgctgtccagatgacctgggccattttctcacctctcctcactcctcaccacactccaaggtggcttctgtctacacaaccaacactgccactgacctggccagcagcaccgactcttcccactgagctaaacctggaagtcaggcagtccctctctgaccagccctcctgcgatgctgctggccattcctctgccttggctcagggatgttcggctctcctggttgtgcttcctgctctctcacctcctcctccaaccaatcagtacctaaggagagctctgagcgttcctacctctgccaaggtaagaacgtcttcttagctgcagtccaatacattaaaaaacagtgggggctgggtgcagtggctcatgcctgtaatcccagcactctgggaggctgaggtgggcggattacctgaggccaggagttcgagatcagcctggccaacacggtgaagccctgtctctactaaaaatacaaaaactagctgggcgtagtggcgggcgcctgtaatcccagctacccaggaggctgaggaagaagaatctcttgaacctgggaggcggaggttgcagtgagccaagatcgcaccactgcactctagcctgggccacagagcaagactccaactccaaaaaaaccccacagtgggaaggaaagggagagtgaacccgttctggctgtttacggaattaaatgacacagaaatgtgtgcagctagtaatgggcctgtaactgagggtgccgtccttcatgcttccctttccattccttcctcctggcagtgacttcttctggtcctgtgggggaggaggccgaaaactggcagctgctctgcctaggacaggaagggtcaagtgcagtccaggacagcaaacagcacgagctgccctctctactacagctctgccagtgacaaaggccactctgcaccctcgcttgctcctaagcctactcctaagtgggtgagaatgtggagggagaggacactgtgtgattacgggctcccaagaacgtcacaggcaaaactcacactggaaggagtcaagctcaggccagcagtgctgaggcagctgcacctcatgaccgaaccctggggtgaagagtgacctcatcagttcacaaaggcattgctttggcaaggccattcagaaacacacaagaggaagaccaaaactctcaacttccaaaccaaggcttctattacctaataagcactaatgacacaaaacgagtcataatgctgtgacagttaagtagttcaaggtgtaaataaagaaacgctacagcacacgcaaacgtcctaatgagaattaggtcactgtgagttttatcccatgagggaaaaaaaaaaaaaaaaaaaaaaacatttaccttcacgacatggcagagtttctgagttaaagccgaaatggaactgacatcatagtcttggagacgaaatgtataaccaaaagttttagcatattctgtaaggagatctgtcatcataaggcagttatctttttgggaccgaaggagtttaacaaactgggcagctagagctttgaaccgctccacctctgtcagagtaaggatcttttcttctccacattccaatacctttgaaaacacacggggggaggaaagggaaaataaacaaatcacgggtgtttacagaatagcaaaaaaagtatgcagctagtaatgaaaaaacaagtcagcgttactgaatgggtataaagtttcagttgtgtaagatgaaaaagttcagaagatcggttgcataacaatgtgaatgtgctgaccactactggacaggagatataaagatagttacgaaggtaagttctatgttatgtgtattgtgccacaataaaacaatttttaaaaagcacttcagtagtaaaaaaagaaaataaaatcaacaacagaaatttggtttaacttagcaacagcgaacagcttagcactgatgttacctcatgtactcagacctaccttcaacacgaaggattttaaaagtataaaagtaatgaacaaatattcagtgtaagaaatcagcaggtgtggtggctcacgcctgtaatcccagcactctgggaggctgagacaggcggatcaactgaggtcaggagctcaagaccagcctggccaacgtggtgaaacaccatctctactaaaaatagaaaaattagctgggcatggtggcgggcacctgtaatccccagctactcgggaggttgaggcaagtgaactgcttgaacccgcaggcggaggttgcagtgagccaagattgcgccattgcactccagcctgggcgacaagaaagaaactccgtctcaaaaaacaaaaacaaacaaacaaaaaaaagaaaacctactgaatctttttttcaataattacccccaaaacaagtttgaataatcctttattgaaggaaaaagccatatttatctaaaaatactaatgagtcaggaatatggcttctctgactggaatagcttagattttcatcctctttcgtaactccctacttcccagaaaaacaggtctggaacgtgaaaaagtatttcctatacgttgttcagaaaaatactttataaaattagaatttcttcactcacttgtaaagtatcaggtatggcttcaaaaagttcaagtagtttggtaaacccatagtacgcaagtttgcactgccggccaaagtggtgatggtaagaagggataaatttattaaagggcatccggaaatggggttggtgacgcagcaaatcaacgacatccttggagaactgttttgtcctttctatttcatcctgagtgcgttcttttaaaaaaaccaaaaaacataaaatcacagtttttttctacccatttgtgttcaacatccacactagagtaaatccttttgggaatttataaacgatatcatccttgccttccaaacacacacaacctaaaacaaacacatatactcttccctctttgcaagtggttctcaaacatgttccagggcagaacaccaggaagttatgatattattatattatgaaattcatatatattcatcttataagctagaaacaatgtcatcttataagctagaaacaattttctagcccctgccccatatctattaacatgacacacacccaggtccctgtacttaagcaagtactctagaaattattcccatgaaatcacgcttctgaatatccccactttttttgtttattcatctgatcttcagttaaaacttgctagcagaagagagaatcaggcttcaaaagttgaacaaaaataaacaggagggaaagcttaagctgagattgtttctattaatttttaagtgagaatgggccctggaattctatgatttcatggacatcaatgttctgcaggagcaccgtttaagaaccagataatagaaggaggatacgaccatacagtcaccccttggtgttctcaagggatcgggtccaggaccctgcctggataccaaaatccgcacctactcaagtcttgcggtctgccccgcggaaactgcagacacgaaaaattggcccccagtatccatgagtttcgcatccctcaaatactgtactttctacccgtaactggacctgtgcagttctgacttcaactattaaaatttgaaaggcaaaagaaaaaaaaacattcgagttgtcttcccttctcaagtgtgcacagtaaataaagtagctcagagttcaacagaagagcaaagccaacaggcacggtgacagattctcaactggatgactaaggctcatgtagccacagccaggctgcagaaggcatttgagcaaagtgctgatgatgcccctttttccccttagagtcaattctaaaaagccagcctgcttttgttcttgagaacagcttcacctactttgaagaacacagaatccaaagagcagcagttttcacactgtgctttctgtggaatcttcaggaagcacggacagggagggaaaaccacatcttccatgccacactatgttaaaataacaggagatagacaatatccttccagcaaatgttaagtcacatacctcttttggggatacaaatcaccatttcattatcttgttgggacaagcagatggttgtgtctggaatctctgatacgatgtcaatcaactcacaaacaccatattcagtgacatcccagtcctttgagaaacacctaggttttaacaacggaagtggatacggaatgagtagtatcatcggtagaagaactacaagttttccggccgggcgctggggctcacgcctgtaatcccagcactttgggaggccgaggtggacggatcacgaggtcaagagatcgcgaccatcctggctaacatggtgaaaccccgtctctactaaaaaatagaaaaaataagccgggtgtggtggcgggcgcctgtagtcccagctactctggaggctgaggcaggacaacggcataaacccgggaggcggagcttgcagtgagccaagatcgtgccactgggcgacagagcgagactccgtctcaaaaaaaaaaaaaaaaaaacaaaaaactactacaagttttccaaaagaatgcttaatagaaatactagataactatttagagtttggcagaagataaaatgtcctaaaatatttactttcatttctgttcttttcatcaactcaccagtgataagcctgtgagaattctctcacaatgacctgtttgctggcctgggatttgagaagttttagtaaatcctgagtaaagcgcttcacctgggccctgtgggtaagggtcagcagacgtttggagcccattccaagaatctgcaaagcaaatagtttatttatacacataagacctcagcagacagcgacttccttgctgctggctcaccctctcgttactagcctcagagcatgactccctttatgtagaatgtgtgcaatttgaaacacatgtcgatcaacaaaatgtagttggtcaaaaggaacaaatgtccaaggccttctgaaactcttatcgtttttggcctggcacaccttctcccaaacagtcgttgagtataaaaatgaaaagtgtaatcttttgaaaagaaaagtcgtgagtacagaaatgaaaactgtattggttgtccagacaaattggtctacaagtttttcaagccgtttttagtgagtgggaagctgttataacactgtgagttaactggtaaaagtcttcataggatccagtgctacactctagcccagtaacttgtctccaactagttaaatttagaagaaaggttaagcccttgactctcacataggcaccaacatacaagtatgtggctattcatgggagcttccttgtaatcatgaacagttctggagaaagctgtgctgggatgaagaaggtctatagagcttagagggaaaatactcctcagtcctccaaggagttcctctaaaactggaaactagcagcgttctgaaaaattgagaagccgcctgtgtgtgttattcctgccctctgaagaaagtttttagtggatgttctgcccagaactgacttcttaggaattaaactgtttctttgatggaggcagccaaagccatggaggaacattcctgcctgtaaacaagtaatcccgtgacacgccttacctgcaatacatgaggcactgcttctaataactcaatcagcttggagtatccgtagtctgacactcggcactgctttgcaaaatgatggtgataggatgggatgaaatgactgatgggtatgacacaagatggctggcttttcagcaagtcaatcacttctctactgaactggatcagctgggggttacctacaggactcttcgaacgcagaagccaagggtctagaagaaaaagaacgtgtataagacagaaagcacagatttcaccagctgaaagaagggaaaatggccctgcagtccctggcttgagttcgatcatggggaagcaaacaaaaccaaatacagtagctgctttacgtctcagtttctatattcaggtctcatagtccaataactagctaactaacttattcacgggctgtcaaatgctgtcccactaatcctcaaagttaagcggccaaggtaaagcagagtctactatagtgttatttatagcagaagtcaaagtacacaagaagctcccagtttagaaactagttatatttccaagatccttctgaaacttggtcatgtggaacgtacctttccacaaagttataaatggtcatcaggtaggtggcccagaagagcaaaattaatccatagtggagctgaaaacgttacccagaaaaccacagaaagtgataatgttgtaagattagcatgacataaaagggtgtaaggaacaggtttttgcaccatcttgactgcttatacctattaaaaaggtataagtaatcaaacggaaatctttatagaaaggtggagaggcttgctggtcgcggcggctcatgcctgtaatcccagcactttgggaggctgaggcgggcggatcacgaggtcaggagatcgagaccatcctggctaacaaggtgaaaccccgtctctactaaaaatacaaaaataaatacaaaaaaattagccgggcgtggtggcaggcacctgtagtcccagctactcaggaggctgaggaaggagaatggcatgaacccaggaggtggagcttgcagtgagcctagattgcaccactgcactccagcctgggacacagagcgagattccgtctcaataaataaataaataaataaataaataaaataaaataaaataaaataaaaagtggaggcttgtgggctcatggcttaggagaaaggaggagtggcataatctatggcccctgagaagtctaagacagagggaaaagaaaggaggtgtcccgtaagaaacctgagtacacacattcctaagagcaggctgactcagaaagaattccttggttatcctcaccttttttcctgtagggtaagggaggtgggagaagcaaaagtgttggggacaaagaggaggaagtatgtgtgtatacacaggaaggcaacaagtaaagtgtcgttcacgggcagcagccttggatatctgcaactcaggacatgcccgtaactcagacactcacccaagtctaggtccaaataccttggtcttttaaatttattttcacatttatcaaagtccaaaacgtggaccaaaatgactttcgaaggtaaatctgcattaagtggtatttccttcaaatacctgaaagtacttttttttttaaagacagagtttcggccaggtgcggtggctcacgtctgtaatcccagcattttgggaggctgaggcgggcggatcacgaggtcaggagatcgagaccatccttgctaacacggtgaaaccctgtctctactaaaaatacaaaaaaaatagccgggcgtggtggcaggcgtctgtagtcccagctactcgggaggctgaggcaggagaatggtatgaaccgaggaggcggagcttgcagtgagctgagatccggccactgcactccagcctggtgacagagggtgactccgtctcaaaaaaaaaaaaaaaaaaaaaatcctgggcgcggtggctcacacctgtaatcccagcactttgggaggctgaggcgggcggatcatgaggtcaggagatcaagaccatcctggctaacaaggtgaaacccgtctctactaaaaatacagaaaaaaaaaaaaattagccgggcgtggtggcgggcgcctgtagtcccagctcctcaggagactgaggcaggggaatggcgtgaactcaggaggcggagcttgcagtgagccaagattgtgccactacactccagcctgggcaacagagcaagactccgtctcaaaaaaaaaaagacagagcttcactcttgtcacccaggctggagtgcaatggcttgatcttagctcaccacaacctctacctcctgggttcaagtgattctcttgcctcagcctcccgagtagctgggattacaggtgcccaccatcatgcctgatttttctatttttagtagagatggggtttcaccatgttggccaggctggtcttgaactcctgacctcaggtgatttacccacctcagcttcccagagtgctgggattacaggtgtgagccaacaggcccagcccctgaaactatttttaaaaggtcagtcaactggcaagccaaaagcttcacaaaattaggttgctaaaaggatctgtaaatgtgaaatttgagtttcaaattttttacatagcttatgttggtactttcaaactggccaggtgtggtggctcatgcctgtaatcccagcattttgggaggccatagtgggacgacatcttcagctcaggagttcaagagcagcctggacaacacagcaaggccctatctaaaaaacaaagtctaggccggttgctgtggctcaggcctgtaatcccagcactttgggaggcggaggcaagtggataatgaggtcaagagatcaagaccatcctggccaatatggtgaaaccctgtctctactaaaaatacaaaaaattagctgggcgtggtggctggtgcctgtagtcccagctactcgggaggctgaggcaggagaatcacttgaacccgggaggcagaggttgcagtgagccgagatcgcaccactgcactccagctaggcgacagagcaagactccgtctcaaaaaaaataaataaataaaaaataaaacaaagtccagtaacgccaacccctcaagcattttaggaattttcaaaagatcaaaggacacatccatggtgttttcacacttggcaaattgtgctgctgtttaaaataaaagccaatagcctcctctggtctcatagtggacaggtggtagctccaggacaaaatacctgacacctaccagtgttgggaggcgggggcttgttgtgaatccatttaaccactttgatgccattctgagcagtggcaatgtttacacctggaacacaggtaatgaagtgttctaagggaacacctccttggttttcttgcactacttctagatcgccaaactctgcaatgtaacaatctggaaagctgaaataggaaaaaacaacaaaaaaaggaaaggttaaatcaaaataacagaaaaggaggcgcttgctaaacagaaggctttggtttaatgtatgtgttaatcatttgtctgaatgcccaccaccaggtttgaaggttaaaattaaggacccagggaggcaagcactgaggcactggcctctctgatgcattctgatggcattttctgggtagttttccaggagggggattaaaaatagggcaactgggctccaagtcagttacgcgtctgcttccacatcagcagggacgtgcaggccactgagtcctgtgttggcctttgtgttaagtctactgttgtggctcatggagtgattaaatgaacttctgaagaatacttttctctcacaagtcttgaaatgtatgcatatttgaagctgtgtactctcaacacttgtggagatttcgactgcagcacttatgatacatctcccctctgtggaagaatctgccctcctcacgtttacgtttctaaaatgtagcgcaaacacacattttcttgttgaagtactgagtgaatggatcccatttcagataaacagtcacgtgctgcttcatgatggggatatgtactcaataatgtgttgctgggtgattctgtcacctgagaacatcatcaggtgcacttatgcaaacctagatgctgcggcccactgcacacctaggctggtgcagcccatggttcccgagctacacatctggacagcctgttactgtactacacactgtgagcaactataacacaatggtatttgtgtatctaatcatcgaaaggtctagtgaaaatatgtgattataatcttatgggaccactgtcctatatacagtccatggttggccaaaattttgttatgtggtgcatgactgtactttgactgaaggctaaacacatgaggatgaagcattgtagagtacttatttgtaaagagatgtgggcagaaagggcaggcttcctataaaaagcagaactagggcattatatcgacaaaggctttgagatggttcacctcaataaaggcacggtgccctcgtgggtctggagaagactgtgaacctggggcgcaaatgtcttcaaagaaagaatcacaaaaggaatcttgtaagagtctggatcaaattcatgttcgctgaagaaaagagaacacaattggaagctgacattccgcaggggtctaagatgttcacaaggtcatcctaacatgttccacaatcttatagaaaagaattacttctaaaggaaaacgaacggcacacctgaaatccttattggaacaatgctgtctgcagacaggctcgtgatattctaactcttcaaatataattgggctgcaattcgtggaggagccgtcgtgtgactgggaagaccccaaggggctctggcgggcctgactgctgggtaggagacacaccagccgtccgtttccttgttcacggattgcgaccgtgtctgttaatttatatagatctgacacattcaacttgtgtccaaacctaaaagcaagagaagagagacgctgacttagaaggtttttctttgattatacagaaacacgcatcctgtttaaataaagaacaataaccaagaatggttcctccatctcttcaaaggtaaaactggaataattctactacaaattcattcactagcaaaccagtgatgcttggtactcctgagtcgtctctggctccgaccatgacaatgctcacttcatttgaaagccacccccagcccctgcccagtttctttaagtgacctcaccaaattctcttgagttggaaacctctctcgatgcagctcccctcacttccaattctctgtgttacttctcaccatccccattctcccctctcagaagtatatgtgctttccgtgaccctctcaactctcctatgcctcaactgcatgatccacacaccctctgacactggactccccagttctcctcctgacctgtatctttcttacttggaacttaaaggcactggccctggaggctggcagatttgagttcacatcctgactccacttcaacctgtgtgaccttagtcaagttccacgaccaatcggggcctcactttttccatctgtaaaatggggtgatgatagcgcctatctcacagggtcaatgtgaggattaagtgtggttaggcctggacagaacttggctcatagtaagtgctcagtaagtgttccctggtcttctcactgtctgaccagtgttttcttcccagtgtcctacatatgctcagattcccatctaccaaaccagcccctggtcctcttccacctcccggagagacacactctcccttgtactctcattctcagtctcgtactctaccctgtccctgtaatggaaacatccagctgctcaggagctgcttctgctgtgttacccccgagtctctcagccccttccctactggattttagccacaggactctgtagtgatgactcaaaagttatcagcggcctctgcctcatccccacacctcatgcatttcctcatggccttggatccccccattcctgatgtgctctcttggcacacatcctgggtgctcgcccacatccctggccctggtggcattccatccattcctgccctctatttctccttccccctcccaaccttatctgctctctagtctgtcccaatcgtcttaaaggcaaatgactgccctatctccagagcctacttctctcccaaagaagtccctcaatgtgcagaagactatgtgacctctccacccagctactccaatggcccctaaaacctgaatgtccaaaaccaagaccaaaaacttgctgtacctccttgccatgctttatttccctatttccagtttaactgtgcaaccatcatcccagtcatgcaaggcaaaacactcagaatcaaaatgacctctcccttttaccttgcttgctacataaaactagttactctggctggacgtggtggcccgtgcctgtaattccagcactttgggaggcctaggagggagaatcacttgaagccaggagttcaagaccaccctgggcaacatagcaaaaccccctcattacaaaaattaaaaaatattaactgggcaggatggcggatgcctgtggtcccagctactcaaaaggctgagatgggaggatcatctgagtccaggagtctgaggctgcaatgacctagggtcgtgcccctgcactacaccctgggtgacagagtgagaccctggctcaataaaaattgtttttaataaaaaaaattagttacccactctagtttcaatgacatttgacattttgacatttctgtaacatcgagttctgtcccaacagtatctgctctgaatttggactgatgtagctactttccctctctgcctccttctctcccctgttcctgccctctcagacaccactgctacgagaagagtcttcctgcagcatgattcccatcaccacacctttcccctcccctccttcctccagcacttcagtggctccctattacctgtgggataatggccaagttccttgttcttcccttcctctgtgttctcaaagctttttctcctcctttccaatcagttttcttcactgtccataaggattcacgagcattttctcttcccgctagacataagctcctcaaggacaagacctaagtcttgcccagttctgccttctctgcagtgccttggtcttgtactcactagtccctgctaagcatctactatgggctgggtgcttaggatacagtattatggcagagctagtccctgctgtcctggagcttatagtctagtgcttaaaaatgttcatccaataaatactaaaacttggccaggcgcagtggctcacacctgtaatcctagcactttgggaggctaaagtgggcagatcacttgaggtcaggagtttaagaccagcctggctaatatggcgaaaccctgtctctactaaaaatacgaaaacttagcaaggcttggtggcacatgcctgtagtcccagctactcgggaggctgaggcatgagaatcacctgaacttgtgaggcagaggttgcagtgagttgagattgtgccactgcactctagcctcggcaacagagcgagactctgtctccaaaaaaattaaaaaacaaacaaacaaacaaaaaaaacaaactaaagctagtcaattaggggaaaaataagcacaacactgaggaccaaaggtctaactttgttaaaaataaaagacgttttaaaactgtctgctaaacattcattgacatgtaaatctgaatgccagtgtctctgtctcctctcctctaccaggctgaagttcctcaagagtcattaccatggttttgtgcatgtaagccaccaatcagtactgactggataaagaaaaaatatacctaacttactttttttcatagatatctgtaaatttaaacagaggcaggcaacaggcaggggcatcctgaagaacagacattgtttctgcactgtaaaacagaagtttgattagggaacagaccatttcctccatattacaagttatataaacagagttcataaaattaacccagtgcatatgcaaaataaatttacggatttctggtatgtcagaatgtattttccagaaaaatttaaagaaaggattttagggacaaggcaatgaaagaagattacgttacacagtagaattagtatcaatcatagggttttccacaccagtggagcagaaaagcatgatgaattcagagcaaaagggagaagagcttaaatatctcctgccacactgcagtttgttagatatatgtgattggcgttcccatagataaggatacacaactgaatacaacataatctcaactacagttttaaaaaaccagaggcaccaaaaaacgctcaaagggaaaaaatccaaacaaaactaaaagaagatgccaaactgttaagtgcaattggctttgggccataggcctgtggatggttttttttcccctgcttcttttatgtttctaaactttccaaattttcttcaataagcatcatttttattctgagaacaacaacaaaaaaaaaacccgtaactcgtaatttaagtaatagtgaagtacaagttagaaaaaagatctctgatcatccaaggaaacactcaggagtgggtcctgttttgccagtctccccgaaacagggagacccaaagaagtatcacattttactatgaataaaaccatcaccagacgcttgagactgagatagtcttaaggtagacttatggggctgagtatctatttgacactaaggatatatctgcaaatggagagcttgaagatttgtagatctagtctttacacacaaatctaccttctacctaagatctcaaggtaatattttagacttttcaggcttataaacttttattgtaggggtctactatttttagaacctatttgaacatgttgcgtattattttactcccaagtgcctgtcaagtttaagctgtattccagctttgattaatgacttagacaagagtcaaatggcttgtttctaactgtatcaatctagaataagcattattccacatgcaatcatcacaagggggtgggaatgtgattgaatctatttttattatttctaaaattgtttctgggtcaaatgttatttcctgaaataaacagcttgcttgtttcttacctcagtaaagagagtgatttgctggcagccccggtggcaagtgagaccaggatctttttgctgccaattttgtatctgtggaggctattcactgcaccgatcgcatcttgtaagttttccatttgcacaacagccttgagttgataatctgtatgggggctgagctcaacactcttcacctacaacaggaaaagcgaaaactaaacgctatgtccgcccagaaccctgtcgtcttaaaactgaaggtgaaccatgaaggaacacatttgtcgactgcagcgcttccatgaaggagtatgtctgaactctgctcttctgctgaccaggacgtaagaaagtgaggatagggtgacctttagagatgtgacactggcccggcctgcctgtgtgctctggcacacacaggtttccaaggcaggctcagaggccaacacatgggaagagtgtttggggtcttttctagactctacaaaacccaggacatggccatttttaagaatctactaaaaaggtgcatttttagcaaaattgcacctaaaaaatgagtcaaatataataaggcataaacaagaccagccaacattattttagaatcctacctgtatttcagcaggaagagctaactgaaatccatcaatgttttacttatcaaattgcctttttttttttttctttctgagatggagtctcactctgtctcccaggccagagagcagtggcgtcatctcagcttactgcaacctctgcctcccgtgtttaagcaattctcctgccttagcctcctaaggagctgggactacaggcgtgcaccaccacgcccggctaatttttttttagtagagacggggtttcactcgccaggctggtctcaaactcctgacctcaggtgatctggccgccttggcctcccaaagtgctggaattacaggcatgagccgccatgcctggccacaaattgccatttcaatttctgcctaagacaagagcttttcactgctaggcgtcttgctctctggggctaacattgtaaaaactggatttatagcaccaccctgagcagaccaaagggaaaaggaaggagttcaaacttgttcagtcacacttctatcccggctgtggttatgtatatcaaattaggtcctcttgactagagactccatcagagagtataacaaagcaagcacaagagggaaaaagttaccttgccatgcctggcaaatgcttcctgcaggagctgctgcagctccttccgggataatctgtagtctatgttgctgacttggacatcagcaccatttgcaaatgggtctgggcagtcggcttcgctgctcgaatttgcaatgttgaaagcaagcggggatgctctgtttaaaaggtttggagacatactcctgcttaaaacacacatattgacattattttaaaaaactgttctgtatatttagattttatcatttaggctttgtttgaaactatatacagaagcagattttccacaacacaaccaaaccaaacatttggttttcaaatgtgtttttaatctttttttttttttttttttttttgagacagagtctcgctctgtcacccaggctggagtgcaatggcacgatctcggcttactgcaacctccacctcctggattcaagcaattctcctgtctcagcctccccagtagctgggactacaggcatgcaccactacacccagctaattttttttatttttggtagagatggggttttaccatgttggccaggctggtcttaaactcctgacctcaagtgatccacctgcctcagcctcccaaagggctgggattacaggcgtgagccactgtgcccagctgtgtttttaatcttaaatacacattgatttcagacattgtcaaaagtactatctactgacccctaattaccgccaaccaattaatatatattcttcctttgggttaaagctaaaggcaggaattagaggcagtcctgatgaattaaccttctgctttgtgcattatccttaggaaatcagcctgtgataccaatttaaggcgtctaacctcctctgtgtctctgaaagagttaaacgttcttgcctacatgttacagttctttctgcacataaggaaaacttttatgtggctttttagatgtaattttatagatccatagtcactttctctttttttttttttttttttgagacggagtctcgctctgtcacccaggctggagtgcagtcatgcgatctgagctcactgcaacctccacctcccaggttcatgccattctcctgcctcagcctcccaagtaactgggactgcaggcactcactaccacgcccggctaattttttgtatttttagtagagatggggtttcaccgtgttagccggttagccaggatggtcttgatctcctaacctcatgatcctcccgcctcggcctcccaaagtgctgggattacaggcgtgagccaccacgcccggctgatccatagtcactttctacagtgatctgccaccaactcagcagaacaaacacaatgctaaaaggagctcatgggaatgcaacacggccttacggcttctctgtctcccaagcatcaagaattccttggtgtgagagacagtgataaataattaccatggtttacagaaaactttacttccaaatagcttcctatacagaaccatatgaatcagaaccaccaatgcacggctcgtttgggctttttcctcaacacagcgaacatagggacatctttacatgcccccctgcactggccagggactctccaacaggcttctctttctgacctctgcttaccacaatttccagatggaggaagaagaaatggtgaaagcattgcccctaaatgttaacgatgattacctgaggagagggggactggcagaagagtgatgggagacttactttgtgcatttcagtactatctgaattcttttcaacaaacatactatttcataatccttcctattacatgtaaccacccccatgggtcaagaagctggactcacctagaagaccaagactgagatgcgagcagaggactgacttgcctggatgcaactaacttgctaaaagcagacgggtaactcacttggaatacagtctcctctttatcttttttctctacaggagaactggtaacacttcgggcactgaggttctcctttctaacagaaggggaaaattgaaggcaaaaggtcatatgtcttccttcacattcaagaagcagctatgagaaagagtagtttcacatacttctgactggttttgtaaacgggttctgccacccccgagtttttcggcgtcgacactgcagcacttgagttaccgtgagtgggtacgaccagcctcaggtgaccttgctggtgctcactgtttctatgaccagtttttgactccatgcggcacagctccttcaaagacacaagcacagtggggtttaaattttaagtacccaagatgtgttagatcctttacagaaaacgattgactttgagtatcatcaaacactgaaatcaaaaagggacacgccaaaagcaagcgggcacgtaaaacacagaaacaaaccaaacctaccataaacttcagaaagcaagaggtatcaaaattacctgtaaacttttaacatttgtattttttgtagcagatccagaatttgcctgtgacccttttccaggcgtggctttggcactggaagattgttcacttgcatctttgatgaggcacaattttggattcttaagttttttgggagacttcactttatcagcaattgcatttgaactctttgtttcacagagttctctattttttggagtaaatgacacaatgatcctattaccaaagacatcttcgttttccattcgcttctgagcgcgctctgcactatcttggtttatgaagcggagaattgcactgcagcctgtgatactcagcactttcccaccacaattatcggacaggcgtctgagcctgttgctgacgctcttgccatccttatttgctggtaggttataaacatagagcagagtgtggcactgctaatacagaggaaagaagtgttacgtcaggttaattcaagggcacacattcaatttcaaaataagaacaatgggtgacctccaaacttcagttaacaactttgaagagaagatgacagtgatttagatgggagagggtaaattatttagtgttgacaaagtaactgaatattgttttaaagaatatgctttagctgggcatggtggtgcatgcctacagtcccagctactcaggtgggaggattacctgagcccaggaagattgaggctggagtgactgtgccactgcactccactctgagtgacagagtgagacactgtctcaaaaaataaaaataaaaaagaatatgctaggcacagaggtctgtatactatatgattccatttctataaagcatccagaaaatacaaatctacagagacagaaagattagtagtgcctgggagtggggaaggggattaattataaattagcataatagatttactgaggtgacaaaaatattctaaaattgtacaactcaatttactaaaaattattgtacacttaaaagagctgaattttgtaatatgtaaatcatatctcaacgaagttgttttttaaaagtctatttattctgcaggtctgctgaataataacttatagagccagaaggtgagcagggtcagtcctggttggtttttgcataggagaatgcctgggaatactaggagctataggcttaagtaaacaaaaatttttttaaaacccaacaatttagagcctgttcagcttcaacagcagattgccagtagttaggctggaagttttatttggcagtgggtagtcataattcttccagataagttgaaatttatgtattaagaagtagaacttggcctggcacagtggctcacgcctgtcatcgcaacactctgggaggccaaggcaggtggatcacctgaggtcaagagttggcgaccagcctgaccaacatggtgaaaccccatctctactaaaaatacaaaaaaagttagctgagcaaagtggcagacgcctgtaatcccagctactccagaggctgaggcagaataatttgcctgaacccaggaggcggaggttgcagtgagctgagatggcaccactgtactccagcctgggcgacagagcgagattctgtgaaaaaaaaaaaaaaaagaaagaaagaaagaaggaagtagaactggagaaaaagaaagaaaagagagagagagagagaaagaacgaacaaacgaacgaacgaacgaactggccaggcatggtggctcatgcctgtaatcccagcactttgggaggccgaggcggggggatcacttgagcccaggagttcaaaaccagcctgagcaacacagtgagaccccatctctattaaaaatttttaaaaattgccaggcattgtggctcactcctctaatcccagtacttagggatgctggggcaggtggatcacttgaggtcaggagttcaagaccagcctggccaacatggtgaaacctcgtctacaaaaaactagccagaggctgggcacggtggctcacgcctgtaatcccagcactttgcgaggccaaagcgggtgatcacctgaggtcagaagttcgaggcaagcctggccaacacagtgaaaccccctctctactaaaaatacaaaattagccaggcgtggtggcgggcgcctgtaatcccagctactcgggaggctgaggaaggagaatcaattgaacccggcaggtggagtctgcagtaagcggagatcacgccactgcactctagcctgggtgacagagtctcaaaaaaattttttttaaataagaataatattttaaaaagcagaaccattaaagcaccaggagaaaacttaagataattatataaagggttaaatccagaaaccataagagaaatcactaacaacaggcaaaggatgtgaacaatttacagaagaaataaaaagcaaacaacgataatcataaaaggatattttgcactgtgttaaagattaaaagtcaattataagatgatgctgtttttcacttactggcctggcaaacatttaaaacagacactcttatgagtgtaaattagtaccaccttcctggaggaagacatggatcttgctagtaaagttctaacccagaactcttatgccttggaaattaccctatggtatgtcagcccaggagcctaaagatataaattaccttgctggaaatggtaaaaaacaaaacaaaacacaaaactgggtataaacaaaatgtccactaacaggtagactggttaaataaagaccagccatacaagtacttttcaaaccaaagttctggtttttaaaatgtggcagatttatattaatatatattaacatgaaaagacatccaagctctgacatagtttttttccaaaagccacagaacactgtatatgtgacacatttttttttaaacgtacattttttaaatctggagggcaataccaaaatattaacagtggttacttctggagggtagaattgtggggttttcactttccacatttctaaatattgtgttttgtttgtttttacaatgatcataccatactattcttttctttcttttttttttagattttttgagacacagtctactctgtcacccaggctggagtgcagtggtgtgatctcggcttactgcaacctccactttcaggttcaagtgattctcctgtctcagcctcccaagcagctaggactaccagtgcccgccaccacacctggctaatttttgtatttttagtagagatggggtttcgccacatcggccaggctggtctcgaactcctgaccttaggtgattggtgatctgcccacctcagcttcccaaagtactgggattgcaggcgtgagccacatcactcggcccacaccatacttttctaatcagaggcttttctttttatttgaggggtactgaccaattatcaacaaaatctacacttttcctattacacctgggactcaaaacccaggcagtaccaatgtatgtttaatttattaaaattaaaggaacagactaaagaacataaaaagaaatgtatcttaaattatcactctagtggatgggaaaaaacatccagcaaaactaaatggtttgaattatcaaaacattgttttggtttttttaaccataaggaataagaatctccaaagtgggcaagttcttacctaaaacactacatttacttttttttttttttttgaaacagagtctcgctctgtcgaccaggctggagtgcagtggcgcgatctcagctcactgcaaccttcacctcccaggaaaaaacaccgtatttacataaggccttcaaagttagaaaagtgaccgtcaaacagaagcagaagggaagaaatgtaactacagccaagtgactaaaaacaaataatgacaaaggtgagttaggaaagagcctcaaaagattaaggtaaggcctgtatatgcttactccctgggtaagcctctggtatccacaactctcaactgtccatagcatgagtttcaacttaagccagaccgcagggggcttgttgggtatcggggacacaggtgactagcaggcaagtgccggaatcaggatacccggggcccactctcttaactgctgcaatcaccaatgacacgtttactttttctaagagctgatttctttctcccttaaatgaagactttgcatgagatcatgtctaacgtacttctgtaactctcagttattaaattatatgtgaagactttcatttaacgtatgggattgcccactctcctggatcacccacaccatggctccttctccattatcattaattctttcagagttacacacatattcgccagcggcttaaacacagcccagcactgcaataaacattcttatcccaagtcaagtctatcagaaatgctagtcctggaaatgtgctcacaccctcctcccagtatatggcataaacaggctacacacaggtggagcaataaccactcctgctaattgtgtccatgcaccacagggaatgcacaatagaaagcacagactcagaggcccgctgaagcttaaggattaaataccgaaaaaaatgcacaattgactccacttatttggtgccaaccacacaagtatgtgagaaccctcgccatattctctacccataatacttggaagcaaaaagaatcatgacttttaatccgttatttctatccacctgacacaaaacactgctagctttgaagacactggcaagttgggaaggtaaatctacaagtcaatttcatatgatattttgaaataaataaaagcaaacttcatacataccaattatctgtatatttgtgagaagaaccgaaggtttctaagccttacttcaaaatctaacccacctcttacaaagaacagccccatctgggcctggcaacccccttattatgggctgtctttcagcctccacaatgtaatattggaaaatggcaaaaataacgcaaacccacttactggcatttttagtggtaacctggggggcaagtcggaaatgaactcttcaaatctgatcagctcgttagcatgatgcagcagtgcttctgaggcctggtttttatggaccaaaataatgtggaaaccatgcctgtgtctcaggtcactaagttccaatgcaaaattgacatcagctgaaagaaaaggtacagaccaaccccatccccaaacattagaaacacttgacaaagacagacaactctattgacacccactgagaagaaaggaaaggctggactatattcaaaattgcttcccccgtttcttaggaaagaaacacgtttcacatcagaagaatgtaagacaatcttaccaaaagaattccaagacacatatgttactttcagtattaaaaaggagcaaatatgttggggagactcaaatttgaaaattaacttaaactttaaaaattattaatactgagcacaaggtaaaaaaaaaaaaaaaaatcacatttttctttaataaacctggtcccggccgggcgtggtggttcacgcctgtaatcccagcactttgggaggccgaggagggtggatcacctgaggtcaggagtttgagaccagcctgaccaactggagaaacccccatctctactaaaaatacaaaattagctgggcgtggtggaacatgcctgtaatcctagctacttgggaggctgaggcagaagaatcacttcaacctgggaggcggaggttgcagtgagccgagattgcgccatcgcactccagcctgggcaacaaaagcgaaactccatctcaaaataaataaacaaaaaaataaaataaaaaataaacctggtcccacaataactcaagttccaaggaggaaatacagaaatccacctagacccaattttttttctaaacagttctcaacaataaccataaacatgtctcatgtacttcagcctctttggggatacattttactttcacatgttgctggcttctatgataatttcccacacagtgagtttagctgaaattagcagatgtttctgtacttacttgacacaagaaccactgtggctggagcagtgtgtgtatttgcaaatctgcggagactctgccgcagtttatcatcagcggcattctttgcagtagcattgatgtgggcaacggttacctgcattaatttataataagggtgaataagcaggagctgaggctagaaaattgctacacattctgcccatattttttattttttaaattttattatactttaagttctggggtacatgtgcagaacgtgcaggtttgttacataggtatacatgtgccgtggtggtttgctgcacctatcaacccatcatctaggttttatgcccccacatgtattaggtatttgttctaatgctcttcctccccttcccccaaccccgacagacagaccccagtgtgtgtttttcccctccctgtgtccatgtgttctcactgttcaactcccacttataaggcaagaacatgcactgtttggttttctgttcctacattagtttgctgagaataatgacttccagcttcatccatgtccctgcaaaggacattatctcattcttttttatggctgcatagtattccatcgtgtattatgtgccacattttctttatccagtctatcactgatgtctgcccatattttaataagtaattcttgagaaaaaaattcttattactattgggaatggtaaaaaattacaacagatctcagtaatctcaacattggttcttgatatgaactgggtttgtgactaaccctgctctcatctccaatcttctgtttttgcatttctttcatcctcctttcagaaaataagtagaatataggaagtgaaatttgaactcagttaaatttgctctaatagcttctgccaacaatttggaggtggtaaagatcagacaaatgactaaaataagatttaaggctgtgttttatgtcaactgtccatgctacccatgcaagcttgtgcaatctgccttttgttgttgttttctgttttgttttgttttgggcttttagcagctggaagccatagtttttagtttccgtccctactaataagcagaaaagagagataaggaaggtgctttactagcccaaccagaaacagaaactgagaatccatgattgtattctctcccttggacacccctggatggctttcaggatctggggtgaggtggtagagagaggagggaggatatcccctaagggagctaaaatgcatttatttctgttaaaactatcaggctcgcatataagtccccaaaggaaggaaaggtttattttgagaaagttgcctcaggcacctgcaatacacaataataacttgctggtttttgtaaagaacatgggtatatcattttagacaagcaatatggactatcaatataattaattatctaagagtcaaaagacccaaattctagtttcagcttaaaagcagactctgggggtcagacaaatctagatttggatctttgctcttcctggccaagtgatcttaaacaagtttcttcacctctcagggccttagtttaatttgtaaattgtgaattatatattctacgtgcctggttcaaagagcagtaatgaaaatcaaaggaaataatacatatataaccattataccagtatagaactaaaatataaattagggagcataactgaaagaatgattaaattatttctagtactttggaagtgatcttttgctaatttattttatttgaaaacttggcacaaatgcaatatcattaaacaaattttcaatcagaattctaaaaaaaaaaaaaacaccacacacacacacacacacacacacacacacgtacagcacttttagaggccaaggcaagaggactgcttgatcccaggagtttgagacaagcctccaccacctaaccctggatcctgaaagccatccaggggtgtccaagggacagaatacagtcatgggttcttagtttctgtttctggttggaacatagggagacctcgtctctacaaaaaataaaaaatgagccgagcatgatggcgtgcatctgtgatcctggctagttgggaggctgaggtgggaggatcactggggtcccagggttcgaggctgcagggagccatgaatgcgtcactgcactccagcctgggtgacacttagactctgtctcaaaacaaacaaacaaacaaatatctgcttattcctctactgtagattaaaattattaaattttttttttttacctggcaattattcagctcttgaataacttccttgttttctttactgatgtcacatacacagatgaattctgcttctctgtggcctttaaaaaacttctcacggattctttgcacaacagcagttgctgaccggccagagggaacggagcagttttcaatatcccaaaaaactccaatggggggtaagttttctagcacctgtccagctactgcaacttctggtgacccttaagaaatgttaacattttcaattacttgtagtggaaaataaatggcaagttacaataagataataaactacctatcattctcagtggtagaaaaactaaattattaatgaatgccaagttttaaggctaccaacctcactggttgacctaataagcaatcaagctgtcaaaaagtatcactctaagagattatttctgtttttcaggagaagacaaatctaaaagtcaagtaactttaagcccacaataaatccacctccaagcatgagccactctgacattaagcagtgatgcttctctgaacacaagcacactaactgaccggatactgcagctccaggacccgactttcaagcttagcccacacttatctacctacttggtagtaaccaacactgaggagctgacaaagggtgaagctgttactgtcgttgattttgagttaacgctgcattaacatctgatttaatattttaaaaatgttttcaaaacgtcgcattaactactttttagggaaattattttaactgagaactctttggttttcaaatactgtttttaatcagccattagtaaattgttctaagcacttctagggagtataccatcaacaagtgtgatttccaacctaaggtgacaccaagtcttttccagcacttttatttctcctgatatactaccaatttttctatacacagcttctgtgtatagcctcggcccaacataaagggcaaatgacttcctggtccataataataaaaagatttctaccaagatatggaattggagactcacatacacagtagctttagaaccataaggaatccttcaaaggtgattaaatgcaatgttagtatgagatattgaaagctatttaaatatgcacattttatgccatactgtcatttaccaaattttgaagcagctttgcctagactggtcgccaataacaacgtggtctccttccctgttcctttggttccacagccattacacagagggacagcaagaggtgcaggttgagtatttggaggtggtatatttggccagactttagccgcatcgattatgctatttcttgctggctgttttaaattttttttaaaaaggaggaggtgtcagatacatcatttcagaagctggagttatatacaacaactgaaaatacactctaagtgttttacctttccacttgctagcctctaataaaaaggactttcaaataatctttccaagaaccattagctatcagttcataaattcatttccagaagtgacttgacatgatcaagaaagatattcacgtggtcagatctttacattctggggcatgagtctgctgcaacgaagacctcacacatattttacataaagggtagcaaagtctcacttgaacaccaatgtgactgaggccaagcttcaggtttcccacattattgcaaaaagacaacatgcagttatctaccttacatgaatgggcccatgtgtaagctgaatgtaagttataaaaaatccatcgtgctttagcctttaaacatagaacacgaaggctttgccaacctcttgtttgcaacaagaggctctaaaagtataaactacaaaaataatgactctctacttttttgaatgatctcccatcttaccctttgtttctttcagaaccagcaaaaattatgctgatggggagattcccctataccatgggagaatcttcaaccccatgtataatacttttcaagataaatccacttcaaaagtcattcctcaatcctcagctgcacccaacttaagaaataaaaagatacgaaccttgtttagacagtcttcgcagtaaagtgagccctttaaacaaaccggaggtaccacattaaggtgcaaagagttggtgcacaagtgaggcgttagctccgactgtgaaatgtgctcttccaaatgccctggagccccgcttgtgaaatcagaacaggggaaatagccagcggaggtgcagccctgcagactcggaaactgatgcagcttgtgcacattaccatgacatgactggaagtggagttttccacaacagggcaggtgtttgcaggaagacaggttactctctagacacatgctgggaaagtcacttgcaatgcctgccaaattgttcctagctgaggcattctggagtgaagatgcagactggaaagcaaaccctgaccctacctgacacgtgattgtcctggtgctttgcgagtctaacagtgcgcccgggtgaatcaagctactggtacctccgctaccgccaccaccaccaccaaaacgcattggcgaagtggagggttcattagggcaatgagcacagcagcttactttggggacagaagaaagctgtattttaggctgctgaagagaacgaatatcaggaagtgggactgctggaaaaagcttagagccagcatgaaggggtgatggtacatcctttagttccacagcaactttcttgttctccatgtactctttctgagaaaagaaaatcagaacataaattaattttatgaggtccgtggttttttggttactcatatcttactgcatgcacaaacagaaatagtgttcaattctgttacatcactaaatcataactgaacaaaatggaatcacagctagttaaaaccaggaacattcttcagagaggtctgcaggacatgaacactggaacacacaactaaaattaagactacattcttcctgaattgaaacagactggggtgggagggcctgtttacatctttagcagccaccatgcctcagtaacttccttttggtaatttccccttgcctcacagaatcttctgaagacaaaataggtggtatgaaaacaacccctcacaaacagcattcaataaagatggctaacacacacagtggtttgaggacaatacttaatagttctgtggtcaggccataaggggttttagtaagatcccccaaaggaaaagagtaaagtttcaaacacagatgagatcagccatctacccagatggcccatccgtgttgctgatgacatttcataaaccctaagatatcatgacctaaagccataatgacaattatattgcagccagtgaaaagatttagagaattagaaaactatccaagaaaaagatccaagacaaatagtttgccacatgactccaacacagacacaggaagccagtatattacaaaggttctgagcagagcatcagtggcagagacctgggttagaatctgatactcaatagttgtatgaccttgggtaagttacttaacctacactttggtttcctcatccataaactgggaatacaatatacctcctagagttgctaggaggataaaataagatagagcacatagaccacctggcacagtacctagccactgaaaggggactgaattcatcagccttcacaggctgactgcaagagacattaagatgaagagggggccctgctacagtgactgagacgtgctcaccgttcacagcatatgagggtccatctgacgcctaaaattccactccctttgctgtgattctacactcacctgggagcataggctcatctggaagaaatgtgaattttcagctaaactttccctaaaagggagataacagcaacgggctgaccagccaatgaactgccctcttggtaattatagttcagactgaaattaacacactggtattctgatttatacagatcaggctcatacaggcaggcttactatgagttgatcccctgaacctactccattctgcatgccactgacaaaattgagtttcaagatctgtaaagttgaccgtgtaattctgaattgtgtgactccatgaggaccagatctaccaccccatcccaggaagccttgcttttgatgccaaccctcactgtcaactgtctctaaaataaaacactcctaaaatgacccaaattacttgatgtcttgcaacaaagacaactatatagtgaaaacctagagaaaatagagaattaaactggtttttaaaaagttattaatacccggccaggcgcggtggctcacgcctgtaatcctagcacttgggaggccgaggcgggtggatcacctaaggtcagaagttcaagaccagcctggccaacacggtgaaaccccatctctactaaaatacaaaaattagccaggcataatggcgagtgcctgtaaacccagctactagggaggctgagacgggagaatcccttgaactagggacagtggttgcagtgaacccggatcgtgccactgcactccagcctagggggctgagccgagactctgtctcaaaaaataaaatcaaataaaagttgttaatacccttatataaaattatattacagtctcacttgaatcccacatacaatagaaaataagaaatagaaaggtggtaacatgagtgcatgaagtcaggaaatgtcaaaattggctggacgcggtggctcacgcctgtaatcccagcactttgggaggctgaggcgggaggatcacttgaggtcaggaggtcaagaccagcctggccaacatggcgaaacctcgtctccactaaaaatacaaaaattagccaggcatggcagcacaggcctgtaatcccagctactgaggaggctgaggcaggagaactgcttaaacctgggaggcagaggttgcaatgagccgagatcgcaccactgcactccagcctgggccacagagcaagactgcacctcaaaaaaaaaaaagaaaatgtcaaaatcacaatgagtaagcaagaagttagagacataaatgtatactgagaagtaaatattcaagagaaatctcgaaataaaaaacaggcagtggataagctcttcccaacccttcctagattatagactcaaaactcaagagggctacagtaaaatacaacatattttgtattttcctctgattttactccacaatgtggatttttaatctttgttacctgtgactttaatgaggaagaaatctttcccaaattttaacattaaatattcaaggcatctactgttactcaaagtgaaatagaagagttaaaaaattgtgctgtgctctcacattataatgtggtataagaggcaatacaggcaagatctacagaaaaatgtggcacagactctaggatgagagactgtatcccagaccaaatggacctctctcatctatttggatgaggaatctgctacatccttagtcttgcatatagttaccgtttggggactatgtggcagcgtctgctcaggacgagaaaagcaattagagaatttccaaagccatggcttagcatcattatcttgttgaagccatccacgtgttctactgcaggagttctcagttccgtttccttccatcatacagccatgcaaagtgattcaacatcctttcatctttcttttctttcattcttccaccctgttaagaatgagtaagatttcagtgttatttccttgcataagtacaaattttacaacatactaaaatgtgaaaccacagctatatttacagtcctatggctctcaacaattcaaatctttgtttcaagaggaagtctcgctctgtcgcccaggctggcatgcagtggtacgatctcagctcactgcaacctccgtctcccgggttcaagcgatttttctgcctcagcctccagagtagctgggactacaggagcctgtcactatgcctggctaatttttatatttttagtagagatggggtttcaccaagttggccaggctggtcttgaactcctgacctcaagtgatccaccctcctcggcctcccaaagtgctgggattacaggcattagccactgcgcccggccaacaattcaaatcttaacaaacaaaataataataataaaataaagaaagaaaaaaacacaaaatatcagagcatattacgggttaataaaatttggtaaacttggttgactgtttatgcttaaaatctaactgcaacaacctgatttcttaaaaaatctataatctgccattcttcatgtttcatagctcttcaaataaaaaatgaactctccatgagtcttgtttcctttccacatgtaaccatgtttgagagaggtagccatatcttggaaacttgcatattccagagtgagacttcacctcctcacttggctggaatcaattttttctacagtttttctgaattcttttcggctctctctccctaaagatgctgctcaggaaagtcaaaagttaacagaagagagcatctaatctgagtaaaagagccaccaccacatcctcattgacaactatatgtaagattttaaaattgacttaagagcaacttcttgcactggtttcttgatctgagcatgaaaagtccaaactaagtggcctctgtggactttgaatttgatttgctacagaacaaattgaaccaatttcttagtttactaatgatgaaagtgcaatctgatataccaccaaaaatctaactgatagaaaaatctcaagtcgcagatgtgttatatctacgccagagcaacaacactcttacaggtcttaacaataaatgcaagcgaggcaccgtggctcaggcctgcaatcccagcactttgggaggccaaggtgggtggattgcttgagcccaggagttcccaaccagcctgggcaacatggcaaaaccccatggctacaaaaaattagctgagcgtggtggtgcatgcctgtagccccatctactcaggaggctatggtggaagaatcacctaagactgcgtagtcaaggctgcagtgagctgtgattgcaccactgcactgcagcctgggcgacggagtgagaccctgtctcaaaaaccaacaaacaaaattacatgaaattaaaatgtcagtgtccataaataaagtttaattgggacacagacacactcattcacttaaatactgcctatgactgcttttgcattccaattgcagagttgcaaagagagtctctgcaaagagactgtatggcccacaaagcctatatttactacgtggctcttttgtcagcctgggcaatatagcaagatcacagctctaaaataaaataaagttcaaaaaattagcatagtgtggcagcatgcgcctagtcccagctactagagagactgaggtaggaggatctcttgagcccaagaatttgaggctacagtgaactatattgtgccactggcccttcagcgtgggcaacagagtgagattccatctctaaaaaaatttttgttttcaagtttctgtttcctcctatgcaaaatgtggctaatttctccccgccactgcattacagagaaaaaaaaaattagataaatgaaccccactgtctattttcaccactgtatctcttgtgccaaccaaaatgctccctactctgtaaatacaaagtaaacattacctactacacactattgggagtggttaatttggagatggatttaactgctaccactgatagtaaattacgattcttgtctttcctattagatacaggttttatgtcccccaaaaaactcctctcaaaatcgtaagaatctgtgatattcacagtgttcataacttaaacattctctcaaacttcttcaaagccaaatcctgaaagtgagctaacattcacagtataatctagtttataaagtattttcacttaacattacttatgtcttcattcagcaaatatttacttagtatctactatgcagcaggcctgtgcttggcacaaggaatataatgatgaaaaaaacccagacggtgggatcctcttatataatttttgcaataatcctgtgaaatagacaggggagaaattagctacatttttgcagagagagaaaaagaaacttaatgaagttttgtagcgagcctgacacaagattaggcttgttcacccctttccactacatcaaggtgccttcaatactgctcaatacaagcgattaaaagtaaaaactttcaggtgcctgcaccctgaaaacttcccaaataccatccacgaagcaacttaggtagccaaaagcaggttctgtttgacttgagcgacagtctcctttctgtcactctcttcaagtcttttgaccaattcaatgaggagagcataggctctgtcgactgtctgcattttggtctccaatttgactgcggtgcagctttggacaactcacaacctctctgaacctcagatcccatctctaaaatgggtgtgataataatagaaaccaccttacaaggccgttgtttggattacatgaggtaatccacggggaacatttagcaaatgttgtttccttagcacccaatctagtctttgaccccacaccaccccatcccattaccgttttctcccccatagctcttctgtccaaaacggcctttttagcttattttattatctttctcccccattaggctataaactccatgacagcagagactatgttttcttatccactattccaactcctgtccttagtacaatgcctggcatattttaataaataactgttgaacgaataaagcttaataaataggaaaacagtttaggtttcaatacaccgatatgcaaaagagaagaatatttaccgctcagagaagtccaaaagacacaaatgcaattggacagctcttggtaataccggaaaggtgcttgagaaactctaaaaggtgtatcacgaggtcgcgttacaactactagtgagagtggctgaagccctagacattgtcaaccctgagactacaccctatgtgttgctaaaaggccgaggagaatgcaaaacggccggggaggggggagtgtgttgcaaaaacacccgcccctttccttctctcttaaccttccagctgtgcacttcactcctggagggccccaccaggggtcagacaggggcgggcggggagccaaatgccctcgaaggggaacagcggcgccaacagtgacagtagtgaatggacccgaaagggagacaagccaactctttcgtggggggcccaactggcgcgtcccagttagctaacctcccctctccaccaccatcccaccagcaataggcggggaaagaggggacactgtcctccgtcccgccccgctggcctcggagcagagcctgccggggtctggtcgcaggactgtctgcaaactcacctctgccgccggctccacctccgctcacattccggccccgccgccttccccccgccccccccaggccctttgttttgattcccgactccgcagctcccgccgccgccgccaagcgcacccttcacttccgcttccgcaccgcaccgcccctgtcgcaaaaccgacgcccttctctcctcttcgccccgccccttcctcgccccgcctccgccgccgcgtcctgtccgcgcggggcatgctgggaaccccggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacggttagtttcaaacactttgtgttttaggtggccagatatgctgtgtggtttgctttaaaaaaaaaaatagcgccccacaatcttcacgtttccctggaataaaaaaaaatttaagactcagcaaaagggtgatttctgaaactaccagctgattactattttctgttgcaaattaggaaaaaagcaaagcacatattgtgtaagttaaatctagacacgatttaggatgtgctagctgctagctaaatgctaccttaggagtttatttttaaagtttgcccagaaacaagttgactttgcaaaagaatcagtaagtcgaaattgccaaacgagaatattttgcccaaaaaaatccttactgggaggttatttcaataggcaatccccattacgtggggattaacacatccctgtaaacatccctgtagacgggtattgtggagggcaggatcagacatgtagctgaagaatcctttgtgcctgtatttaattttccagaaggcagatgacaagcacacatcctctccctgcgtaggtatttattactgctgactaaatcttgactgtgggctgggcgcagtggctcaggcctgtattcccaatactttgagaggctacggagggaggatctcttgagcctacaaatttgagactagactgggaaacggtgaaaccctatcactatttagaaaagaaagaaaaagaaaaaaatcttcattatgtctgtgtataggtagtattttccaagtggagattagaatagatgaaaaacccgtttctagcgttttggcttttttcaaagtaccaaacaaatacgctactcttcagaggtgttttttccccattttatttcagttgagtatgtttcaacacaagccatattaactaaaaatcttaagaaacaaggtaattgtaggtttctaattgctttttttaaaaaatagtttttagccagaaaacatcaaagaatgcagacacatttcctttttactttttttttttttttttttgagacaaagtcttgcttcattgcccaggctggagtgcagtggcaggatcttggctcactgcagcctccacctcccgggttcaaccgattctcatgcctcagcctcctgagtagctaggattacaggcgcccaccaccatgcctggctaatttttgtgtttttagtagagacgggatattgccatgttggccaggctggtctcgaactcctagcctcaagtgatcctcccgcctcggcctctttaggattacagggctgagccaacgagcttgaccacattttctttatatgtatatttttcttttagattcctttttaccaagcagacacattttgtttgacttagcttggcattctttcaagtccaaagctgtaactagtcacaacaagtaaatgtagtgattgaaaatgggcggggcatggtgactcatgtcgtaatcccagcactttgggaggctgagacaggaggaccccttgaggcttggtgtttaaaaccagcctgagcaacatggtgtgacacttgtctctattaaaaaaatttttaaaaacaaaacagtcgtattaagtggaaggctaataaaagtctgaattacaaatacttttaaaagaaatgtaattttattgctgctttctaaagactaggagcctaagcaaagtataccaggccttaggagacaattatgaatcaaaatacataaattttctcttaagatatattttaagtatgtatcctctattaattgtattcctgtttctttgctgggaaaactttagagagtacaagtaactttcagtttttcccttgtccaaattatagtcttcacatgtatgaaaaccgaaagacttttttgtgtgctatttaagtagctactttacatgcaattcagcttttcaactaaccaagctgttattaaaggagtttctccccagaaaccaatcttctacctgtattaggttcagtggtttgaattaataaatgatcatggaaggacctaaggaagttaaattgagttatctgctcagccatagtccaaagctacaaggaaaacaaattgaatttaaaaagaacaagaaaaacattttaaatgtttttaaggttttacccaatgacaaacctatttccctaaatgttgttcccaaataggactttaaggattattatttcaatgccctctcttttttctttatggaaaatttgggaaattgagaaccaactagtttaaataccttgatcaaagccatttaggcaacaccagtacctcatcagtttgtgcttcggtttctctgtaagctgaggtgattagttcctgtccagaaacgtcacagagtggttagggccaaataaaattccgaggggggccaggcgcagtggctcacgcctgtaatcccagcactttgggaggccgaggcaggtggatcacttgaggtcaggagttcgagaccagcctggccaaaccaacatggtgaaaccctgtgtctactaaaactacaaaattagctggacgtggtggtgcacacctgaaatcccagctactcaggaatctgaggcaggagaatcgcttgaacccaggaggaagaggttgcggtgagccgagatcgtgccactgcactccagcctgggcaacagaacgagactccgtcaaaaaaaagaaaaaaaaaatccaaggggggttaataccagctacttggtaggctgaggcaggagaatcgcttgaactggaaggtggaggttacaatgagccgagatcgcaccactgcactctagcctgggcgacagagtgagattccatcttaatgaataagtaaataagtaataaaattcctaaggggaggcttggtgtggtggctcatgcctgtaatcccagcacttttggaggctgaggcgggtggagcacttgaggtcaggagttcaaaaccagcctggccaacatggtgaaaccctgcctctactaaaatagaaaaattaggtgggcatggtggtgaacacctgtaatcccagctagtcgaaaggctgaggcaggagaatcgcttgaacccgggaggtggaggttgcagtgagccgagattgcagcactgcactctagcctgggcaacagagtgaaactctgtctcgaaataaaataaaattccaagggggaaggcatcagacgtagtaaagtgtgaagcagcatgtaaatgattcattaatgtttgggaagtttcctgaaagacatttggtactttccttaaacctgttgataggtggtggggttcccctttgtgcctctaagcagtttttaggaattagcaaggagttcaaagtagaatttgagaaaggctgttgtaggatagcaggaaggcaagatggggtgggagatcctgtaatagctaagatctctttgcctctagcatagtgctgaagaaggagggtttaggagtcagagccagctctgaagcctgatttgttaattactagttgtaagacctcggacaactcaattaacttcctgcacctttattttcttatctttaacatggatacaatttaatgctttcctgtggttcatcacctgtggttcagttgcatggtctcctctctacagtggccttccctgactatagcatctgaagtgacccctcccagcccgttgtatcaaatgggcttgccttagtcatagcacttatcagtatctgaaatgacgttactttttctgcttatagatttagtatgtttctctcttaacaatataagccctttgaggacaggtactttgtctgactgtattcactgtgctgtaagggtgcattgtacagaagaatgctcataatgccgggtgctgtggttcatgcctataatcccagcactttgggagggaggctgaggcaggaggatcacttgagcccaggagttcaagaccagcctgggcaacatagtgagatccacgtctctacaaaaaaatgtaaaaattagctgggcgtgttggtgcacacctgtggtcctagctactccggaggatgaggtgggaggatcacttgagcctgggaggtccaggatgcagtgagctttgattatgccactgcactccagcctatgtcacagggtgagactctgtctcacaaaaaaaaaaaaaagctggataataatatatatatttttagtttttatgggtacactgtaggtgtttatatttatggggtacatgagatattttgataacaggcatgcaatgcatcataatcacatcagggtaaatgggtgtccatgacctcaagcatttatcctttctttgtgttacaagcactccaattatactcctttagttattttaaaatgtacaatacattgttgtggactgtagtcaccctgctgtgctcccaaatactagatcttattcattctaactctatttttgtacccactaaccagaatgttcggtatttgttaatgaacatgttatgacaggatgttttagaagaaaataaagaaaaaaagaaattccagccaagcatggtggcttgattttatttatttatttattttgagatgaagtctccctctgtctcccaggctggaatgcagtggcgtgatctccactcaccgcaacctctgccttctgagttacatggctcacgcctgtaatcccagcactttgggagactgaggtgtattgcttgaggtcaggagttcgagaccagcctggccaacacagtgaaaccgtgtctctactaaaaatacaaaaaattagctgggcgtaatggtgggcgcctgtaatcccagctactagggagactaagacaagaaaatcgcttgaatctgggaggcagaggttgcagtgagccgagatcgcaccattgcacgccagcctgggcaacaagagggaaactctgtctcgaaaagaaaaaaattattttttaattttaatttgttagtgaacaattagggttgctgtgagaattgtgcctggcacacacagccatttaaaaatcacgatcttcaggcagtgtgtggtggctcacgcctgtaatcccaggactttgggaggccgaggtgggtggatcacctgaggacagggattcgagagcagcctggccaacatggtgaaaccccgtctctactaaaaatataaaaattagccgggtgtggtgatgcgggcctgtgatcccagctactcgggaggctgaagcaggagaattgcttgaactcagaaggcagaggttgcagtgagtggagatcacgccactgcattccagcctgggagacagagggagatttcatctcaaaataaataaataaacaaaatcaagatcatttaacaaatacatatattgtacttactaagttcaaatttctgttctaaacgtttttacaaatgctgttaagtcatttagtcctctgcataatgtcgtttgtttgtttgtctgttctttaagacggagtcttgccctgtcgcctaggctagagtgcagtggtgtgatctcggctcactgcaaccgccacctcccggtttcccgtgattctcctgcctcagcctcctgagtagctgggattacaggtgcgtgccaccacatccggctaattttttgtatctttagtagagacggggtttcaccatgtgccaggctggtcttgaactcctgacctcgtgatccacccgccttggcctcccaaagtgctgggattacaggcgtgaccaccgcgccagacccataatggcgttttatagatggggaaacggagtcatagaggctaaacaactttcccaagaccacacagttagtaaggggcaggactaggactcaaagccaagtttatgaccaaattctggtgcactacgttctcctgcttctggagaagataatgatgctgaagattctacttttggtgtaaaggagtaggaagggcacggggcactgctagcttcagtgggcctgaatctttgtctttccttctgatttggagaaagtgcaagaatgggaaaatgcaatcgaagtgaaggagaggccggcgtattttcctgaaatgcgcggcccgcaagcccaaacccgtttcccgggtgtccaggcagcgttctgcagcatctccaatgcccgccagcccgccgcagcccagcgcccggcagccggcgcctctcaaaccccctccggccaggagccttcgccgcttggccgcgccgcgcccggcctgggaaaaaagtttccaaacgacgctgctctgcgctgattggccgaggcggacgcggtaccgtagagcagcagccaatgggaggcgccgaccgcaggctccggggcgggggcggggtccggagggccggggccgcaccgcccttcgcagccgcctctgccgccgccgccgcgttggcctcgccgcccctgctcgggtaagtgaggcgctgcgcggggctggggtcggggtggctgtccggggacctccaccgcggctgaaaagctcctctgccccgccccaggatcccgggaccccgggccaccgcctggcagggacccctacgcccctcgcttgcgcgtcgcttcccggccgcctggactcccccggtccctgggctccaaaatcccgcctccctggagcctcccgtcctaaaaagttaggcactgagtgccttgccaccggtgcgttcctcgcgctggcccctcgcccttggcaactttgtttctctttctgcgttggtctctctcccaccccgttgccctcttctccttccgggacttcctgggtggttaagccttgccggtccccaaaccccgctgccaggctccatcctctttctcctcttccttcctccccatactcctctcctagatgaccctcgtttcttttctctctctctcctattcctccatcctgccacccgcttctctgcgaccccagacccctcgattgcagcgttgcccctgccctcacacccactgtcccgcccctgcaggcctctttccaaaaacccaccctgctccctccctccgggaacacgtttggggcagtctgctctccgctttgctcccgtctctgccgcaggacggttcaggtttcttctgacagcactttggggagggattgggtaaaggacgaaaatgcttattccgcagcttgagtgatggctgggctcactgaggacctgagtctctgaggtcctgggaaaccccgctgtcaccttgacaccgcttttggggaggcgactttatcttctccgagccatctcaggctttctgcctcctgagggcctgagcttccttgattgctttgtccgtggttactaccaggttgtgcctcttaatttctactttgagcctcaggccccttttaactttctaaagaaaaggcctttgcagcacgacctaggcaggttcatcatttttagttttgttatagtgtattctagcataggatggcattttaggacatgggtcgggtgttttgaagattaattagatcccagctactcctaaagcctcttgttacccgaccaccccagcctccatcacctcgttggtatacaacccgtttttttttttttttttttgtttttgtttttgagacagagtctcactctcgcccaggttggagtgcagtggtgcgattttggctcactgcaacctccgcttcccgggttcaagcgattctcctgcctcagcctccggagtagctgggactacaggtgcgtgccaccacgcctggctaattttttgtatttttagtagagatggggtttcaccgtgttagccaggatggtctcgatttcctgacctcgtgatctgccccctcggcctcccaaagtgctgggattacaggcgtgagccaccgtgccggcctacaacccattttgagcctttcctcttagtgtgtgttttgtgtaggattaaatgcagatgatctgtgccgctgaagtctcaggggcctgtgattcatatattttatcccatgttggataacagtttattaacttgacttatttttgtttccaaagtgtgttatttattatttatttatttatttattttgagacggagtcttgttcttgtccaggctggagtgcagtggcatgatctcgactcactgcaacctcagtcctccgggttcaagtgattcttctgcctcaccctcctgagtagctgggattacaggtgcgtgccaccatgcccggctaattcttagtagagatggggtttcaccatattggccaggctggtctcaaacttctgacctcgtgatctgcccacctcagcctcccaaagtgttgggattacaggcatgagccactgcacccgactctatcattattattattttttatgtagaggcagaatcttgctttgttgcccaggctggtctcaaattcctgggctcaagcagtcctcctgccttggcctcccacagtgctgagattacttgcaggcatgagccactgcatgcagcccaaagtgtgttcttttgccttagaatgtgagccgagaattgacactccttttcctcacaaggtaatttcctaacatgagcattcctgtgtacagaaagtttgtgcctgcagttagtactacacgtgcacctcgtgcaatggatgtgggtgctttttgtctgcctccttcagcagtgcccagcacttagtaggtattcaagaaatgtttgaaaagggttggaggaggcaaaaccacagtaggaaaaattctttccctgtcacttggttcagtagaataaaattatcctggaacaatagctattttactttttgtccaagtttttgtttgtttgttttttgagacgggatctcactctgtcgcccaagctggaacacagtgatgcaatcacagctcactgcagtctcgacctctcaggctcaagcaatcctcttgcctgagcctcccaagtagctgggactaaaagcacatgccaccatgcttggctaatttttaaaattttttgtagagattggggtctcactatgttgcccaggctggtctcgaactcctgggttcaagcgatccttccgcctcagcctcccaacgtgccggggtgggagagagccaccgcgcctggcctaagctttttaaaatctctaaagcgatctatgcttactgtatatatgtgtatgtagtttaccttaaagcaaggtgtcaggtacaaatccacagggcttgctttacccccattctggtgcatcctccagacccttttctattctgtgtacagagagagggaaataaacaaaaatgggcacccatttttaacatatcctgagctttcttccatattagtacttacagttcttaacaactgcatcgttttccattcagtcctctgttgacattgaggtttccagttttccacattcgtgaatgatggtgtgcatctttgaacatgggtccttgcctgcctaagtatttttgtaggttgatcattgtaaacttggaaagcacaaagacagaagccaggcttgctgactcttgactgatgttgccccagtgatgtcactcctgcaaaatgcaaagcctgcgtcctggctgtcggagcatgtgtggacatttggcagcttctttctcttccctcctgctcttctgtttgttttgattgggaaggatatggagtggggatggagaagggtgttgagtaattatcgatggtttctgtatgtttattgctcctgactagcagtgctgggtttcttctctcagaggaaagctgaaagagattgctttgcttttttccagagttttaaaatcagaggtgtgtgtctcgagtgtattttcagacttttttgttagctttaatcatgtaaaacatgcaaaaaaaaaaaaagcatgtggaaacaattttttttttttgagacgggttctcgctctgtcacacaggctggagtgctgtggggcgatctcggctcactgcaaccaccgcctcccatgctcaagtgatcctcccacctcagcctcctgagtagctgggaccacaggtgtgcatcaccacacctggctaatttttttgtgtttttggtagagatggggtttcaccatgttgcccaggctggtctcttatctgctgacctcaggtgatctgcctgcctcaccctcccaaagtgctgggattacaggcatgagccaccacacccggccggaaacaaatttttgaaggaggcatagatctctgttgtgcaaaatagatactttttgtaccactgggtcctagtttgtcattgttccttgcatgatcccatcagatttgtctacagagctgctggggcatgatggtgtggtggcgtattaagaacgcaggttagtggcacacagatgaaataaatgcatgtggggtgcatttttaagatagcaggtgcaaagttgtatatactgagaccaggcattaacacttgcctattacagtgccttttaaaacactatgtgagggccgggtgcaatggctcacacctgtaatcccagcactttgggaggcctaggtgggcagatcacctgaggtcaggagatcgagaccagcctggccaacgtggcgaaaccccgtctctcctaaaaatacaaaaaattagccagtcgtggtggcatgcacctgtaatccgaggtactagggacgctgaggtaggagaatcgcttgaagctgcgaggcagaggttgcagtgagctgagatcacaccactgcactccagcctgggcaacagagaaagagattccgactcaaaaaaaaaaaaaacaaaaaaaaaaaaaacaaaactggaccaaatgaaacaagtgaatctgatctgcagtcagtcagtttgcaacccctgggaagccttggacttgaatgcaaagatcccttgaacttggatctagtttgcctctgctgctcacatgcacatttagagatggccaaggcatacggtgtttctgcttccaagaaacagagtggttgtcctgtttagccatctcttacagtcacacagcttaaagaagataatgtttgcaaacaatttttgaaatgtctagcacacagcaaacagaaggtcaaattcagtacttaatgctgataaaataagagaacccttgcaagtcatgttgcctgctttctgccacagagagtactgcaatagaactttctgacgttttcatgttgtttatttatttattttttgagacagagtcttgctcttgtgcccaggctggagtgcagtggtacaatttctgctcactgcaacctctgcctctgggttcaagcaattcttgggcctcagccacccaagtagctggaattataggtgcgctctaccacacctggctaatttttgtgtttctagtagagacagggtttcaccatgttgcccaggctggtcttgaacccctgggctcaagcaatccacccacctcagcctcccaaagtgctgggactacaggcgtgcatcgtgacgccctgctgatttgtgtatttttagtagagacggggttcaccttgtgctggtctcaaactcctgggctcaagcaatctgcccacctcagtctgccaaagtgctgggattacaggcgtgagccatcgtgcccggcctctctctgacatttttgaatggcaaaggcaaaaatcttatacttttaaggatgtggagaaataggaacacttttacactgttggtgggactgtaaactagttcaaccattgtagaagtcagtgtggtgattcctcagggatctagaactggaaataccatttgacccagccatcgcattactgggtatatacccaaaggactataaatcatgcttctataaagacacatgcacacgtatgtttattgcggcattattcacaatagcaaagacttggaaccaacccaaatgtccagcaatgatagactggattaagaaaacgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaacgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaagaaaaagaaaaaaaaagattgctgttttatgataaagtgaagtgcagctgttacttcttccttctttgcttccagcatctctcttccctaaggattgcttttaaaatgtaagagtttttggttgaaatgctgttcctgtggtttttgtctcttggttggagtgaaagattttgcaggctgtgatacaaatccagttctctgcttattttctcctcagtccttgaaatccaaaaccagatccctcccattggcccgttgtaattagaacctgccccacaatagacgcacctcctaaagcatctcagattcatttctttcctgaggattaagtttttaaaccttcctggccaagataacagtgttttaagaggctcttttcttttattattattattattattattactcttttctttttttgagatggagtcttgctctgtcacccaggctggagtgcagtggcaggatctctgctcactggaacctccacctcccgggttcaagagtttcttctgtttcagcctcctgagtagatgggattacaggcatgtgccaccatgcccagctaatttttgtatttttagcagagatggggttttaccatgttggccaggctggtctcgaactcctggcttcaagtgatctacccgctgtggcctcccaaagtatcaggattacaggcatgagccacagcaccctgccaggcttgggtgttcaaggaagagaaagaaggcagtgtggctgggacataagtgaatgagaggtggtagggtaagaaatgtgtagaaaactatgcaggggcctgatcacattggatcttgcacatctttttccaaacctcaggaggagtcattctgcttttgttgttactggttcctcacttccgcactttattgtatgctgacaaccttccataccatgggactgagactgccctcaatagtatcaccaatgtctttttttgttttttttttttgaggcagagtttcactcttgtcgtccaggttggagtgcaatggcgtgatcttggctcactgcaacctccgcctcctgggttcaagcgattttcctgcctcagtcttccgagtagctggggttacaggagcctgccaccacacctggctaatttcttgtatttttagtggaaatggagtttcaccatgttggccaggctggtcttgaactcctgacctcaggtgaaccacccgccttggcttcccaaagtgttgggattacaggcatgagccaacgcacccagccaccaatatcttaatggccacacagtgctcattgatagatgccttggccctgggctattgttgctatagaattggtttgatgagtacatattacatgagatctgggctcattagagcttatggcttgagcagggactccttggcctaggtttatgctgctcctggccttgttaatgactgctattaacactctaccccctttttatttttttgagatggggtcttgttctgtcgcccaggctgggaggctggaatgcagtgatcttggctcactgcagcctccgcttctcaggcttaagtgatttttcctgcttcatccttctgagtagctgggactacaggcacgcaccgccgtgcccgtttgatttttgtttttgtttttttagtagacacggggtttcaccatgttgcccaggctggtctcaaactcctgacctcaagtgatctgtctgcctcggcctcacaaagggctgggattacaggcatgagccattgcgccaggcaccactctacccttttgactttgagcaagtaaggtcgttgattccatacattcattaagattcctgcgtggcagaaatctaaccccaactggtataaccaagacaaggaattgattatctcataaccttaaatcaggtgtggctgcatctaggtgttcaaatgatattgtcaggacccaggctctccatcccttggcccagctttcctctgttttggcttcactctgaggcaggctctcccttgtgatagcaagatgaccaccggcagtttcaggcttacctccggcttcaggcttacctccagcttcaggcttaccttaccaaccctagtggaaagagagtttcatttttgacagctatgcaaaaggtctggacctgggccctcactggcttagtatgggttaggcccatccttaagccaatcattggctcagcatgggttagatccgtgactgtcactggctgagcatgggggttaggctcaccctatcattggctctgcgtgaattaggcccacctctgtcactggctcatcgtgggttaggcccacccatgagctgatcactaaggtcgtgaataggcatatgcctcttcccaggtgtggaggatgatgtcagatccctctgaactcatgaaatgagtagggtattctcccaagggaatattgtgctgtcacagaagatggaaaaatgaatgcatgtctggaaaaaacaagcaaaactacaaatcattagctttatatgacatttatttattttttgtttatatgtttttgaaatggagtcttgctctgttgcccaggctggagtgcagtggtgtgatcgtggttcactgcaacctctggctcccgggttcaagcgattctcatgccttagcctcccgagtagttgggatcataggtgcctgccaccacacccagctaatttttgtgcttttagtgtagacaggattttaccatgttggccaagcttgtcttgaactcttgacctcaagtcatctgcctgcctcagcttcccaaagtgttgagattacaggcatgagccaccacgtctggccagctttgtatgacatttcgcctttctgccttgatcaaactttcagagaatctgctttccagagggatgagtgggtcgggaaatagcatgttttctctgaatgagggaaaggattgaaaaagtaggagggagaaaggatgtgaatatgagtcccaacaaatgcagagttatcggtaagttttgtgcttgaatctaggtacaattgtgcatttcctggttctgcatgaattaggcccacctctgtcattggctcaacatgggtgaggctcactaacttccaccagaagttagtggtggtgtctgtgttgacacttacatgtttagcctaatgatttcatgttttaaccaaaactatatagcttgttggttatatcttagaaagtgatggtttttgctcattcttttgtccccagggatacacaccagcctctaagttctcttgagggaaggaagggaccttgcacacaatctttttttttttttttttttttttttttttgagaggaagtctcactctgtcacccaggctggagtgcagtggtgcgatctcggctcactacaacctctgccttctgggttcaagtgattctcccgcctcagcctcccgagtagtggggattacaggcgcacaccaccatgcccggctaatttttatatttttagtagagatggggtttcagtgtgttggccaggctggtttcagactcctgagctcaggtgattcacctgccctggcctcccaaagtactgggattacaggtgtgagccactgcgcccggccttggacacaatcttttttttttttttttttgagacggagtctcgctctgtcactcaggctggagtgcagtggcacgatctcagctcattgcaacctccacctcctgggttcaagcaattctcctgccttagccgcctgagtagctgggactacaggtacctgccactgcgcccgcctaatttttgtatttttagtagagatggggtttcaccatattggccaggctggtctcaaactcctgaccttgtgatctgcccgcctcggcctcccaaagtgctgggattacagatgcgagccactgagtctggcctggacacaatcttacttggattcctcatgcccttttgacaagctcagagcctcaaataaattcagaaaataggtgattacatcaaacagcctctatcaacagggagtatacaaaccgttagcccaactgttaatagaagtctgctttcttgctgggtgtggtggctcacacctagaatcctagtgctttgggagtacaaggcaggaggatcgcttgagcccaggaatttgagaccagcctaggcaacatagtaagaccccatctcttaaaaaaaaaattagcttggcgtagtggcctatacctgtagtcccagctagtcaggaggctgaggcaggaggatcagtgccgcctaggagttcaaagatgcagtgagctatgattgtgtcactgcactccagctgggttgacagattgagaccctatctcttaaaaaaaaaattgcttccctcacctctgctgtgaaacagctcaaagtcctgagagccaaggcccctaccgcccacatcctctagctgttggctaatttatttcatcgtcttttaggtaattctccagaattccatcgctttcctctttttcacctcccagttactcctgcactcagttcttcgtctttcctcctccactgtgtagaaactgttcttgctcacaccgccagtgaccgactttcgctcagccttgtggatattttccagcccttatcttccctgcttctctgttgcatccttgtgacactggaatgtttcccttttttcccttgaaaccgcccactcccaggacagcacagtcttcctgattctcatctctctcactctgtttcttctctgcctccttcggttaccatttcttaaactgcccacctttccaatattggcattcttcactgttccatacacagtccctaggcgattcttccatggtcacgaggaaaagagaaaaaccagctatagacgcatgactttcaaatggatattgttgacccaatttcaaccctgagtttcagctgcgatattgcatcttggtgtgtcatggacatgtcaagctgtgaatgtctgagactgggtttgttatctctccttaacccacccacctacccaagagttttacttgttttttttttttttttgagtctcgctctgtcacccaggctggagtgcagtggcgccatctcggctcactgcaagctccgcctcccgggttcaagccattctcctgcctcagcctcctgactagctgggactacaggcacccgctgccaggcctggataattttttgtatttttaatagagacagtgtttcaccatgttagccagaatggtcttgatctcctaacctcgtgatccacctgcctcggcctcccaaagtgctgggattacaggtgtgagccaccgcgcccggccgagttttccttttgattgtcctttttttttgagacgggatcttgctgtgttgcccaggctggagtacagtggcatggtcatgggtcactgcagcctcgacctctccttgcccctcatcctctcgagtagctggaactacagacacaccaccatgaccagctagtttttgtattttttgtagagatagggtctcaccaggttgcccaggctggtctggaactcctgggctcaagcattccacctgctttggcctaccaatgtgctgggattacaggtgcgaggcactgcacccagccaccttctggaagtctttatctctggtgatggggatggtggcggcacccaattgcctaaggtagagccccagaagatgtcctcacctcctttttctctctcccctgccccgaaaagtcataattcatcaagttctggtaagtttgccttctaaatatttttggagtccatttctgttccctccatcttcattcctactttctttttttttagacaaggtctcactctcttgcccaggctggagtgcagtaccgtgatcatagcttactgcagcctcaaattcctggactcatgtgatcctccttcctcagcctccagagtagctaggactacagatgtgttgcaccacaccagtctaattttttaaaaagtttttttgtcaaggtagggtcttgctgtgtttcccaggctggtcttgaactcctggtcccaagtggtcctcttgccttggcctcccatagtgctgggattatacgtgtgagccactgtacctggcctattctcactttctaattcaggccacgttcctttctcttttcttttttttttttttttttttgagatggagtcttgatctgtcgcccaggcttgagtgcagtggcgtgatctcggctcactgcaagctctgcttcccaggttcacgctattctcctgcctcagcctcccgagtagctgggactacaggcacctgccaccacgcccagctaatttttttgtatttttagtagggacagggtttcaccgtgttagacaggatggtctcaatctcctgacctcatgatccgcctgcctcggcctcccaaagtgctgggattacaggcatgagccaccgtgcctggtctcttttcttttttaaataggatctcacttcatcacccaggctttagtgcagtggcactatcttggctcaccgcaacctctgcctcctgtgctcaggtgatcctcccatctcagcctcctgagtagctgggaacacaggcatgtgccaccacagctggctgatatttttctatttttagtagagacggagtttctccatgttacccaggctggtctcaaactcccaggctcaagcgatctgcctaccttggcctgtcaaagtgctgggattataggcgtgagccactgcacctggcctccaccttcctttctttcttgcattgctgcaggagctccccatcttaggccttgtccttcctctgcctgtccatggccaccaggaccagctttttaagcaggagagcccatcatatcacatcactctcttccctaactttctccaatggtttcccattgccactaagtttcttaacatcttgcaaaagccgtctgtgacttagcccctttatttcagtctgtccaggtaggttcccttccactcgtcacctttcaacccaggcttaccagactccctctagctcccctacaagtgcctggctgtttctcctcattccttcttcccctgctcaattaccattgccttccagttctttcatattcttttttttttttttttgagacggagtctcattctgtcgcccagtctggagtgcagcggcacgatctcagctcactgcaacttccacctcccaggttcaagtgattctaccgcctcagtctcctgagtagctgggagtatgggtgcccgccaccacgcccagctaatttttgtatttttttttagtagagacggagtttcaccatattggccaggctggtctcgaactcctgccctcgtgatctgcctgcctcagcctcccagtgtgctgggattacaggcgtgagccactgcacctggctttttcatattctttcacatgctcctcatgtgtcgcctcttctaggaagccttccttgactttcgggttgagttttgaacttcttaaatatcctgggcactgatagaaatgtattttcaggtgcatacatatttcagaacacaccaatgtgtatactcaaatatatgcaatttattgcatgtcaaaatcctgtgcacatttctgtggctatactaggcacatagttttatcataatttacatggggttgggtgcggtggttcacgcctgtaataccagcactttgggaggctgaggtgggtggttcacttgaggtcaggagtttgagaccagcctggccaacatggtgaaaccctgtctctactaaaaatagaaaaattagccaggcgtggtggcgcatgcctgtaaaatcgcagttgctcgggaggctgaggcacaagaatcatttgaacccaggaggcagaggttgcagtgagctgagatcacgccactgcactccagcctgggtgatagagcaagagtctgtctcaaataataattataattattattttatgcgtaatttccattccagcccccactcccccactccctccaccagactgtgaggcccctttagggaaggcaggcatcttggagacgttttatgtggctccctaggtcctttagtaggtgctcaataaatatttgcatagggatatccatgagccttgatgttaacccagggaatataacaggtgagtggattgtgttttgtttgggtttagcttcagatttttggcagtatttaatcatttaacccagcataaagtttatttatttatttatttattttgacacagagtctcggtctgtcactcaagctggagtgcagtggcgccatctcggctcactgcaagctccacctcctgagttcacaccattctcctgcctcagcctcctgagtagctgggactacaggcacccgccaccacacccagctaatttttcgtattttagtagagacggggtttcaccatgttagctagggtggtctcgatctcctgacctcgtgatccgcccgcctcagcctcccaaagtgctgggattataggcgtgagccaccgcgcctggccaagtttttttttttttttctgttaaaggggatcagctgtttaaccagatgtgggtaatcattttgaaaccttctctcctagacaccatgccacaaggagagtgatctcttcccctgttttcacaatggaggactccggaaagactttcagctccgaggaggaagaagctaactattggaaagatctggcgatgacctacaaacagaggtcagtccgagttcacctgcttttccttttttttttttttttgagatggggtcctgctatgttacctaggctgagtgcggtggctgttcctaggcgtgatcatagtgcacagccgccttaaactcctgggcttaagcgatcatcctggctcagcctcccaagtagatgggactataggtgtgcttcatcaggccaggcttttttttttttggcggaaacaggggtctcgctatgttgcccaggctggtcttgaactcctggactcaagtgatgcacctctgcctcccacagtgttgggactacaggtgtgagctctcttttttctataaaaagaacagcaaccatttattgcaggcctatatgtgccaggcagtgtgaaaggcttaacttacactatctcaaaactgcctgtgaaaaaactattagcaccccattatatagatgaagaaactgagcctcagtgaaggcagataacttgctcacagtcacacagccaataagtagcagagctggaatttgaactccagacctatggtcctgattatcctactatgctactttacattttgttttcttattttctttttcttcttttttttttgagacagagtctcactctgttgcccaggctggagtgcagtggtgccatcttggctcactgcagcctccacctctgggttgaagcaattctcgtgcctcagcttctcgagtagctggaattacaggcacccaccaccacgcctggctaattttttgtgtttttagcagagacggggttttgccatgctggtcaggctggtcttgaactcctggcttcacgtgatctgcccgtctcaccctcccaaagttctggaattacaggcatgagccaccatgcctggccttccatcttattttcttttttttttttttgagatggagtttcgctcttcttgcccaggctgtagtgcaatggcatgatctcggctcaccacaagctccacctcctgggttcaatcgattctcttgcctcagcctcccgagtagctaggattacaggcatgcaccaccatgcccagctaattttgtatttttagtagagacggggtttctccatgttggtcaggcagctctcgaactcccaacctcaggtgatccacttgcctcggcttccctaagtgctgggattacaggcgtgagccaccacgcccggtgtccatcttattttctagaagggtttttatcagttcctagatgccatatctggtaagttctttgtgcacagggaaagagcttttccctatgcctagcaaaatatattgctaaagattttaagatttgaaactcgtgttttggtcagggctcatatctgggaggtgtgtgtgtgtgcgtttggtttggcactgtttttatttataatgggtctttataatttgtacatagaggccttattccagtccccttagtttctttcatttattgaaaaattattttaggtccaggcacagtggctcacatctgtaatcccagcactttgggtaggcagatcacttgagctcaggagtttgagaccagctctagcaacatggcaaaaccctgtctgtacaaaaaatacagaaattagcaggcatggtggcatgttcttatagtctcagctacttgggagcctgaggtgggagaattgcttgagcctgggaggtcgaggctgcagtgacgcatgatcacacctctgcattccagtctgggtgacagagcaagactctatctcaaataaataaataaaaattattttagagtcagggtctcactctgtcacccaggctgaattgcactggctcttcacaagtgtgacctatctcactgcaacccctgggaccccaggtgatccttctgcctcagcctcccaggtagctgggactacaggcgtgtgccaccatgtctggctgatttttaaacacatttctgtagagatgaggtcttactatgttgccctggctggtctggaactcctggcctcaagtaattcttaatgagccactgtacccagcccttcctactttctttattctagtttgacttaaaggtaattcaggcttgatatttttaaaatattccttgaatttggccaggtacaatggctaacgcctgtaatcccagcactttgagaggccgaggcaggcagatcacctccagtcaggagatcgagaccagcctggccaacatggtgaaaccccgtcactactaaaaatacaaaaattagctgggtgtggtgccgcatgcctgtagtcccagctactcgggagactgaggcaggagaatcgcttgaacctggaaagcagaggttgcagtgagacgagattgcagcactgcattgcagcctgggtgatagagcgagactctgtcttcaaaaatattactacgtgatgattaacaattttgctgtagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggtgaggggctgagaggaagtgtgctcaggtgtagacaggcgtccaacacaggcatggcatgcttggctggaagaaggaaccctgcaatgagggactccagaccccaggcccatgctcatctctggaagggcctgtgcggcagacgtgatctttgaactctttgtgcctctagtgggtggtgctttttgttttgttttttttttttttttgagatggagtttcactcttgttgcccaggctggagggcagtggcgcgatcttggctcactgcaacctccacctcccaggttcaagtaattctcctgcctcagcctcctgagtagctgggattataggcgcctgctaccacgcctggctaattttttttgtatttgtagtagagacggggttttatgttggccaggctggtctcgaactcctgacctcgggatccatgatgggtggagctttgagaagcaagtcacacacatgttcccgtggactttcttggttgtgtacactgattttatagggcacatggcagggagacttttttttttttttgaaacagggtcttgctctgttgcccagactggagtacagtggctggattacagctcactgcaccctggacgtctcaggtttaagcagtcctctcacctgggccgggcgaggtggtgcatacctgtaatcccagcactttgggaggctgaggtgggcagatcacgaggtcaagagattgagaccatcctggccaacatgatgaaaccctgtctctactaaaattacaaatattagctgggcgtggtggtacacgcctatagtcccagcttacttgggaggctgaggcaggagaatcacttgatggttggaggctgtagtgagctgagattgtgccactgcactccagcctggcaacagagcgagactccgtctcaaaaaaaaccaaagtccttccacctgaacctcgggagtagctgagactacaggcatgcggcaccatgcctggttagtttttgtattttttatagagacagggtttcgctgtgttgcccaggctggtcttgaactcctggacgcgagcagtcctcctgccttggcctcccaaattgctgggattataggcatgagccaccacctggccagggagacatttttagggtatggaggtgttgctagagtaatatcatcaggtccaatattgtagcccttagctacatttggctgttgaaatttaatgaattaaaataaaaacttaattcctcagtcacagtagccacatttcaagtgcttaggagccacgtgtggccagtgagtttccttagtggacagaggggctgcagaccatttccttcattaccaaaaggtgtgttgcactctgccagttcagagcaggtttctcgacctggctgctgttgacattggagcccggatcatcctccgttgggagggactgaggtttgctttgtgggttttttgtttgtttgttttgtatttttgagatggagtcttgctctgttgcccaggctggagtgcagtagcgcgatctcggctcactgcaagctccgcctcccaggttcacaccattctcctgcctcagcctcccgagtagctaggactacaggcgcctgccaccacgcctggctaaattttttgtatttttagtagaaacggggtttcaccgtgttagctaggatggtcttgatctcctgacctcaggatccgcctgcctcagcctcccaaagtgctgggaatacaggcgtgagccactgtgcccagcctgttttttttttgagatggagtcttgctctgttgcccaggctggagtgcagtggcacaatctcacctcactgcaacctccgcctcccaggttcaagtgattgtcccgcctcagcctcttgagtagctgggattacaggcaccctccaccacgcctggctaattttttttttttttttttttgagacgcagtctcactctgttgccaggctggagtgcagtggcgtaatcccggctcactgcaacctccacctcctgggttcaagtgattctcctgcctcagcctcctgagtagctgagattacaggcacacaccgccatgcctggctaatttttgtatttttagtagagatggggtttcaccatgttttccaggatggtcttgatctcttgacagtgtgatctacccgccttagcctcccaaagtgctgggattacaggtgtgagccaccacgcccggctaatttttgtatttttagcaaggacgaggtttcaccatgttggccaggctggtctcgaactcctgagctcaggtgatccgcccgcctcagcctcccaaagtgctgggattacaagcatgagtcaccccgcctgaccacactgtgggatgtttggcagcatccctggcctccaccctctagatgccagtagcattccccgcacctccaaggtggtgaaaaccaaaagcacctctagacatagccaggtatctggagacccagtgctctgcaaggtaaaaaccatcccttctgtacatgctgtagggctcagcaagggatcactaagtcaacaccgtgccccagagactggctctcagccttagctgccagccagcatcactaggccagcttcataaacatccgacaggcctgaaccctctctccccatccccatctccccgccttgctctgagattccatttctcagtaagtctgggtggggccctggcatgtctgtgtggttttctttttctcattaaactcccaatgtacattttgatgagctgcttcatggaagagtcaaaactgtgtgtgcccagggctaggtatgatggacggtgaaaggggaagtgctggttgccttctttgggaagacaaacctaatgccatgaagcagttggggacgtgaagctcagtcacagaactctgatgtgggggcctttcaagagaaaaaggactggctgggtgcggtggctcatgcctgttatcccagcacttcaggaggccgaggtgggcagatcacctgaggttgggagtttgagaccagcctcaccaacatgacaaaaccctgtctctactaaaactacaaaattagctgggtgttgttgtatgtgcctgtaatcccagctacttgggaggctgaggcaggagaatcacttgaacccgggaggcggaggttgcagtgagccgagattgcaccattgcactctagcttgggcaacaagagcgaaactctgtctcaaaaaaaaaaaaaaagaaagaaaaagaaaggactgcatgggttgagggaggctgtgtggagggtgtttgtaggtgtatgtgttgctgacacttggtgcttggggagatggggctgaaggagagttgatctgtacccatcacagacgtggacaagaatgggtgtcgggtggaccttggcaagcccagctttactaatgtataggaaagggtgtgggaccaacaaatggattgggggtttggggcagggcggaggagaggtcccagacacgttgaaggtggtcattgaagctgaagctttctgttggagaccacagagtgcagctggccgtctgcagatccatctgccccataggtgttgtttgatcgccttcaggggtttttgttcagcatttccccatgaacgttttccagcatataaggctgaaagaatttccagtgaatacctgtgtatccaccaccacctaggctctaccaataatatttcccctacttacttgccttttattatatatattcccccatccatcaaaatttgtaaagcttcctgtaaaaagatggatttctggccaggcatggtggttcatacttgtaatcccagccctttgagaggctgaggagggagaattgcttgagaccaggagttcaaggccagcctgggcaacatagcgagactctgtctctacaaaaaaataaaaataaaaaattcattggacatggtagtgcacacctgtagtctaagctactcaagaggctgaggcaggagcattgcttgagcccaggaggttgaggctgcagtgagctatgattgtaccattgcactccatcctgggtgacagagcaaaagttaaaaaataaaaaacctgagtagtggttgtttagaacacacattgttgagtttcccccaatccccatatccgtgacacggagaccttagtgtcatctgcctctccctgtacttggcccacttcacccatttgttaacagctgaacacctgctacacacaatgagcaatgattatcgttctttttgttgttgttgtttttgctgttggagacagagtctccccctgtcacccaggctggagtgcagtggtgtgatctcagctcactgcaacctctgacttccaggcttaagtgatcctcccacctcagcctcccaagtagctgagattacaggcacctgccacaccacgcctggctaatttttgttattttttgtagagacgggttcatgtgcccatgctagtctgggactcctgagctcaagtgatccgcctgcctcggcctctcaaagtgctgggattacaggtgtgagccactgcgcctggctgattatagttcctaaattgaaggggactctgggttgaaaagctgggtaggaggaagattagtggtatgaactgcagtttggagaggataacaggccctccatggatcctgagtaaaatatcaagagaattactcagtaattctctgcttcaagactgagctcttgggcctggcgtggtggctgatgcctgtaatgccagcactttgggagaccgaggcgggcggatcatgaggtcaagagattgagactgtcctcgctaacatggtgaaaccccgtctctactaaaaataaaaaaattagctgggcatggtggcgcacacctgtagtcccagctactcgggggctgaggcaggagaattgcttgaacctaggaggtggaggttgcagtgagctgagattgcgccactgtactgcagccacatgtcagatgcaggagactcagagcacacagcacagtgaagaaacagggtaccttggaataacgaggaccctgccaccagcaagtatttgtcagtcacctaagagaaatatattcagctgggccggacttcttaacaactggcttattcatcacgggttgaatgaaaaagcctttaagggaccaaacagagcatctattgatgcccccatcagctgacagcttattcgaattagccccaaatggcagcacaacatttcagcaacaggttttcatgtccacaggttccgaggagatctctcaatcgccagtgcagtcggtggagcccactcgctgcgtcctcctggagcctgcgtttgaatttaggttaatgacttaagatcctgttttatttggagatgttcccaaataaagggtgtgaggcgatgagagccacgcctgggaacagggcctggtctgcctctacttgctgggtgcagatacttctctgcttacagccaggaaatggggagggtgctgcgggcggcagcagggatgtggtccgccctcctcatccttccaacgctgtaaatcatctgtttgttctttctttggagtcttcttgcacaatggctctcgccacgcctctctggcctaggcaccattacatcaccctgggtgcatccggactttctagcaacggctttgtttacttgattgagtaaagagaagttggccttttttaacttttaaattagaccttgcgcctttcttgtgggaagtgttttctcttatgtttgtagaatctaggatgggtgttttgtgttttcggttttgatttttttttgagatggggtctctgtcacccaagctggagtgcaggggcacaatcttggctcactgcaacctccgcctcccgggctcaagcgattcccctgcctcccgggtagctgggaccataggcacttgccaccacacccagctattttttgtatttttggtagagacgggggtttcaccgtgttggccaggctgttctcaaactcctgacctcaagtgatctgcccgccttggcctcccaagtagctggaactacagccgtgcaccactatgccgggctaatttttgtattttggtttcgccatgttgccccaggctggtgattttttttttttttttaagcgttggcctgggctagagtgcagtggcatgatcatagtttactggagcctcaacctcctggcctcaagcagtcctcccacctcagcctcccccatagctaggactgcaggtgcatgccaccacgcctggctgttcttaaattttctgtagagatggagtcttcctatgttgcctaggctaatatgcctctgccacctgaggtgctgggattgcggcatgaggcaccgcacctggctctgggtgtttggtgaaggaaagtaatttggaagcagagcaggaatagaatcgagagagcacgggaacgggcaggtgatctggattgagatggtttagggctggttagcataattgcttaaggacacctgctcaggaggctggggtttggtcttggcccagtcatttgctactggttgattctgggctagttaagtaattgagtctcagtgttcatgtctctgaagtggaattaaacgagacaacataggaagtgtacttagcctggaggccagcacagaataagtatgtaatggatgttattgctgcagctggcaacagggaatcattgagaagtgcgctggactgtttctttggtaattaacaagatctccctctctgtctctctcctctccttttctctccctttcccttcctccatcttctccctcccttctgtcttagtttttgtttgtttgttttgagatggagtcttgttcgtcgcccagactagagaacagtggcacaatctctgctcactgcaacctccgcctcctgggttcaagcgattctcctgcctcagcctcccgagtggctgggattatagacaacgcaccaccacactcggctaatttttttttgcatttttggtagagacggggtttcaccatgttgtccaggctggtcttgaactcctgacctcaggtgatccacctgcctcagcctcccaaattgctgggattacaggtgtgggtcactgctcccggcctgtctttgtttttaaacccagagattggaatgttctttctgtctccatgctacaacggagagtcctggatcaaaaattcagaataattgactgttgtgtaaaccaagtacatgctgctctcccattgttgtgggcacaaacaacagaagtcattgagattcctttttttttgctttttgagatagctgggtctcactctgttgcccaggttggagtgcagtgatgcaatcacggctcactgcagcttcaacctcccaggctcaaatggtgttcccatctcagcctcctaactgggactacaggcgacgccaccatgccctgctaatttttattttttgtagagactgagtctggctctgtgggccacgctggtgactctttgtaatacggtgataatgtgtgaaagcaggcttgcgttgcccctgtggatgaggcttggagaggtccatgtggctttctttggttgtggacaccttgggcagaatgatttgtctgaagattgctgggggcttcagacaatgatttgtctgaagattgtgggaaccaggtttgggagtgggcaggattcaaggtgctcaaggggcaggaggtgggaggcacttaggacataattgaaacagttattcagtgtgcctgcctgcccgccccctcccagtcccccaccactgccagagagttttgctcttgttgcccaggctggagtgcaatggcacgatctgggctcactgcaacctccgcctcccgggttcaagagattggcctgcctcagcttcccaagtagctgggattatagacgcccgccaccaggcccagctaattttttgtatttttagtagatacggggtttcgccatgttgccaggctggtgattttgggtttttttttttttttgcttgttttttttaagtgtcgtggtctcactctgtggcctgggcgggagtgcagcggcgtgatcatagctcactgcagcctcaacctcctggtctcaggcagtcttcttgcctcaccctcccaagtagctaggactacaggtgcatgccaccacgcctggctgttttcacattttttgtagaggcagagtcttgcccaggctggtcgagaactcctgggctcaagcaatcctgcctctgccacctgaaagtgctgggattacaggcatgaggcaccacacctggctctgggtgtttggtgaaggaaagtaatttggaagcagagccggaacagaatcaagagagctcgggagtgggcaggtgatctggattgaaatggtttggggctggttagcataattgcttaaggacacctgctcaggaggctggggtttgatcttggctcagtcatttgctaccagttgattctgggctagtcaggtcactgagcttcagtgttcatgtctccaaagtgggattaatgagacaacataggtggtgtacttagcctggaggtggcacagaataagtatgtaatggatgttattgctgcagctggcaacagggaatcattgagaagtcagctggactgttcctttggtaattaacatagatctctctccctttccttccctctccctcccttcctctctcctctgtctcccttcctctctcctctctctccctcccccattttatcccctccttttctccctccttctttttctttctttctttgtttttctggtttttttttttttttttgagacagagtctcgctgttattgcccaggctggagtgcagtggtgcaacctccgcctcccgtgttcaagcgattctcccgcgtcagccttctgagtagctgggattataggcatgcaccaccacgcctggctaatttttttgtatttttagtagagtccagatttcaccatgttttcgaggcaggtctcaaacttctgacctcaggtgatccgcccacctcagccctccaaagtgctgggattacaggtgtgagccactgcgcctggcctgtctttatgtttttaaataacctagagatcaaactgttccttttttctccatgtcacaacggggagtcctggatcaaaaattcagaatggcggactgttttaaaaccaagttcatgctgccctcccattgttgtgggcacaaacaacggacgtcattatgatttctttccttttgaggcagcagggagttgcccaggccggagtgcagtggtgccttcacagcccactgcagcttcgacctctcaggctcgaatggtcctcccacctcagcctcgcgagtagctaggactacaggcaagagccaccatgccctgctagtttttattttttgtagaggccaggtctcactctgtgagccgggctggtgactctctttgtaatacactgatgatatgtgtgaaggaggcccatgttgccgtgtggatgaggcttggagaggtttacgtggcttgctttggctgtggacaccttgggtagaatgatttgtctgaagaatgatggaggctataggaatctcaaccctgttgagagtaggcaagattcaaggtgctcagggggcagaggcactcaggacataattaaaacagttggtccgttgtgcctgctttgaatgacacctgcctgttcccaccacgttacatcacttgcctaagagtcagctctggagagaaggttctgttgactgagcctggcttgtctcccgattgtggtgggagggtgggacagaaagcctggagccccacccagggagtgtggtgggaggagtagtttcataaagagagagggtcaggccaggtgcagtggctcacacctgtaatcccagcactttgggaggccgaggcgtgcagatcacttgaggtgtcaggagttcaagaccagcctggccaacgtggtaaaacccggtctctactaaaaatacaaaaattagccactattgttggtgggtggctgtattcccagccacttgggaggctgaggcaggagcattgcttgaacctgggaggcagaggttgcagtgagccaggatcttgccgctgcactcaagcctgggcaacagagtgagactcggcctcaaaagaaaaaaaaaaaaacacggagtcttgctgtgttgcccaggctggagtggagtgttacagtcatagctcactgcagcctctaactcctgggctcaggcagtcctcccagtttagcctcccgagtagctgtgactccaggtggatgtgtgctactgtgtctagccttctcagaagtcttaagtcattcactcagtgtctgtgttgtccttcaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcggtatgggtggaagggaaaagcacgagtgggagactctcctctctgctttttgtccccagcagctgggtactgggccctgtgctgagtatagggaactaagcagtgagcagaacaaagccagtgcccttctggattttagtgcccggggggaaatggacaatagtcgaagaagtgcaatttcattacagcagcaaggctggcagcccagggtgctgtgggggtgtgtaataggatgtattaatttggctgttggcctgggagcgtcaggcgagccttaccaggggaaatgctatttaggctaagaccagaggaatgagtagccatgatgccaggaggggtgtgagacaagaacattccagacagaacaccaagcctgtgctaagcccctaaggtgggaaggaagctttttcaaagaacagttttttgtttttttttggagacggagagtctctgtcgccaggttggtgtacagtggcgtgatttcggctcactacaatccctgcctcctggattcaagcaattctcatgcctcaggctcctgagtagctggaattacaggcacgtgccaccacaccattctaatttttgtatctttagtagggatgggctcttgccatgttggccaggctggtctcaaactccttagcctccaaagtgctgtgattacaggtgtgagccactgcgcccagcccagtgattcctaaactgatgttctgtggtttagcagaatgataatgactaacatttacagaagaattactctcagccaagcagtttttttggataagaacacttgtttttaaaaaatttatatatgaattatatacagtgaaatgcgcagatgtggccaggcacggtggctcacgcctgtaatcccagcacttttggaggccgaggtgggcggatcacgaggtcaggagatcgagaccatcctggctaacatggtgaaaacccgtctctactaaaaatacaaaaaattagccgggcgtggtggcgggtgcctgtagtcccagctagtcgggaggctgaggcaggagaatgatgtgaactgggaagggcggagcgtgtagtgagccgagattgcgccactgcactccagcctgggtgacagagctagactctgtctcaaaaacaaaacaaaacaaaaaacaacaaaaaaacaaaaaaagcacagatgttttttcttttatttatttttggaaacagggtcttgctctgttacccaggctggagggcagtggtgccaccatagtgcattgcagcctgaaacttctgggagcaagtgatcctcctgcctcaacctcccaaagttctggaattactggcatgagccactgcacccggcctcctcagagagttttttttctgcctcattctttttctcctgtccgtctcggacgccatctatacacataacctttttatattgtcaggcaggttcctaaggctctcttcatttttcttttccctaattatttttttgtctttgttcttcaaattgaataatttctgtttatccagtttcaagttgatagacgccctcttctctctccaatctgccattatagcagatgaaatattgaattttcaatatattgtatttttagatgtaggatttgtgtttgttcttttataatttctgttctattgaggtttcttgacatccttgagcatagttgtaagagctgctttgaggtccttttgtgcagttttcaacatctgggtcacattttctttatactccacgcattcaataactttggggttgtattgtaggcagtgtgagtggtgtttcccacgtggtgtttcccacagactattagttgttttttgtttttgtttttgttttaagacagtcttgctctgtcgcccaggctggagtgcagtggtgcgatctctgctcactgcaacttccacctcccagattcaagtgattctcctgcctcaacctccggagtagctgggattacaggtgtgtgttaccacacccggctaatttttgtatttttagtagagatgggatttcaccatgttggccaatctggtctcatactcctgacctgaggtgatctgcctgcctcggtctccgaaagtgctgggattacgggcttgagccaccatacccagccagagatgatgaattcttttatgttcttgatttatttggttttcttaggtggtttacttggctgagcttacagcccaaattctgtctcccctttgatgggcagtagctgaaatctctttgctttttttagccgtaactgggctgctttgtgtctgctctgtgcacgtgtggtttgggggaggccagagatgtgggaagatactatattcagaatgtgggggggcccacggtgatagatttctatccctggagctttaggcaaaaatcttgtaaagatgcagacttcacccagtcttgttctgtttttctaagcgttgttttccagttcctgccagtgcactcagattattgttgtaaacattttacttagaatttatacgaggtttgatctgatacaggtttcctggtcattaccagaagtggaaattcctttcttgtcaatctgtaggagttctttgcatatatatattttttgagatggagtctcgctctgtctcccaggctggagctggagttcagtggtgtgatctcaggtcactgcaaccactgccttcctgcttcaagtgattctcctgcctcagcctcccaagtagctgggattacaggcgccccccaccacgcctggctaatttttgtatttttagcagagacggagttttgcgatgttggagaggctggtcttgaactcctgacctcaagtgatccacctgcctcagattcccaaagctggaattacaggcatgaaccactgtgcctggccctttgtatatttttactactaatcttttctcctgcattgaaaataattttttccgtggtaatcttttgtttgttgactttgtctattgtatcattttccatacaaatatttccttttttctcttttgaaaaaaaattttttatacatgtatttttcatttttaggtcatcagttacatctttttttaaataccttctaggtttgcagatttcactagggaagtctccttggttcttgattgttcatgtgttttgtgttttttttgcaatattttttaattgtttaatttttttgtatccttattccttagtctgcaatgaatttatttttgtatctagtataagatacaagttcaattttatttttattttctttaggtggatagcccagttgtgccagcactgttaaacactgccttttttttttttttttttttttttttttttgagactgggcctcgctccattgcccagagtagagtgccatggtgcaattacagctcactggagccttgacctcctggggcaagtgattctcccacctcagcctcctgagtgtctgggactataggcatgtgccactatacctggctaatttttgtattttttgtagatacagggtttttccatgttgcctaggctggtctcaaagtcctggactcggtctgtccaccttggcctcccaaagtgctgggattataggcatgagccaccatacccggcctttggcatattttaaaattgggttgttcgttgttttttttcccatgatttctaggagatttttatatatttgtctgtgacatgaatggacagtattgggagtttgtcatttgtttccagctttgtctgatgtatattttattgtacagagttactgatttgttttgttttgagtcagagtcttgccctatggcccaggctggagtgcaggtgcaggatctcggctaactgcaacctccaccctcccaggttcaagctattctcctgcctcagcctcccaagtagctgggattacaggcgcccactgccacgcctggctaatttttgtatttttagcggagatggggtttcaccatgttggccaggctggtatttgatttttttgtagtcagatttcttagtcatagttagaagggccttgtgcactccaaggtttataaagcaattagccaagtgttttcttgtagtatttttgttttttctttcttttctatttttatttttgtactaaacgtgcattgtttttgttaatacaatttggccaaatgctgaatagtttagtgttaaaaatcggatgaggtagaagcccagttcaccattatagaatcaataaagttctaggtcaccaaagttttatgtatttatgttttgagacaaggtctctctctgtcgcccctgctggagtgcagtggcacgatcacttcagcctccccagtagctgggactacagtcatgtgccaccatgactcactaatttgtgtattctttgtaaagaccgggtttctccatgttgcctaggctccaaagctttattttaaagacttgaaaatgttacaattttgtgcaagtttaatagttatatttagaacgtttgacagtcttctccaagaacaagagtttctcagcaccatcagctgtttgattgctctcatggtccttcttctatacgtccctcaaacgaaactactcacttttaactgaggacaggcactttgtataagaataaccttgaaaagtgtgcaggacctaattggaagtaactaaaaattaaatacatttcctaaaggttactttgtttcatatgagtactaagatgccaaaaagttttacaaaaattcaaatagatttaatctagttttactcttttcataagtttttcattttattttatttatttatttttgagacagagtcttgctctgtagcccaggctggagtgcagtggtgcgatcttagctcactgcagcctctgcctcccaggttcaaatgattttcctgcctcagcctctcgagtagctgggactacattgcatgtgccattatgcccagctaatttttctatttttagtagaaatggggtctcaccatggtcctgacctcaagcgatccaccacctcggcctcccaaagtgctgggattatagccgttagctctcacacccagtccaacttacacattttttttttttaaagagatggggtcacacagtgtttcccaggctggtctcaaactcctggattcaaacaatcttcccatctcggcttgccaaagtgttgggattacaagcatgagccactgtgcccagccaattccatggacttttaaagcattttttggctcaaaaaggatatgttcttagttatctaaccagtatatctctttatatttactgaaaatctgttttcctatttaagtattttcaggttctcaataactgcacatgaaattaacagctttcatagtcacaaattattgcaatattttgctgttatactaaatatgggttttttttgtttgtttttaagacagagtctagctctgttacccaggctggagtgcattggcacaatcttggctcactgcaagctccgcctcccaggttcatgccattctcctggcctcagcctcccgagtacctgggacaacaggcacccgctaccacgaaccggctaatttttttgtatttttagtagagatggggtttcgccatgttagccaagatggtctcgatctcctgactttgtgatccacccgcctcagcctcccaaagtgctgggattacaggcactaaatatgcttttatacattagttgacagaatttcaacatataaaatacataaagcaattttcactccagttacaactagcatgctgacctttatttcaaagtaaatacgctaggtgagatagctcatgcctgtaatctgtcatcttagtacttggggaggctgaggcttgagtattgcttgagcccaggagtttgaggacatcctgggcaacatagtgagactcccgtctctagaaacaaatataaaaactagccggctatggtagcttgtgcctgtggtcacaactactcgggaggttgaggtaagaaggtgaaagaatcgctgggcgcattggctcacgcctgtaatcccagcactttgggaggctgaggtgggcggatcacctgaggttaggagttggagaccagcctgacaaagatggtgaaaccctgtctctactaaaaatgcaaaaattagccaggcatggtggcaggcgcctgtaatcccagttacttgacagactgaggcaggagaatcgcttgtacccgagaggcggaggttgcagtgagctgagattgtgctgttgcgctccagcctgggcaacagagtgagacttcatctcaaaaaagaaaaaaaaaggtgaaaggatgacttaaacccagggtgtcgaggttgcagggaaattcagaaatgccactgaagggccaggcatggtgtccaacacctacaatcccagcactttgggaggcagaagcaggtgcatcacctgaagtcgggagttcgagaccagcgtggccaacatggtggaatgctgtctctactaaaaatacaaaaattagcaggatgtggtggtgcgtgcctgtaatcccagctacttgggaggctgagacagaagaatcatttgaaccccggaggcagaggttgcactccgcctgggtgacaagagtggaactccatcttaaaaaaaaaaaaaaaaaaggcactgaagctggtccccagttccctagcattccagaagcaaaatagattttgaccaaataaggagtttgttaaaatttccgattcagtcggagtttgtgttagggtacagtatgaggtacgaatctaataattttttcctggtgggtacccagtggtccctaaaactagaactgaacctgccatctttttaccaatgatctgtgatgccacctttattataaattaaactcttgtctatttctggacctttggttcctttgttcttacaaccagtagcatactattcttcattgttgaggctttatagtagtgcgttctgactctctggtagagctagttccctgatctcttttacagagttcctctgatcattcttgtttcattgtcacaggatctttcaaatcagtccagtttattcccccagtagaaacgtattaagacagtgttaaatttatcagtttaacttgtggagaattaatttctgcatgataatgggtcttcctctttatatactcagtatgtctgcatttctgcaagcattctgtactactctacatattattatgtgaatattttatctttgatatgtcaaccttagggctgttttaactgtttctggtattgtactccgaagtattatccctttgttgttggtagtagtgtgttttttgtttttgtttttcgagacagggtctggcattgttacccaggctggagtgcagtggcatagtcatggcttactgtacccttgaattcctgggctcaagcagtcctcctacctcagcctccgagtagctgggactacaggcacgcatcatgcacggctaatttttttactttttgtagagacagggtctctctatattacccaggctggtcttgaaccctgggcctcaagcggtcctcacaccttggcctcccaaagtgctgggattataggcatgaaccactgtgcttgtccctttgttgtttttaatcggtactgtggtaactttatcctatccactacttctaaagaccctgtgagggtaggtacttgtatgactccatctagacatagtaggatatgttgaataaatgaactgatgcagccattaatcagtgcagttattaatttggtgattgaaggaactgaggatgaaggagatcaagttccgcaatgatactcagtgagttctaggtggaggaggagctgggtgttaactcctgggttcctctccaaacacgtgcttctgaccactgtgggatacagttagcaggttgtgtaaggtctggggacagacacagggtcaataataaaaattgctgaaaatttatagatgtgtgcttatgtgtaaaacatctgttgtgtgcttcctgtaggattttttttttttttttgggaaacattcttactctgttgcccaagctggagtgcagtggcatgatcttggctcactgcaacattcaccttctgggttcaagcgattctcctgtctcaccctcccgagcagctgggactacatgtgtgcaccatcatgcccggctaatttttgtatttttagtagagatgaggtttcaccatgtcggccaggctggtctcgaactcctgacctcaagtgatccgcccgcctcggcctcccaaagtgctgggattacaggcgtgagccaccgtgtccgggcctgtatgacttcttgccaccccttccccaccacaatcctgcatgaaggttactattactatccttgttttgcatgagagaaaactgaggtgcagagaaggtggttttcccagaattataacagattgttttcttacagcacttggcagtgcctttaccacagtgtttatgcccttcacaagaaggggttgtgagcagggcagctgggctggtactgggcattttgaacttccactgagaggttaaatatgatctcttccacctgcttaagtgcatcttatgcctggcacaatgcctcatgcctgtaatctcagtaactcaggaggctgaggcgggaggatctcttgagcccaagagtttgagattgcagtgagctgtgattgtaccactgcacttcggcctgagagacacagcaaaaacctgtgtcttaaaaaatcatgttgttatatgtgtttattaggttattattattttgagatggagtctcactttgttgtctaggctggagtgcagtggtataatctgggctcactacaacctctgcttcctggcagttctcccacctcagcctcccaagtagctgggattacactacaactggctaatttttgtatttctagtagagacaggattttgccatttgcccaagcttgccaggctggtcttgaactcctgatctcaggtcttccacctgcctcggcctcccaaagggctgggattacaggcatgagccaccttgcccagtcatattaggttatttttaatgctggttggcattgtgagcttgcaagagaagatggagcatagtggtcttctcaaaccaccaaatgccacatgcagtcctgatagggctttggcttattgctgagtgctgtgtgggcagcatcttatttaatcctcatgacagcctcgtgcaccccatgagctatgatgagtcccattctgcaggtaaagagcccatgccccagaaggttaagggacttggcccactctgtggcatctaggaagtttggggctgggacttgtgcccaggtgtgtctgacccttcgcacctcctggatccgcggtgctggagggatgctgcggtttgtcctcttggataactctgcttttctcttcgccagcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagaggtcaggaggccttggtgtcttcaccagcatggtcccctctccctacctgagcaacatcttgtcccacaagctctcccagcattatctttacagggaccccacaccctgctctgcacccaggttgtctaatcagagggtgtcggactgcactgggcagactcttgccttgggccctggctggagctgagaacagtcagacatccagccctgtaagggccccttatgggtatttagagaaatagctttggggttcacagatgaagtccttgtattgggattctgcctctgggcagcagaatttatttccagaaagatgcttcctggtctgtaattcacaaacacagcaaactaccctgatgctcagtaggaacagagagttttgtggggagatctggcacagtggctcacacctgtaatcccagcactttgggaggccgaggatctcttgagcccaggagtttgagaccagcctgggcagcatagtgggactccatctttacaaaaacatttaaagattagctgggtgtgatggcatgtgcctgtagtcccagctactcaggaagccaaggtgggatgattgcttcagcccaggaggtggagtatgcagtgagctatgatggcaccagtgcactccagcctgggtgacagagtgagaccctgtctcttaagaagcaaagatgttgtggggagaaatttctggtggaattgccagctagcctattatttttgtgacttgatggcaaccaatatatttggctaaaactttgaaacctcatcagcatttgctctttttcagttggcacttccagaggtagaatgttgaaactgtaatgaggcatttggccaggcacagtggttcacacctgtaatcccagcactttgggaggctgaggcaggtggatcacctgagctcaggagtttgagaccagcctggacaacatagagaaaccccatctctactaaaaatagaaaacatgagggtatggtggtgggtgcctgcaatcccagctgctcaggaggctgaggcacgagaattgcttgaacctgggaggtggaggttgtagtgagccaaaattacaccattgcactccagcctgggtgacagagtgagactcttgtctcaaaaaaaaaaaaaaaaaaaagacattcattagtggattgtccaagttgtttttacctttttttttttttttttttttttttttgagatggcgtcttgctctgttgtccaggctggagtgcagtggtgctatctctgctcactgcaacctctgcctcccaggttcagcgattcccctgcttcagcctcctgagtagctgggactgcaggtgtgcaccaccatgcctggctaatttttatatttttaatagagatggggtttcaccatgttggccaggctggtcttgaactcctgaccccaggcgatctgcctgcctcggcctcccaaagtgctgggattataggggtgggtcactgttgctggcccaattaattatttataacgtcgatttgctttctaatgtgtaaccagtaggtgggggataaaaagtaaaaattcttaagtttaataaagtagttgttcctagatgtccatcagtaatgaagtggttaaatgaagtacatagatgtattttgtgaaatgttaatggttaaaatgaacagtagatagaaatgttgtggtagaaagattgccaaggctaggcacagtggctgatgcctgtaatctcagtgctttgagagacggacgcaagaggattgcttgagcctaggagttcaagatgagcctggacaacatagtgataccccatctctacaaaaatgaaaattgtaaaaattaggcctggtggcatatgtctgtagttccagctacttaggaggctgaagtgggaggatgacttgagcccaggagttcaaggttacattgagctatgattgtgccaccgcaccccagcctgggtgactgagtcagaccctgtctctaaaacaaaaatcattgccaagacataccactgaagtggggagagtaagtcatacacaggacaacatattgtatgtttccagtaatgcttaataaaaaattttcttgttttatgctcagtagatacatacatatgtataaagtttatgtttgaaaatggagagaacagctgggcgcagtggctcacgcctgtattcccagcactttgggaggccaaggtgggtggatcacctgaggtcaggagttagagtccagcctggacaacatggtgaaaccctgtgtctactaaaaatacaaaaattagccaggtgtggtggtgcgtgcctgtaatcccagctacttgggaggctgaggcaggagaatcacttgaacccgggaggcagatttacagtgagccgagactgtgccactgcacttaagcccgggcaagagagtgaaactccatctcaaaaaaaaaaaaaaaaaaaaattcagagaacaatggttgaaaagctctcccacatgttatggtgatgatgagtgaggaggagcatttggggatagtctggaaagcatactttatttatttttgagacagtcttgctctgtcacacaggctggagtgcagtggcgtgatctcagctcactgcactcactgcttgtcccccaggctcaagcgattgtcttgcctcagcctcccaagcagctgggactacaggcgctcaccaccacgcatggctaattttttgtatttttaatagagacggggttttgccatgttggcctgaaaattcctgacctcaagcaatcctcccatctcgacctctcagagtgctgggattataggcttgagccagtgcaactggcctttttttttttttttcttttttttttttttttttttttttttttgagccagaggtctcactctcgcccaggctgaagtggtatgatcatggcttactgcagcctcgacttactggattaatgtgattcttacacctcagcctcccaaagtgctgggattacaggcatgagtcactgctcccgggcatattttcatttagtgttctaaatacactgctatgttggaattgttttttcaataataaaagcattagtgtgtcactgtcatagctttttaaaaatctgaaaccattttgttagtcaagagaaacatcctgtagagttccaagtctgctaggcaaggtcctgtgggtttccctttatttggggtttctacctggagtgtttcaccccagtaggtcttttttctgactggtatctactgttgaacctctctccctgcaccccaccaaccctaagcaaggacttaaattccctttttgttttttgagacgtagtcttgctcttgtcacccagactggagtgcgctggagcaatctcagctcactgccaccctggcctcccaggttcaaatgattctcatgcctcatcctcctgagtagctgagattacaggtgcctactaccatgctgggctaatttttgtattttcaatagagatgaggtttcaccatgttggtcaggctggtctcgaactcctgacctcaggcgatccacctgccttggcctcccaaagtgctggcattataaacatgagccactgcgcctggctgaggacttgaattcctgaatcctttttctggcacagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggtaaggggagtgggaattgcaggattttctcggttcacaaagtgtttctgggtaagaatctggggtgggtcctgggggtgtgatgatttgcatcaggctcagagcctgatttgctctcaggctttgagcagagagtagactgggatgttcttggggatgggcattgagatcagtgaggactgggtaagaggcagtagtggagtctgatgaaatggaaaccccacccagagcgggtggctgccactctgcagctacgaggattggcccttcatctgcagctttttccattcttcaaagccagaaatcctctttttttttgttgggtttttttttttgagacaggatctcactctgttgcccaggctggagtgtagtgacgtgatcttggctcactgcaacctcttcatcgtgggctcaagtgattctcccacctcatcctccggagtagctgggactaaaggcacctggctaacttttgtattttaggtggagacacagtcttgccatgtcgcccaggctggtatcaaattcctggactcaagtgatccgcccacctcggctgatcccaaagtgctgggattacaggtgtgagccaccgcgcctggtcaaaaatcctcttgttgaatataaaacctcccaaatttgaaatgtcactgaccaaatacaaaaaagtaaaaagcgttctgtgggtttagtaatacatccaccgagagctagactcagcgtaacgtgtgctgcatgggcagaaaaaaagaatctcagttctcaccccagcccctctgctgacagcttccgatcaggccttttacagcagatattaataacagacagttaaggagtgctcagtgtgtgctggccagcctgcagccttcgccgcaggcccaggatgcaggtgctgtccccgtttgatgaaagtgaggctctgagttaagcagagtcatgaagcaattgaatggcagatggtttgggattcagacccaggcaggcaggctccagggcttaccctaccatctactaccttatcccttagcttgtcccctgggcatgaagagaccagtgagacttctagaattccggtgcagagcccttctgtttagttttgttgagatggagttttgctctgttgcccaggctggagtgcaatggtgcgatattggctcgctgtaaccccctcctcccaggttcaagtgattctcctgcctcagcctcctgagtaagcttgaattacaggtgcccaccaccatgcctggctaatcttgtatttttagtagagatggggtttcaccatgttggccgggctggtctcaaactactgacctcaggtgatctgcctgcctcagcccctgaaagtggtggtattacatgtatgagtcactgtgcctagccccagtctagagccattttgcatactttatttcattgttgtttttagagacacagtcttggtctgtggcccaggctggagtgcagtggtgcaatcatagctcactgcagcctccaactcctgggctccagtgatcctcctgcctcagcctcctgagtagctgggactagaggcatgcaactccatgcctggctatgtttccacacttcaatatgcatgtagcttacctggggatcttggtagaatgtacctcagatcaagtgggtcttgggtggggcctgaaatttctttctctctttttttttttttttgagacaaagtcttgctctgtcggccaggctggagtgcagcggcattgatcttggctcactgcagcctctgcctcctggattcaagcgattctcatgcctcagcctcccgagtagctgggattacaggcaggcacctgttaccatgcccagctaattttgtatttttagtagaaacaagattttgccatgttggccaggctggtcttgaactcctgacctcaactgatcgaactgcctcggcctctgaaagcactgggattacaggtgtgagctactgtgcctggccgagagattctgcatttctaacagttctcatgtgctgctggtgcatggaccccacttggagaagagaggctctgcagagcgggacccttgtaaagctggatcatcctgtctatagttcttgtatctatcacagatgccattatgttaattaactatatggattttctacaatttcaaaaggatttgttttgggtttgtttaaaaagactaatgtggctgggcacggtggctcatgcctgtaaataccagccctttgggcggccaaggtgggaggatcgcttgaaactaggagttcatgatcagcctgggcaacatagtgagaccctgtctctattaaaaaaaaaatttgttaaaggccaggcatggtggctcacgcccgtaatcccagcacttttggaggccaaggcgggcagatcatttgaggtcaagagttcgagaccagcctggacaacgtgatggaactctgtctctactaaaaatacaaaaattagccgggtgtggtggcacatggctataatcccagctactcaagaggccaaggcaggagaatcgcttgaacctgggaggcggaggttgcagtgagctgagatcacatcaccgcactccagtccgggtgacagagcaagactaacatgtaaaaataagtatttgttgcagtcatcacaaggacttgaaaaattggttgtcatacgggccttgggtgtgtgatgcggttaactacggaaagaaatagggtagcttttgggatccgaggaaaggcgtcagtgtccctcctgtcccgtggttttggatctagcgatgttaacgcacagacatgactataggttggtgagttacatgctcttccctttgcacacccaggcctggacgactccaccggggggacccccctcacacctgcggcccggatatcagccctcaacattgtgggagacctactgcggaaagtcggggtaagaccacactttcctggcgtttggtgccttcctgcctgtctttcaggatgtgtgaagggggttgatctagttccttccctctcttctttttttctttttttttagagacagggtcttgctctgttgctcaggctggagtgtagtggtatgatcacaactcactgcagcctcaaaatcctgggttcaagcgatcctctcaccttagcttcccgaggagcttggaccacaggtgtgcgccactatgcctggctgatactttcatttttttgtagtaatgtgggtatcgctgtgttgcccaggctggtcttaaactcctggcctcaagtgatcctcccaggttggcctcccaaagttctgggattacaggcatgagccaatgcgtccagcccctttcatagcagtgtggtgagttttaggtgtggctgctcctttagcatccctgggaatcattagagcttcctgtgggagttactgccagacactcagagctctgactcgaagccctgctctgaaccctatgtatgtctctttccttttaccgtttttcctctaggaaatttgggaaattagggtgatatgtgtgttttttccttaactcgaaaaattaaggagcacttggaaactgccttctcttttggccgggtgctcatacctgtaatcccagtgctttgggaggccaaggtgggagattacttgagctcaggagtctgacaccagcccgggcaacatggtgaaaccccctgccccgacttggcctctacaagaatgcaaaaattagccaggcctgatggtgtacactggtggtcccagctactcaggaggctgagaggtgggaggattgcttcagcctgggaggttgaggctgagtgagctgagattccaacactgcactccatcctgggtgacagcacgacgttgtctcagaagagaaaaaaactgccaccttttttttttttttttttttttttggtttgtttcttggggtttaagtgaattttgacactttgggagaccgagatgggtggatcacctgaagtcaggaattcaagaccagcctggccaacatggtgaaaccccatctctactaaaaatacaaaaattagccaggaatggtggtgggcacctgcgatcccagctacttgagaggcttatgcaggaaaattgtttgaatccgggaggcggaggttgcagtgagctgagatcgcaccgctgggtgacaaagtgagacttggtctcaaaaaaaaaaaaaaaaaaaatcttgaaagcctagggcaaagaatttggcctttcagcttttatgttaattacagggagggatccttttgtgcttaagtaaaaacataggtattctttgtagtttatttttaaaaatgatgcctagaaggccacataatttaactcctaccaagttgtcactgtacacagtgtatttgtagctacaacttaatagaagcttgcaactcatttcttttgtttttacttctggtttttggctgtctggtttgctattctagaagcaggtctgcatttcagtatttagcctagttggagtatagagaagcctggggtgctgtcagtgtccttttggtttcctcagggtctgttgtagccagaccaagtccttaccaaacttcttgccattctgcagaggtttaacaaggtaaaccaaagggtgaaggattccagaagtggatttcctacttcctacaagcggagttggataattggtaggttagtgatttttccagaaagctcccattttaaaaaattttttgtaattaaaaaagaattttttttttttttttaagccaagcatgattgtgcatagtcctagctattcaggaggctgaggtggaaggattggttgaggctgcagtgagccgtgatctttttccaggcagctcccaaacattttaaaaaatttttcgtaattaaaaaaaattttttgcattaaaaattttttttattaactgggcatgattgcggatgcctataattccagctgctcaggaggctgaggtgggagggattggttgagcctgggaggttgaggctgcagtgagctgtgatctcaccagtgcactccagcctgggtgacacagcgtctaaaaaagtaaaaaacaaaacaaaaaaaaaaactgagatgggatcttactttgtggcccaggctggtctcaaactcctgatgtcaagccatcctcctgccttggcctcccagagtgctgggattataggtgtgagccattgtgcccagccagctcccaaatacttaaggtgcttggttctgagactggcatatacgttggattcctcttggggtcccaccttggaattccagtgcacaacagtttgagaaccactgtctggggttcgttcttctgtacaggctctggtaagacagaatagtccttgcctataacttgagagataaaagtgtatttctgtccaggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggtcagtaccttctaataaacctctcgctggcggggagaacccgcctgccccaggcaagagacactcacccccagcccacagccatgtgtctttttaaattataggattatttcagcaaaccttatcctctcctctgctccctgcaggcagcattaggtggtgtcttgtggcttgaacaaagggctagagagagggtcttgttttgtgagacagggtctcactctgtcacctaggctagaatacgatggcaggatcatggctcaccctctgcctcccagctcaaacgatcctcccacctcagtcccccgagtagctgggagtacaggtgcgtgtcaccgtgctcggctaattttttgtattttttctagagacaggttttgccatgttgccgagtttggtctcaaactctgagcttcaagtgatcctcacccttcatcctcccaaagtgctgcgacgacaggtgtgggctaccatgcctggccaagaaggtcatttttatcatttgattctacagctgctactcacggttacactgtgagaatgtcctgtataaaagcccttatttgggccaggtgtggtgacgctcgcctgtaatcccagcagtctgggaggccaaggcaggtggatcacttgaggtcaggagttcaaaaccagtctgggcaacattggtaaaaccccatctccaccaaaaaaaatagaaaaatgagccaggcatggtagcatgtgcctatagtcccagctactcaggaggctgaggaaggagaatcacttgaaccctggaggcagagattgcagtgagccaaaattgtgcctctgcacagcagcctgggtgacagagcaagactccatatcaaaaagttaattaattagttaaataaaaataaagcccttatttggggaattgagcatcagtcatggctctgcttcccctgaagtttttttttttgttttgttttgttttttttttgagacgtcttgctctgtcgcctaggctggagtgtagtggcatgatctcagctcactgcaacctctgcctcccaagtccaagcaattctcctgcctcagcctcctgagtagctgggattacaggcgtgtgccaccatgcccagctaattttttgtatttttagtcgagacggggtttcactgtgttaggatggtcttgatctcgtgacattgtgatccacccacctcggcctctcaaagtgctgggattacaggcgtgagccactgcaaccagcccttttttttctttttaaatctgtagaacctttgagaaactggcactaacttctagcccagactatgttcctgaaaccagccacccgatgggacagtgcagatctgatctctaacagtgtcattaattttcttgcctaaagaaaatcagggccaggctcagtggctcacacttgtaatcccagcactttgggaggctgagggcagcggatcaattgagctctggaggttgaggccgcagtgagccgtgttcccagccactgcactccagcctgggtgatgaagcgagaccttgtctcagaaaaaaaaggggcagctttcagattcaggaattctgcaaggtgtgtgactaccatctctctgggccccaagccgtaggaatttgatgggtttgtagcagacacgtgacaggaaattaagaatattttccatggcatgcacataactttgagacctttacacgtggatttttaggccaggtgcagtgaagtggctcacacctgtaatcccagcactttgggaggcagaagtgggtggatcacttgaggccaggagttcacaagaccaaactgggcaacatggtgaaaccctatctatactaaaaatacgaaaattagccgggcatggtcgcggatgcctgtagtcccagctgcttgggtggctgaggcacaagaatcacttgaacccaggaagtggaggttgcagtgagccaagattgcaccactgaactccactctgggcaacagagtgagactctttctcaagaaaaaaaaaaaaattaatttttgtttgttttctttctacgagacagggttttgctgtgtcacccaggctggagtgcagtggtgcgaccatagctcactgcagcctcgtcctcctgggctcaagccatcttcctgcctcagcctcccaagtagctggggctacaggtgcacaccaccacccctggctaattttttttatattttatagaaacagtcttgctatgttgcccagactggtctcaaacctcctggctttgagtttgagaatacacctctgagactgtagtctgcttctcattgagatttctagaggtgagttttcagattaattttccaggcgatcttcccaccttgacctcccaagtgctgggggttacaagcgttagcaatcatgcctggcctttttttttttttggagacagggtctcactctgtcacccaggctagactgcggtggtgtgatctcggctcactgcaacctccgcctcctgggctccagcgatccttccacctcagcctaccaagtagctgggactacacatgcaggccaccacacccagctaatttttgtttgcatttttcatagagacagggtctcactatgttgcgtaggctgtaaaacaaacaaacaataggtaagagatggatttttctagtgggtctgagactgggcgttttgtgtgaccttggaatctgagagccaggtagccagtgtcctcttcttcatttcacaggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttgagacagagtcatgctcttgccctgtcttgtccaggctggagtgtagtggtgcaatttcggctcaccgcagcctccgcctcctaggttcaagcgattctcttatctcagcttcccaagtagctgggactacaggagtgtgccactacacccactaattttgtatttttagtgagaaacggggtttcaccatgttggccatgctggtcttgaactcccggcctcaagtgatcctcccgcctcagcctcccagagtgctggaattacaggcctgagccaccgtgcctggcccctgattggtcttgacaggtgtttttaatgtcccaagtctccgtaaatgtgggatggagcttctctcagaggctcttccccccaactcccaaccaggtggaatcgtcttccagaacaaaatctcccagtgctttgtggtgtactgaaatcatgtctaagaacagagaacttaacagtcacatgcctttttaaaaactggaataggctgggcgcggtggctcaggccggtaatcctaagactttggaaggccgaggcgggtggattacctgaggtcaggagttcaagaccagcctggccaacatggtgaaaccccatctctactaaaaatacaaaaaattagctgggtgcagtggtgcgtgcctataattccagctactccagatgttgaggcaggagagttgcttggacccgggaggtggagggtgcagtgagccaagattgcgctactgtactccagcctgggcaacagagtgagactccgtctccaaaaaaaaaaaaaaaggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccatggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaatgttgaacttgttgggcttctggtcaaagaggctttgtatgtttatactttaatgttttcccacagagtggtgaaaaactttttttaaccaagttaaaaaatatgaaaaaatctttttgaaaatttctattcaagccaggtttttagaaatgtatccgggatgtgtttgtgcgtcattcaaggcatattagcatctggtcacaagatggagtcctttgtttccatgtttcctgtctcccaaatctgtctgatcccatggagttggtggtatacggcatcgtttgtgttgaacagagcctttgcaggcatgtctgtctaaaacactcaagctgaaagaaggacagggcctacagcttgtttttatggcccttactctaagaatgatttattatgtttttaagggttgttttaaagaagatgaatattcggcaagaccatatgtagcctgtaaaggctaaaatactatctggctgggtgggtggtggtggtggtgtgagagacaaggtgttactgttacctaggctgcagtgcagtggcgtgatcatagctcactgcagcctggaactcctggctcacatgatcctcctgccttagccttccaagaggttgggagtacaggtgtgcactatcctgcctggcttactaacaacaacaacaaaaaaacaccttttttttatagagacgggggtctctctcggctaggctggcctccaactcctggcctcaagtgattttcccatctcagcctcccaaagtgctgggattccaggtgtgagccactgtacccagccaccatctgacgttttgtggaaagtgtttgctgactcattggacaagaccttgtgttttaactcaaaaaatcaaggaaatcctgtatttttcttaagatactggttttgatgagtcaagatgttcttcccagtcatgttcgagggcagggggcagtggcccttagaccacacatcaccttatttctctcccctgccctccctgctgagcggcccagtaacccccttagacagtctcactttgcatctctgctctgctctctggctggctgtggggttgtaggcaattgatttcacctctctaggcctcagtttctgcattcatgacgttaaccctgacttcagagaatctttgggacgatgaagcaaaacccagccttccccaactccttttcctctatagaaaacagctcaacagaaaagccaacgacattgtgatttataaccatttattagtgaaagtgtttttaagcacagtcagggtgtaaacagtgcagcattcctgctcccctccgtgggagcagcgtctccttttcaattcatgtgactacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggcacccatttcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaacttcaatttttaccttgaatacaggggtagtaggggtggtggtggtggtggtggttgagacagggtctctgttgcccaggctggagtgcaatgatgcaattatagctcattgcagcctcgaagtcctgggctggagcgttcttcctggctcagcctccctagtagctgggaccacaggtgtgtaccaccacgcccagcttatttttaaattcttgtatagatgaggttttactacgttgcccaggctggagggtggtggtttttatattccttgtgtgaggggtgtctgtgatatttggaatttgagaatggatttagacaatgctaagtacagtctgctgggttttgctttgttctgggttgttgttgggttttttttgtttgtttgttttggtttttggttttcttgccgtggtgcaaaactgtagaaagttgcttattcactggccttggttccattgaagtctgcgtctcgagtgtccgtttcctcctcagaaccatctgcattttcaataactctacgtcctccagaccttctagaaggaacgaaagaggtctcgtttcctcgcctgtgggttgtaagaaaacacattatttagcaaagaaatcttcatggttgggatagattttttataaatctattttaaacttgtagctatagtcctattgcaatataaattttttttatggcagaaaacacacacggcacaaataagatgcagatattcaagttgaagtcaacaaatcattgccagtcttaaggcatgagtgattgaatttaatcagctgaaattggttgcgggggtgggtggagaaggtttttcaaagcaagacgatctgcttttcaatatgtcaggcttggtcatttgagaagccacaggattctggtctgctgtggtctttgatttagaataggaaaaaaacgccaaaaaccaagcaggggattttgtcttctgactttattcatagcccatggggcagagttgaagagagaacatactgtttttcttctgtatctcctcacccccattcgccttagaggtgagttttcaagatttgaattggaagaaggtgaaatggacaagggcagccttgagaaggacacagaggggctccctggttaaaaggcgagacagcaccccctgctggtgtgaatgttcatggactgagttttccccactgcagggactgctgcatctgttttgctgatcgtggaacataccgcacatggcgtaaaacaggtgcccagtgaatattagaaaaggaaattatacgtgttaatccaaggtggattattttattaaattgagatgaggtcttgatattgttgcccaggctggtctggaactcctgagctcaagcagttctcctaccttggcctcccaaagcgctggcattacaggcgtgggccaccacacctggccttcaaggtggatttaaaaaagaaatttaagagtctctctcacccaggctggagtgcagtggcatgatcttggctcactgcaacctctgcctcctgagttccagcagtccttgagcctcagtattgagtagctgggactacatgcacgtgcacactgccacgcctggctaatttttgtatttttagcagagatgggattttgccatgtgacccaggctggtcttgaactcctggcctcaaacgatccacctgtcttagcctctcaaagtgttgggattacaggtgtgtgccagtgcacctggcctctgaggtggattttagctccagccagtaggacacccctgtctctccttaatgctgccatctcctctctgcgctggttctctcttgagtttatcacctcgacttcacaggaagggctggtcacgtgaggggagactttgggtaggaggaagagagtgggcagaagaaggaaaaatcagatctgcctgctgccagccttcaccgttcagaagaaacacttaactcttttcagcaaccgcaacaaataattatgttgggctctggccatctggccctgtttgacctgaatcggaagacaggtcttattttaggacatcaaagaagagagcagacttttgctccccacgcaagggttggataagaagccataaggatgaacacaactcagtgaccaattctttagtcaaaaggaacaactcggctgggcatggtggctcacacctgtaatctcagcactttgggaggctgaggcgggcggatcatgaggtcaggagatcgagaccatcctggctaacatggtgaaaccgtgtctctactaaaaatacaaaaaattagccgggcgtgctggcgggtgcctgtagtcccagctactcgggagggaggctgaggcaggagaatgacatgaacccaggaggcggagcttgcagtgagccgagatgtggccactgcactccagcctaggcgacagggtgagactccgtctcaaaaaaaaaaaaaaaaaaaaatcaaggcccagagattcatgatcactgagaagaggaattcgcaaatgacccttttgttgacagaggatgggagagaccccggctgggaaagcccacctggctataaaggatgggacttcccgcagtgcagcgatcaggaataaatacttaaagctgcagccacttcaaagtaaacactcctagcccagcttcacagagaagcttctggacttgcagccctactagagaactctccatccttctctctctagatgtgacccttaagtctttttcttttttagcactgttttccaagcgcttgactcagaaggatgctcaaattcagcgcagaggagcagcagtttgactgttccctgtacgctccccacacagctctcttcgtcacagttttaactccaggttcaaaccctgatgggttggccagttgctgcgactcatgcctgtaatcccagcacttggggaggccgaggtgggcagatcactcgtgaggtcagttgttcgaggccatcctggccaatatggtgaaaccccgtctctactaaatatactaaattagccgtgcgtggtggcaggcgcctggaatcccagtcactcaggaggctgaggcaggagaattgcttgaacccaggaggtgaaggctgcagtgagccaacgttgtgccactgcactccagcctgggaaacagcaagactgtctccaaaaaaaaaaacaaaaaaaaatctgatgagctgggaagtagtccctaacctccacatcagtgctctaggcactctctttttggctcttggaagagtctatttgctaactggaaaagcttaatggataaatttgctcccttgacctaagaaatacattgtgccctgggccgttgaagctccttgcttggctgtcagcctgcaagatactctgttttggctgaagtgcttttcttggaactggtttcaaatcctagaccaaggttgacaccaactatacctgttacaggaactaagggacccccctaaaggttttcttaaagggtctgatcctggagaatctggaatttttttttgaaatagagtctcgctgtgttgcccaggctggagtgcagtggcgtgatcttggctcactgcagcctctgcctcccaggttcaagcgattctcctgcctcagccttccaagtaactgggactacagacatgccaccactcctggctaatttttgtatttttaggagagacggggttttaccatgttggccaggctggtcctgacctcaagttatctgcccgcctcggcctcccaaagtgctgggattataggcatgacccactgtgcctggcctagcatttggattctattcgtggactcagcttatccaaggcctcgggaatcatcttgagtgtaagcacctgctagtttgcaaggactcagtttcccactgaccagtgggttctgcacttcagcccaccctggaatttggcttatcctatgatcccaatcagctggtaggagagctgcttgaagtgtcctagaaactcatctgctcccccacaaaactggctcttaacaagacctcaccctgcgctttaagtattttggtagtgacagcaaagctgagattctccaaaaatgaagatggacacaaatgagggttggtttggcctctccatgaggtgaagtcagatccacatggcctaacttcacctgtgaaaagttggtcatgcttgtaatcccagcatttggggaggccaaggcgcgcggatcacctgaagtcaggagtttgagaccagcctggccaacatggtgatatcctgtctctaataaaaatacaaaaattagctgggcgaggtggcgggagcctgtaatcccagctactcagaaggctgaggtaggagaatcgcttgaacccaggaggcaaaggttgcggtgagccaagattgcgccattgcactccagagcgagactccgtctcaaaaaaaaaaaaaaaaaaaagcaaaatcccagagcagcagagacctcttcatgctttcttgggaagggccctgtgtgcatccttgagtcttgggtatccactccccagtccctgaacatgtacatgcccgtgaagcctccagaaaaggctctgccaggactgtgcttggctttgcggtggtcagcttccaccccgtgtgctgaaaatgcagtttgtagctagacatcactcaagccacgtgcagcccccggcatttgtcagacatcgcagtgagctcatttccttcgcagacaagcctgtgaaagctgaatcatgggaggactggttgccgcgccgcagttaccgtgaactttgtgatctctgacttgtgacccagaccagccaactagaagccaagtacgttctccaggaatgtgcccagatagtggaactgtcatattcattcagtgcagtgtcttcactggacaagggaggacagcactgctgagtgccctaaccacgtaagagtggcttttggcatgaaaggaagaaaaatccaagctacacacacagcctctgccatctcgtcaagatgcagtgataagggcgcacactgttgggtgtcatgtcacatgtgctgcccagaggcaggaaggacagtgggtcaagagatgaggtctatttgtcatcctgatcttggtttcaatgaaagctttgcacaaagatatccaagcctccagattttgcaagaatctcgtggaaatgtgcaagggtttaaaaattggggtgggcagaggggcgcattgggcagaaaagaaatggatactgagacaacacacagctgcgaagctgaaggcatgatacctggtgcatcactgcgaagtttcctgtggggggggccctctgaaacagagagagaatccccggaggttaccatcagcaaacaagaaggagcccggttaagtatattcttaattgttaaagacatttgcttcgatttaataattaaaggcactcttttttattttgagatagtctctgtcacccaggctggagtgcaggggtgcgatcttggctcactgcaacctctacgtcctggattcaagtgatccccttgtctcagcctcccgagtagctgggattacaggcaggccccacgtgcttggctaatttttgtatttttagtacagatggggttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggcatgatctatctctgctcactgcaacctccacctcccgggttcaagcgattctcctgcctcagcctcccgagtagctgggattacaggcatgcaccaccgtggctggctaattttcatatttttagtagagacggagtttcaccatgttggccatgctggtctcgaactcctgacctcaagtgatccacccacctcggcctcccaaagagctgggattacaggtgtgagccactgcacccggctcagttttttaaatggaaaggaaaatgtctgtcctttagagctacttttaagaacctcctataaatcccatgattgcatactggttcagggaagtaaaagcatttgagcaagctagtttgagaaatcagtgttggaacagaagccaagaagtcccaggcaaggaacctgcagccgcctgtcccttggtttatgattacttgctcttcattagctttcgggcctctagcaagagaggagaggtggaggccttgtacagctcttgccggaggtaactggcagtgtagccagtggtaggtaagtgggtctggctttagagagggcttgtgtcgagatgcgtctggctgatagaacttggtgaaactcgcactacagttccttcttggctgaggagccaggcatgcttaccaacctccctcagggctctagtgcctgattttatgtttttgtgcacccaaaagatgcagaaggcaggacagaccttccacctgcattatgtgtgtattcgtgtcggaactggcaaaaatggtctttttgttccactttgcccttggctgcccaagaaggctcaagtgtctggggcagaacccacaggaggtgtccagtgtgtgctaaagaatcactgggccggccgggcatggtggctcacgcctgtaaccccagcactttgggagaccgaggcaggtggatcacgaggtcaggagatcgagaccatcccagccagtatggtgaaaccttgccactactaaaaatacaaaaattagccaggtgtggtggcacgcacctgtaatctcagctacttgggaggctgaggcaggagaatcgcttgaacctgggaggcaaaggttgcagtgagccgagatcgcgccactgcactccagcctggcaacagagctagactccgtctaaaaataaataataaaaagaaaagaaatcactgggcctgagaaagggaagcagagacagcagtggggtagggagtcagagtggctgtatccccatcgctcagcccagccactcaggagaggcagggggactggttgccagcagagcacatctgagggtttttgttttttgttttttttttggagacagagtcttgctctgaaggctggagtatagaggcttgatcttggctcactgcaggctcctcctcctgggttgcaaaggagtgtcctgtctcagcctcacgagtagctgggattacaggcatctgccaccacgcctagctgatttttgtgtttttagtagagatgaagtttcaccatgttggccaggctggtctcgaactcctgacctcaggtgatcagcccacctcagcctcccaaagtgctgggattacaggcgtgagccaccgcgctttgccccaggagtcttcacagtgagaacagctctcctccactgacccctcaaccctgggagatgcttccaggcccctgctgtactttgggagcctaggcctggtttctctcctatccatgggggaccaacaagcgctcaccatgcagcgagtggggcttttccctgaaggcttggtgccctgcgccagctgctctcttccccttctcagaggggtttggacttttccctgtctcacgcagtggtccccaaactctagaggtgatttcagatggcttccgggcatgccatccgctaactgaactgggccctgagaaagtcatttcctttccaactctttttaaacaagtctaattatgatgtcagagagagtctatttggtgctaatggctgttgtcactccctttttagtggagaagtaggcttcaggtcttggtgatcaagttgtggccacaatagctagatattgaacttgatactatttttatcatattactttcatcgtaaccagttgatagaggtgatgctggtttaaaaatatagaggaggtatgtttatttgccgttatattcatgtatgattaaaactgttaaaagatcaagtcattggtattaaaggtagtaagaggctcagcacatggctgtggtggtatgagaatgaagcggggaaaatatctaggacccgagggataaaggttcactctgcctggtgctgtcctagacactggagattttttttttgagaccgagttttggtctgtcacccaggctgaagtgcagtggtgcgatctcagctcactgtaacctgtgtctcccaggttcaagcgattctcctgcctcagcctccctagtagctgggattacaggcacgccccaccatacccggctaatttttgtgtttttagtagagacggggtttcaccatgttggtcaggctggccttgaactcctgacctcaggtgatcagcctgcgttggcctcccaaagtgctgggattaaggggtgagccactgcacccagcctgggcaggattctttagggaaagttgaccagattctcccatagatgggatgtggggtataaaggagaccaaaacgttaagaaggaccacgaggtttgtgatgtgaattgttggcaacttcatcattttagctgctgagctggagagaggagccagtttgggggtgaagagtttcagtcaggacttggggtgcagcatgtttggtgtgagctgcctattagacatccatgtgggaacgggagggtggtctgaggttctaggaagaagctagggcttctcagagatgaactgaggagtcattagatatacatggaattctaaagcgccaagattagttgagacctctcacctagcgctggggagagatgaaaacaactaaggccgtgcagtggtccatgcctgtaatcccagcacgtggggaggctgaggcgggtggatcacaagatcaggagttcaagaccagcctgggcaacatggtgcaaccccatctctactaaaaatataaaaataggccaaaaatagcttgaactgggaggcagaggttgcagtgagctgagatagtgctactgcactccagcctgggcaacagagcaagactctgcccaaaagagaactaagttgataccctggggcggtctagtggcaagcaggtttcgaggtgagggatcagcagaggagaggaagagggacaaccccacaggtcgggggacaagcaggtgtggatggtgtcggggaagtccagggaagcaagtgaattaggccagaggcatgatggactgcgtcacgtgctgctgccctgtcaggggacctctggccattagtgtcacccatgggaggcttctgggagagtgatgggtgggggcgaggggaaccagcaactcttcacatacagtttttttttttttgagaccgagtctcactctgtcacccaggctggactgcaacctctctctcccggttttaagccattcttgtgcctcagcctcctgagtagctggaactataggcatgcaccaccacacctggctaatttttatattttttggtagagacagggtttcggcattcacatccagttttgtagtaagggtagcaaggtagacatggggctaagaggttattccatttgctgatggagcaaatgaaagagaaaaccttgcaaaataaggatttttggagctatgtgcttgagtgaacaagagggtcgggtccaatggaggtgttggcctcggttggtgccagagggttcagcatagaaatggaaaaaaaatagaagtgtacagaggtgcacggaggtaggatgatgaggcagtgggagcttgtgcacgtttcatgatcatttctgcttttgagttaagtaggaagtaaggtccccagctgagagagaatggggaggagcgatcataagttcaaagaaaaagtgaaaagcagcagagagtgagaagatgagggaggggtgtgggaggacccctgagcaaggcctgctctgtgggaaaaggtggagagtgggttttgggttttttgagacagggtctcactctgtccatccagggtaagtgcattggctagatcatggctcactgcagccttgacctctggggctccactgatcgtcccacctcagcctcctgagtagctgggattttaggtttgcgccatcccacctggctgatttttgtttgtttgttgtagagatggggtcttgctgctcttgaactcctgagctcaaagcgattcacctgccttggcctcccaaagtgctgggattataggtgtgagtcccgtgcccagccaagcttgagtttcatttgggttgtgctttcaccaaatgattgcagcaatgcaagagggggaaccggatgttgaggatgcgcgacgggggttactagacagctggtttggagctgggtcagaggctgatggcattaatggagtgaagaccccgttggggacagagccaaagaaaggtggcaccaggcagacaatgggatgcctgagggtcaaattgtgagggctcctaggagtactggttggcccggtagaagcagcaggatcacccagagggtcaaggaaccgagaggctgcgtcgcccacctggatgttgaaatcatggagaactgtgaggagtggtgtgggagacaggaagcccggagctaaaacctcctgggagccaatcgggatggatggacagggtggtggaagcagcccttgggagcaggggggacccccaaggtaccagaggcatgggagagaaaacagcccccactccagtgacagcaggaattctcagcggggtggcagtcgtaccctcccatctctagaggacttctggcaacatctagagacatttttggttgtcacattgcagggtggtgggggactactgcagccggtgggtagaggccagaaatgtaagcacctgctacttttcagggatctttttccttctgatggggaatgtcggacagcccccatacccgagaataatgcagcccagatggcagcagtgctgagggggagaaaggaggagcagagcatgtcaggaaggaggtgaagtggcggggggtggtgttgcagcttcaatggatgtcgtgaagactcagtgatgcaatgaaggaggggctggaggagacagtggggatagcctcttcctcctcctcagccggaggaccggatgggagacggtcgatcgttaaaggatctagaaggttagctgctaccaggcaaggcagggcccgggtctgatctcagtgcctggcccacactaagcttagtgattaaggagaagcaggaataaaccacagaagggagtggcggctgtgggcacaaggggcatttgcaggccgaaaggagcccgagcccccagtgcttttctctggcctgagagacggggtcctcccgggccacgggctcctcacctgagcttgctcttgagtgcgttcacctcgcggcccatggcctcgttgctctccgtggcctcatccagctcccgctgcagcttcctgcggttggcgttgatgcgctgggactcctcctctgcctcctccagctgcctcttgagctgcttgaccctggcattgcctttctctgcctgtcgcggagagttggaggggtggttaggggaggccggctgggggctgggggctcgagggaggctgggtggcaggggctacctgctccttgtactgctcggccatcttgcgctcgtcctccacctgcagcaagatttccttcagcttcttgtctttctgcttcagcgacttggtggccgcctgtttctctctgcaaacagcaaggaaaacaggtggtttcagcggagggtggcaccccttgtagctggtgtgtcacctggaggtggcatcttgagtgctttcctgagccccgtatctggactcctctcaagaatcagtcagatggtggaatagtattcagccatgaaaaggaataaagtatcaatgcatgccacagcatggatgagcctggaattcttgccaagtgaaagaagacacatagcagacaacatagtgtgtgattccgttgatatcaagtgtccagaatagataaattcatagagacagaaagtagattatggttgccagggactgaagggagtggttacagggcatggggtttctattttttttgcggggaggaggcaaggtcttgctgtgtgacccaggttggagtgcagtggtgctccaatgcctgctcttcaccctagttcatagttcactgcagccttgaactcctggctcaagcaatcctcccacctcagcctcccaagtagctgggactacaggcgtacaccagcatgctcagacttttaaaagtttttcatagaaacggagtctctggccaggcgtggtggctcatgcctgtaatcccagtactctgggaggccgaggtgggcagatcacctgtggtcaggagttcgagaccagcctggccaacatggtgaaaccccatccctactaaaaaatacaattacaagctgggtacagtggtgtgcacctgtagtcccagctacttgggagggtgaggcggaggttgcagtgagctgagatcgcaccactgcacaccagcctgggaaacagagtgagactatgtctcaaaaaaataaaaataaaaaagtcttgctatgctgcccagactggtctcgaactcctggactcaagtgctgctcccacctacctcagcctcccaaagtgccgggattatgggcatgaaataccacatatggcctggggtttctgtttgagccgatgaaaatgttctcaaaatgactgtggtgatcgtttttacatgtttgtgaatatatgaatagcccttgaattatacactttaaatgggtgcattgcagggcgtgcgaattactgaaaaagctactagaagagaatgggtgagaatccttagaatccaatggtaagaaatgtgctgtgatcatatgcctcattcgacccataattaagaaggcttccagtgtgtgtaccaaatgggctgccggttggacttttgttttttggggttttttttgtgtgtgtgtatgtgtgtggaagggtcccactgtgtcacccaggctgcagtgcagtggcacaatctcggctcactgcaacctccacgtgtcacgttggagtgattctcctgcctcagtctcctgagtagctgagataataggcatgtgccaccacactcggctaatttttggtacagacagggtttcaccatgttggccaggccggtctcaaactcctgacctcaagtgatccacctgcctcagcctcccaaattgctgggattacaggcgtgagccaccacgtccagcctggttggatttttgatctgtcagcatgctatccctgcagaggctgggaaaagtcatatgtactgctgggaaggcaggttaatgtcaggaggaccatggagatgctaagagcagctcacactttaggtgcttgccctaggccaggaaccagcagggcactttgctgtgtttacgttcagttctcacaacatacctgcactgtaggcatcacagagcttgcttcttacaagccagaactgatgctggaagaggttccctgacttcactatgactcctgctgtccatcacccccctgcaaactgggttcggaactccacacccgcatacctggcctcctgctcgacctgctcctccagctgtgcaatcttggcctccagcgccgcgatggtggacttgaacttggacttgacggccccctccatctcgtggagcttgctccggagctccttgttctgccgctcgagctgctgccgggcactctcattcttctgggccgtgctgcgctctgtggccagctcgttgctgagctgctcggcctggggaggagagtgaaggccatgaggcggactcagggaagcccaagagagcgcactgagaccatgcctcttcctgccttgtttggcctctgcacgagtcccttgatcccgggcaccctgtcctctccttcatcctgtaaaactccactcaagagcttcttccaggccgggcgtggtggcgcacgcctgtaatcccagcacttttggaagcagaggcaggtaaatcacttgagctcaggagttcgagacctgcctggccaacatggtgaaaccccgtctctattaaaaatacaaaaattagccgggcagtggtggcacgtgcctgtagtcccagctacttgggaggttgaagcaggagaatcccttgaacttgggaggcagaggttgcagtgagccaagattgcgccactgcactccagcctgggccacagagagaccctgtctccaaaaaaaagaggtgcttccacaagtgtcagtgccacccaggctgagcgagtgacttgtcccttgctttctctgtcctggagtcgcctggagaatgatgcctgttcaccctacaccacaaggggctgcaggttactggatggtccctagtgcccaccatggaactagtgctcagtgacatcaccaagggctcactggataaggtcagagcttcagctaggggaaaacgcaatgaaagagcatcccaaggcccggactccagggatggccgtgaggtacggggagccagccacgccgtggctggaaaatgagacactgcagcgtggagaggagtattctgaagacagcagcctgggcactggtgtaagggccctggatctctactctcaggccccaccaccctcttgtccctcaatccagggcctgcacacaggaagccgccacgcgtgtgttgactggtgcaggatcctgctgcaggagagacagtaggcagcgtgactgtggtgtccaggcggccctcacctgctgtgtggctttgcggacccggtcgctcatggcctccatgttgccctgctcctcctccagctcctcctccagctgggcgatccgggcctccaggcggcgcttctcgtcctggagtgcgttcctgggggaagggcggccatggtgggggcctctaccctcccccgccttaaaagatgccccctccttggagtcatgcctcaggggtattgccctcatcatctaatgggtgaaactgaggcttggagaagattagaagactcatctgtagttacacagccaggaagtggacagccgggactcaggccgggtccgtgtcagcaaagctgggattgggatggggaccagcacactcctccctgactcttcctggcctccccttctccccacacagctacttattgggaatgaatgaaagcagccacacccccaaacaggcatgaaagcgctgacggaaaacctaaccaccatgggtctgtccccaatctcagaggacgcttcgtcagcagcagcattgaaatgggggtccagggccaggcacggtggctcacacctgtaatcacagcactttgggaggccaaggtaggaggatcacctaaggtcaggagttcaagactagcctggccaacatggtgaaaccccacctctactaaaaatataaaaattagccaggcatggtggtacacacctgtagtctcagctactcagaaggctgaggcaggagaattgcttgaacctgggaggtggaggttgcagtgagccaagattgtgccactgccctccagcctgggtgacagaatgaaactctgtctcgaaaaaatttaaaaaataaaatgggggtcgaggatgctgcctgtccccccatcctctgcttcagagccctcttcctccattcagtttcctaccttcccgacaggctactggccagctcctctgccagttcctccttctcgaggtccgcttgtttgcgagccctctcagcggcggcgaggtcctaggtgggagggaggaaggctgttgtctgccagggaaaggccaagccccaccaagagtccaccctgacaactcagccacccttgaaagtacatgttcttcctctgagctcaggggaggccccgtgaatacatagaggagggaagcgtgtgtctttctagacaggtggaccccagaggaggacgaaatgaaatctgggaatgcacagactggagctgccaaggggtgctaccgtgacacccgcatctgaggctctcctagcaaggcgaggctttacctcttgtagctgcatgaggtctgcttccaagctcttggctttcttctcattctctttggctgtggcaaagatctcatctctggaggcacgggcatcttccagctctctttgaaagtccttcatctgagcctgcatgagtcaacagggaggacaagctcagatgtccttactcccccaagttctgctgcccagttcagctttgcacacccaccccttggattttctgcagttgaccacaaagaagttcccattgcacgagcatggctctcagttccaggtggctggtggtgcgctgggagcaccattctgggtgggctccacagacctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgctctgctgacttcggtggcctgaggggaactgtgccctccctccacccatgccccaagctcctagtgtcacccacctgcagtttgcgtagctgcttgatggcttcctccctccccttgatggcagagtcggcctgaagctccaggtctttcaggtccccttccagcttcttctttgctgcagctgccagggcacgttgctttcgctcgtcttccagttccgtctcatactcgtgaagctgggcgaggaatagagatgtgtgctgccccacttgcccctgggaggtcctttggctcacctaggcagcacatcactgcaccccttccccagcacagcccccttgtgaggtgggcatctcatccccagttgcagatgagaaaacggaatcacgccgggcgtgggtggctcatgtctgtaatcccagcactttgggaggccaacaggagaatggatcacttgaggccaggagttcaagaccagcctggccaacatggtgaaaccttgtctccactgaaaaaaaaaaaaaaattagctaggtatggtggcatgcgcctgtaatccaagctactcgggaggctgaggcaggaggtggaggttgcagtgagctgagattacgccactgcactccagcctgggcgacagagcgagactctgtttcaaaaaaaaataaagaaaacgaagtttccacaccaaccatgagagtggtgataggaatgaaaaaggccacccgacctccctctgctggcctccccggcagcacgcacctgtctctgcagttgcctcctcttctcctcattctgctcgtcccgggcttggagatccctttcgaactggcccttgagcgcctgcatgttgacttccagccgcagtttggcgtcctccgtggcttgcagctcgtcctccagctcttccagctgcgtcttcatctcctccatctgggtctccagggcccgcttggacttctccagctcatggacctgccggcagagcgggcagccccattctatgaggctcaacttcatgaagacgattgagaaacccaccgtgagcggcacctcaggagatcagggaggtggctttggcctcccacaggatgcatggccgggactcaagatgacccctgagagttcagaccccagccttatcctcggaccccccaactcagacccatcctcgactgccattctcagcccctcccagcccctgcaccagtccaaaaacctccttccatttccgatgatagttcgctatgaaaaaggccaggagctagcctcgcatggactggtgaatagcacagagggtgggcaggcgaaacatggacgagaaaaaccacccagagccacttacgttcttgcccacgtcatccttggagctgaccaggtcttccatttcggctttgagcattttgttggtccgctcgagttcctctttggcttccaaggcctcttcaagggcccgagccagggacagggccttggtttccttctccctggcttctgcctcagctctgtccctctcatccgcgtatttggaagagatgtttttctcctcggctaacaactacaacacaagacccagaggtgacttctaggcatatccggggtcagcgtcactgaattgtaaataccgggggaagccctgtgtcctgctgaatgtattgaggtgcaggtgtaagcagtgtaggttagctatgggagtaatttatataatcatctggcgttctgacttctacatcaaccttatgcagagccagaaatcagctgacttgtttttttttgttggtttgtgtgtttgtttgttttagatggagtctcactttgtcacccaggctggagtgcaatggtgcagtcttggttcactgcaacctccgcctcgtgggttcaagcgattctcctgcctcagcctccagagtagttgggattacaggtgcccaccaccacacctggctaatttttgtattttaagtagagatgtggttttgccatgttgaccaggctggtctcgaactcctgaccctcaagtgagcctcctgcctcggcctcccaaagcacggagattacaggtgtgagccaccacacctggccaaatccttgtgcttcgaaaccactagacctgcccacgttgcttagagcacactgaggtcaaagtgagatttaaagctgccagaagctagttattagtttgtttcatggccacaagtagctattaatatcttacaaaagtatcctaagagcctcagtagggaaatggtaagcatgggtggccctgcacacatatctctctgcttggagaagcaactcagagaacattccatgctcacgttaatctcatcttcagagagaacagagcagattataaattgtaacatccaaaagccaaacttccagtattcagcaaagacagggacctctaaatggcacagtcaacacaaaaatcccacactatgtgtgccactgcactacactctatgtgacaggaaaataaaagcaacctcaggccttcaaccagataacgaagcattgaagatgagctgacagcccagaggagaggtagctgatgggaagaggagaaactgggatgttatctagaatcctgacactaggaggtcagtcagggaggggtagggaacctgcaggcatctggcatttagcctcactgtacaatcctcattttatttatttttgagacagggttttcactccatcactcaggctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcgtgagccaccgtgcctggcctctcaaactgatttttagaataaccctgagtcacttgtaaactaaatcatatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataaggcatgatagatagaattagtctttataaataaatatgtgggccgggcatagtggctcatacctataatcccagcactttgggaggccaaggcaggcagatcatgtgaggccaggagttggagaccagcctggacaacatggcaaaaccccatctctactaaaaatacaaaaattagccagacatagtggtgtgctcctataatcccggctacatgaaaggctgaagcaggagaatcgcttgaacccagtggtggaggttgcggggagctgagatcacaccactgcactccagcctgggtgacagagctagatcctgtctcaaaataagtatctgataaagttcatataatacagtgtcaatgactgaatccaggtggtggccttaaaggtgttcaccgtacaattctgtcaactttgctgtgtacttggaattttacagaatgaaatcttagggaagagtggtattaaaagtatagaaactgaattacttggaatactactcaataggtattcagtaaatacatttagtgaataaataagcacctcattccttcttcaggctagaaactaaggcatcaccatgtgtgcaggtgaccctcatggtgctggtacccagaaaagtcacagtcatcaaggcttctttgccatccttactgtgacctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtgggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaaggaagggttttttttctttttttttttttttcctgagacagagttttgcccttttagcccaggctggagtacaatggtgcggtctccgcacactgcaacctctgcctcctgggttcaagctattctcctgcctcagcctcccgagtagatgggactacaggtgcccacgaccacgcctggctaatttttgtatttttagtagagacttttcaccatgttggccagactggtctcaaacccctgacctcaggtgatccacccacctctgtctcccaaagtgctgggattacaggcatgagccaccgtgcctggccagaaggtttttttaatatttaattgaacagggagatcatcgcctctcctccaggaacgcaactagaggaaaggacttgccttgcagcaagagagacctcagcgagccgggaagaggctcctccccacagaactgggcaccacccagcactgcccaccacaccaccgcgccacctcctcacctgcagcttgtggactttgtcattgagctccgcccgggcccgctccccatcgctgcacttggactgcagctcctgcacctgcgcctccagcttcttcttcttatgttccacctcctgcttggcctggcccaggacccgcagctccccggccaggtctgcgttctctttctccagcgtctgcttattcttgtctaggttcgccttggcctggcgaaggaagcagaggggagggataacagggaggctgtggccgggagaacgtttcaggccctgccctttcctccctcagagaggtccaggaaggcacacaacagggggcacacaatcaccagtaagagatttggggtttttttgttgttattttttttttgagatggagtcttaactctgttacccaggctggagtgccgtggcacaatcttggctcactgcaacctccgcctcccaggttcaaactattctcctgcctcagctgcccaagtagctgggattacaggcgcccgccaccatgcccgactaatttttgtatttttagtagagacgaggtttcaccatgttagccaggctgctctcgaactcctgacctcaagtgatccacccatcttggcctccctaagtgctgggattacaggcgtgagctgccgcacccagctgatattttggattctattttcctaaagctcatgggttgcaatctggaatcccacaagcggtatccaacctgctgacatgtcccctttgaccctttcactacttttaaaaaaatgagttgccgacattttaataaatgtcacataaaaatctggattcccagcttctttttcaaaaaactttaatgtttgaaggcatgccatggcagctcatacttgtcatccccagcactttgggaagcaggcagaaggatcgcttaaggccaggagtacaagaccagcctgggcaatgtagtgagacccccatctctactaaaataaaacattagctgggtgtggggggcacacaccagcaatcccagctactcaggaggcggatggcaggcttgcttgagcccaggaattggaggctgcagtgagctatgatcacaccactgcactccagcctgggcaacaaagtgagaccctgtttcagaaataagtagctttgggaggccaaggcaggtggatcacttgaggtgaggagttcgagaccagcctggccaacatggcgaaactgcatctctactaaaaatggaaaaattagccgggcatggtggcgcacgcctgtagtcccagctactggggtggctaaggcacaagtattgcttgaacctgggaggtggaggttgcagtgaaccaagatcatgccactgcattccagcctgggtaacagagtgagactccatctcaatcaatcaatcaataactaacattctatgtggtgactgtggtggtggtagttacacaatacacatttgttaaaattaatggagcagtaaaatggataaattttactacatatgcctcagtaatcctaaacttaaaaacaaaaacaaaaaaccaacaacaacgaaagatctggaaacagagggtcttgctttccttcaaggcaacaatctgccacatctaagtagcggctggctctgcaggtggggcagtcacctttcaccgcccccgtccttcacaggtgtcgtgtgattgacactgctacttctgtcctagttaagggaaacttattttatggaaccagctcctgtaggcatgtgagttgccctacaggaaaaaaaaagtgtgttggggccaggcgcggtggctcaggcctagaatcccagcactttgggaggcctatgcaggcaggtcacttgaggtcaggagtttgagaccagcctggccaacatggtgaaaccccgtctctactaaaaatataaaaattagccgggcatggtggcagtcacctgtaatcccagctgctgaggaggctgaagcaggagaattgcctgaacccaggaggcgggggttgcagtgagccgagatcccgccagtgcactccagcctgggcgacagagtgagactttgtctcaaaaaaaaaagcgtgttgggcaaaagtaggacgcggtgaggggcttctttccaggttgtagagaaggggaaagagaagcgcaagtatcccgagaggacgagacccaccactcagtcttcccatagtccctgggaggtgctggacgttgaccggtcagccctggatgcccgtcctccctccaagacatgactaagagctgccagacctcagatggggacagggagtctcttggtggtaacaaagcagtgaagcggggaccctaggggacatgggctcccagaaaccttagcccagcctaagaccccagaactggggccaaaccgcacgagggcctggggagcccaggtaggagctgatgttaaacgtttcccccacaagcagatggaaccaggtctctacatcagaattcaagttgttagaggcaaaggcctctgtttccctgcacctgagatgggcagaggtttgcacctctacctgctttgtgcgggtcagtaatggacatgccgtctgctggtggtcttaataactgcgtcttcccaaagaggcctggctgggaatgggcttggcttctagctcctgttcacgtctaatgaaccccaagcatggggagggtcagtgattctgtctggggcctcactcttccaaccataattttttttttttttttttgaaactgagtctcactctgttgcccaggctggggtgcagtggcacaatcttggctcactgcaacctttacctcctgggttcaagtgattttcatgtctcagcctcccaagtagctgggattacaggcgaccgccaccacgtccagctaatttttgtatttttagtagagacggggttttgccatgttggccagactggtctcaaactcctgacctcaggtgatctgcctgcctcgggctcccaaagtgctgggattacaggcgtgagccactgcacccagcctaattttatgtatttttagtagagatggggtttcactatgttggtcaggctagtcttgaactcctgacttggtgatccgcctatctcagcctcccaaagtgctgggattataagcatgagccaccgcgcccggcctttgggggcagtttctaatggtttagcactatccctttggtgctgccctcatgagatctggttgtttaaaagtgtctggcagctccccattctctctcttctgcctgctctggtcatgtaaaacatgcctgcctccccgttgccttccaccatgatggtaagtttcctgaggcctccccagaagcagaagctgctatgctttctgtacagcctgcagaaccgtgagccaattaaacctctcttctttagaaattacccaatctcagggtggtgcagtggctcacacctgtcatctcagcactttgggaggccaaggcaggtggatcacctgaggtcaggagttcgagatcagcctggccaacatggcaaaaccccatctctactaaaaaaaaaaaaaaaaaaaaaaattagccgggcatggtggtgtgtgcctgtagtcccagctacttgggaggctgaggcaggagaatcatttgaacccaggaggtggaggttgcagtgagccaagatcacgccactgaactccagcctgagtgacagagtaagactccactgctcaaaaaataaacaaataatccaatcttgggtatttctgtagagcagtgcaacaacggaccaatacactagtgatagaaccaaatgcaaattccccaaaatttttaggcaatgctgcacccacttaatctagcagaaccaaaagcttccactgaaggggatgtggaggagctgcaacgctgagggtaatgtaactcaggctttcaggaaaacaatctggccgaaggtcgcaagctaaaaaacttaccctggggaatgaagcacaggcactaccccaaaggagagaagagcacccaagattcagcattcggtactgctatttaccagctcccactcccatacaccgcaaagagttccaacaacgggagagtgatttgacctagtcattctcaaattatgccggagagagctgttctgccattgaaatcaaataatgacaagtttcctccagtcttttttttttttacaaaagaaaaatcgctatgttgcccaggcgatctgaaagtcctgggctcaagcaatcctccctccttggcctcccaaagtgttaggattacgggaggcatgagccgccatgcctggccttcctccagtctgcagagaaattaaagtggatagaatgatcccagttttaagtttcatttaaatctccccgaaagtgttgttacacctttgcttatccctgaagggcagtatattgataggccccacccatcctataggccttcagtcctgtagaggccagaaagtggggtctaggaccagactgtttgggtgcaaatcatggctctgtcacttaccagcagtgtgaccttgggtaagtctcttcacctctaggcacctaggacctcagtttctttgcttgtaaaatgagtttaatagtacacgtctcacagggtggttgtgaagattaattgacatactgtatgagaagcatttctattcattcttttttttttttctttttttgagatggcggctcactctgtcgcccagactggagtgcagtagcacgatctgagctcactgcaacctcttcctcctgggtccaagtgattgtcctgcctcagcctcccgagtagctaagattacaggcacatgccaccacacccagctaattctttatatttttggtagagatggggtttcaccatgttggccaggctggtctcgaactcctgagctcaagtgatttgcccgccttgcctcccaaattgctgggattacagacatggtgagccaccgtgcccagcctatttttattgtttgattaaggtctcactgtgtcgtccaggctagagtgcagtggcatgacagggctcactgcagcctcaacctcccaggctcaaacgatcctcccacctcagcctcccaaatagctgggaccacaggaatgcactaccaggcctggccaatattttattttattttatttttttgagatggaatcctgctctgttgctcaggctggagtgcaatggcatgatctctgctcactgcaacctctgcctcctgggttcaagtgattctcctgcctcagcctcccgagtagctgggattacaggcatgcaccaccgcgcccggctaattttttgtatttgtagtagagatagggtttcgccatgttggccaggctggtctcgaactcctgacctcaggtgatccacccagtttggcctcccaaagtgctgggattacaggcttgagccaccacgcctggcctacttttttaaaattttagtagaaacaaggtctcactatgttgcccaggctggtctccaactcctgagctcaagcgatcctcccgcctcagcctccccaagtactgggattacaggcgtgagccacctcacccagcctgtatgggaagcattttgtaaataaatataagctgctatcatcatcattagaatcttatgtaacttgttttttgtctttatgcagaccctgacctgtagtaatttgaggctgctgatgtcactcttatgtgtcatcaccaaaaagcatcaccaaaaagcattaccctcttgaactgctcaagctgctctgtgagctcctccaccgcctgtgcgtgtttctgcctcatctcctggacctgagcctcatgggaccgcgtctcttcatccagggccttcttcagcaccgtcacctcctgctccctcttggcccttggtgggaggaacacagtgaatggcagttgggtggagacagagggtcatctcagtgccgtgcaaaagaatgagagctcttccaggacccagagctgcagtcctcatcaccacccctctctagctgtgtgaccttgggtcattcacctaacatctctggacctaaaatttcctcagctgcaaaatgtggagcatatcacctgcctaggacatctgtaatgactggcaaacaaatacacaaagtaatagaattgaaaggatgtctgtgaactgcaaaattttgcttaaatattaatgttggctcttatttaatgagcagttactatatgccaggccctgagctaagttttttatatacatcatctaatcctcagagcaacccaaagaggcaggtgtgttattatttccattttacaaatgaggaaactaaggctaagagagggtaagcagttttacccatggtgtcacagccattgtgtgatggagccagaattagaagctaaaccttgaccttgagtccatggttttgtttgtttgtttttgagatggagtttcactcctgttgcccaggctggagtgcgacagcgcaatcttggccccctgcaacctccacctcccgggttcaagcgattctcctgcctcggcctcctaagtagctgggattacaggtgcccaccaccacgcccggctaattttatatttttagtagagatggggtttcaacatgttggtcaggctggtttcgaactcctgacctcaggtgatccacccgcctcagcctcccaaagtgctgggattacaggtgtgagccaccgcactcagcctggttttttgttttgtttgtttgtttttcttatcgagtcttgctccgtcgtccagactggagtacagtggaatgatgtcagctcactgcaacctctgcctcccaggttcaagggattctcctgcctcagtctcccaagtagctgggattaccgacgcccaccaccacgcccggctaatttttgtctttttagtagagacaggttttcatgatgttggccaggctggtctcgaactcctgacctcaggtgatctgtctgcttcagcctcccaaagtgctgggattacaggcatgagccaccatacctggcccatgcactgggctcttctgtatcaaaggccaagcggcaagggagcagaacgctgtgctctatgtgcatgtgacactgcacaaaacccaaagtgggggaagtaaaccccagggtatatggtgttggcacagctagcatagctatatgctatgatacatgctatgccaacaccacagattgcatcaaaatacatttatgtgtttactgaatgaatcaatgacctagtttcactagagtcaggattcgtgatctggcaggcagtttgttattgtttgttcatttgaagtgaatcttcaattgaaaaccaatctgatcaattttatttttaaaatttaacacaaaagtgatacacacacatacttgggaattggagcttggggactgactgatacacacacagacaggaaggaatttctcaagaatgttaactggtgtgactaagggtgatttttttgttttttgtttttttttgagatggagtctcactcactgtgtcacccaggctggagtgcgatggtgcgatctcagctcactgcaacctctgcctcccagattcaagtgactctactgcctcagcctcctgagtagctgggatttacaggcatgcgccaccacgcccaggtaatttttggatttatagtagagacagggtttcaccatgttggccaggctggtcttgaactcctgacctcaagtgatccacctgtctttggcctcccaaagtgctgagattataggcgtgagcccgaccctaaaggtgatttttttttatgtctgcttttctatagttttcaaattgttctctgagtatatccaagcttaccaatgaggatggttttgaatgcagcctgacacagagtcataaactttcttaaaacagtatgagatgttttttccaatttgtaaaatttttttagttgatcagctattattagtgttagtgtatcttatgtgtggcccaagacaaatctttttcttccaatgtggccaagggaagccaaaagattgtacatccctggtatatactactcttctgatgagaaataagatgatgagggtcgggtgcagtggctcacacatgtaataccagcagtttgggaggcggaagtgggtggatcacttgaggccaggagttcaagtccagcctgggcaacatggcaaaactccatctctactaaaaacaaaaaattagccgggtgtggtggcacatacctgtaatcccagctactcaggaggctgaggcatgagaatcgcttaaatctcagaggtggaggttgcagtgagccaagatggcacaactgcactccagcctaggcaacaaagccagactgcctcaaaaaaaaaaaaaaaagaaagaaaaaaaagaaacagccaaccatgcttctataagttaaagcaaaccgcggccaggaaggtaaatgcacaggggctgatgcacgatttgctttgggtttgtcccctcttctgcccccatcccattggtgcagtgggatagcaggatggtgggattgatgggcccctcacctgagctcctgctgagtggctgtgctgtccagtgtgtcttccagctctgtctttagggcctccagctcctcgccgaggtctcgcttctgcttttcagccttgttcctggcggcccgctctgagtccaggtcctcctggaggtctgagatgtggccctccagctcccggatcttcttcagggcattgttcttctgagcgatttcatcgtcaagccttccagggagagacccagcagaatgaacccccaggtcccttggtttcctctcttacaatgtggccaaaaacttttctgggaccagacagttatgttgcagagacatcaaacaccttctatccatgtccccaggtctgcttcttgacatgccagactatatgagattaacataggatgtgagtgccaaggtctgacatcaaaacaggttgtacatgtgcatgggtgtgtgtacgtgtgtatgcacgtgtgtgcatgtgtgtgcaagaatgcaaagcattgaccccagactggcaaggtacctggtcacagtagggactgtgtagatgctttctgaatgttggacagttcttcttccctggcaactgtctgttctttctgcatttgctcagtgactgagtacccgccccatgcacagcatttggccagccactgcttgcgggggatattcagactggggctctgcatctggtggaggtggtgaccagagatcaaggtgggctgcaagaagccctgttaaatggcagaatgctgcaggagaggcaagcactttgattttactgtacttgtgaaagggcagcaacaagagagaaagtgaaatagttgggttggggtgagactgcagagggtggatgggctctgagggtgaggctaaggaaactggattttccctagtaagccagtgaagttaggtttttgttttgttgttattattgttttgagacagggtcttgctctgttgcccaggctggagtgcagtggcatgatcatagctcactttagcctcaacctcctgggctcaagtgatcctcccatctcagcctcctgagtagctgggactacaggcacacaccaccatgcctggctcattttttaactttttgtagggacagggtcttgctatgttgcccatgttggtctcaaactgctggcctcaagcaatccccccacctcggcttcccaaagtgctgagattacaggcgtgagccactgcatccagccagcaaagttttgtgagcaggttcctgccccagagagatgctttcccttcatcaccgtagcactgtcaacatagcacaaattggccgacaaaagagccaggccaggggatcaatcagaaagctttgaggcttaaatcccagctctgcctcttagaagcaatgacattgctcctgttgcgttacccctaggaggctcagcttcctcctcaaagacaccggcagtacacctggccaggtgtctgcaaaggtattgcttgaaaagaacttagcaccgagtgagcaggtaaataatcattcatagtggctgctgcagtattagcattagtgtaaatccagctaagagccaggaagagggaaaaaccagaggaaatgggtgggggacatttagaaggactggcagaatctgaaggttgctgcttgctgtgggtcggcagaaacaaaggaggagattggtgttcacaaaaaagagggcccttagagggaggggctggggaaaggaaggtcattcccgccttagacaggggtgtttgagatgacggtggaaattgactcattgggcaatcggaaattcagaagggggtctagatgagaaaagcctggatgtcgaagaggcagcagcaacaccatgggagtaggtgagatcaactgcaaagacatgatgtgtttgcagggaagagaagaaagtcgaaggtgaggatctgggggagtgaacagggtcgagaaggcttgtgggaggcctggcctgggaaacgaagttcatgccaagggcctggggccgccttgaccaagacagccactgcgaatgagcgaatgagcaggggcccaggggatacatggacacacagcaaatgccccttgccagccccgctacctggccagggccgcctgcagctcctcctccttcttggccagctgcatcttgagctctgcgatctgcgcctggaggtcagcgatctgctcgtggaagtcgctggcatcaccctccagcttccgtttcagcttctccagctcctgtcggctcttctcttccttctttagccgcactgcaaaaaccaaggtgctcttcaggaaggggaggccccagagagatgcccggaaatgagccttcctgcccaggcattttacccggaggagatgaacacatcccccaatcagtaaccatcatagtcacggtctggaccattatctcccgatgaacagcaccttatattgtcataatattattattagttgagatggagttttgctcttgttgcccaggctggagtgcagtggcgcaatctcagctcactgcaacctccgcctcccgggttcaagcaattctcctgcctcagcctcccgagtagctgggattacaggcgcccgccaccacgcctggctaatttttgtattttgagacagggtttcaccatgttggccaggctggtctccaactcttgacctcgtgatccgcccacctcggcctcccaaagtgctgggattacaggcgagagccaccgcacccagcccttttatcatattattagtgcatgtgatgactaagggtgatttcgagaggtggcatagagttagttgtcactcatgggatgatctgccatcctcaaatttcctttctgattttcctgcttttaaaaatacccattcaagcccaggaatagtggctcatgcctataatcccagcactttgggaggccaaggtgggaggactgcttgggcccaggagtttgagactagactgagcatcatagtgaaaccccatctctacaaaataaaaaataaaaaaaaattagctgggtgtggtgatgcacgcctgtagtctcagctgctcaggaggctgaggcaggaggatcactggagcttaggagtttcgggctgcagtgagccatgatcgcaccactgcactgcagcctgggcaacagagcaagacctcatctctaaaaaaaataataaaataaaataaaaataaatctcttggtagctggtttaccttccagttctgaaatcatagattcatgcttgtttttcagcttggtaagattcttggccttttcttcctcttctgcaagatttgtcgttaagtcactaatcctctcctcaaggagttttcgttcctttttggggaaagagaaagagatagctttaggatttttcttttctctagaatctatgtttcacttttagtgatttccatgtaaacagttgaaagaaaaacccacattataacaaaatacaactagagttttaaatggtaaagagaagtcccataacaatttccaaaaactggccatttctcatctcgtgccagtttgtccctcatattgtatggtcagctaaaggtaccctccttccattcctgccactggccagctcttccctgccccagggcctttgcacagtgggccaaccagctgagatgctcttctactcccctctaactgctccttcatctttaagtttctgcttaaatgtcacctcctccaggaagtcttctatgaatacccttcctctatcccccactgctgtattctttttttttttttgagacagagtctcactctgtcgcccagggtggagtgcagtgttgctatctcagctcactgcaacctctgcctcccacgttcaagtgattctcctgcctcagcctcccgagtagctgggactacaggcgcccgccaacacacccaactaattttttgtatttttagtagagatggggttttaccgtgttggccaggctggtctccaactcctgacctcaggtaatccacttgcctcagcctcccaaagtgctgggattgcaggcatgagccaccgcacccggcctgccgcactcttaaaatatggtgaacgtttccttcagagccctgatcaccatggtaaatgacgattatttgccatctcactacagtataaaccccacaagggaagggtcctccttcaccatgcatacctgcatctaacacagagcctggctcacagtaggggccaagctgacatccagctcaaagaactaaaagcaggtggggctggttagtgactactgactacggtgaccagcttgtcctggttttctaagggcttttctgctttgagaactgaaagtcccaaatccccaaaatctccctgatcctggtaagcctgttgtttttaatgcagaaacttgattccacttttttttttttttgaaacagagtcactctgtcacccaggctgcagtgcagtggcacgatctcagctcactgcaacctctacctcccaggttcaagtgattctcctgcctcagcctcccaagtggctgggattacagacactggccaccacacctggctaatctttgtatttttagtagagatggagttttaccctgttggccaggctagtctcaaactcctggcctcaagtgatccacataccttggcctcccaaagtgctcggattataggcgtgagccactgcacccggcccctactcacttttgatagtttattgttctgatcatccatgaccaggatctcatcctccagtttcttgatcttggcctcagccgtgaccttctcaagttgcagcttctgcctggcagcttcctcctcctccagctgttcttcaaggtcctttgttgtggagggaaaagagtaacagctttggttataacagatttactctcgtggtgatctggggactaatgaatacaggggctaggcctgaagatgcccagaactctgtagcctcctaaaaggaagaaataaaggcctgagcgtggtggctcacacctgtaatcccagcacttttggaggccgaggtgggtggatcacttgaggtcaggaattcaagaccagcctggccaacatggtgaaaccccgtctctactaaaaatacaaaaaaaattagccaggcatggtggtgggctcctgtaatcccagctactcgggaggctgaggcaggagaatcgcttgaacccgagaggcagaggttgcagtgagctgagatcgcaccatcgcaccccagcctaggcaagagagtgagactctgtctcaaaaaaaaaaaaaaaataaagacctgggtaagctgctctgcttcatggaacctcaacctcctcatctataaaatgagcacagtaggtaccatggtggttttaaaatctatccacaagttctttgcgactccaaaaaggtggagcctaattctcctccccttgagtgggggttagatttgcttctaacaacaacaacaaaaatcaggaagaagtgatggaatgtaacttcagagattaggctataaaaggcattgcggcttcctttctcctctctcagatcactccttctgggggaactctgctgccatattggaaggacactcaagcagccctgaggggagaggccttcatgataaggaactgaggcctcctccaacagctgtgtgaataagccaagtagaagtgggtcctccagccccagatgagccttcagatgactgcagcctcagccaacaccttgactgcaacctcaggccggaccctcagccagaaccactcacctaagccactctcaaattcctgactatgcaatactttttatttttagctgctgagtttggcatgttttgttatgtagcaatagctaacaaatacaattatcctccattcaggcttgctgttaggagaaaaggggttagcacatgcaaggcagggcaatagaacagagtgggctcactgtgttccagtcccaatcccagctgtgtggccttgatcagatgaccaaccctctccaagcccccgtctcatcatctgtcccagcagggacacatatccctggatgcacctccacaggcctgtggtgagggtcaagtgatttgctacccaccacgggctgcccctgtgacaccttaccagcatctgctgggccatcttcttcctttcagcctgtagctgctggcccctgtcttcctcctcctccaggcgggcctccatctcatgcagtatctcctccagctcctgcttcttggccgccagccgcacccgcatctcctcagcctctgcatacagctctgtctctgcctgcagctgttcctgtagcaggttcttctcctcggtcagctgcacgcaggtggtggggaggaggcgggtgagccccacggggccaagtcctgttccccagcaaccccagccatgcatccatacaggtacctgcgagtgcttctgttccagctccttaagctcattctctgccttctgctgccgctccttggtcttctgcagttcatcctccttggcctgcatctcctcctcctgccgtgtcacctgcagcagtggcttcacctgcacacacacggttagcccatcatttgtttttgtggcaaagggatatgttgtcataataaattcgatcagtggttccgagccagggacaatgttgcccccaccgatccccactaggggatattgtctggagacactgctgattgtcacagctggggtggggggtgcctctggcatccagtgggtagaggccagggatactgctaaacaccctacagtgcacaggacagcccccacaacagaattagtcaccccaaaatatcaacagtggcaagactgaggagctctaaatcagagcaccagaaaaggtacaaagtgaaaggaaaaagtctcatcttccccactttagaaccatcccaacagagaactactgctgaaaagtgatatttccttccaaggacaaaagggagaaaaaaaatctttcatatcccacccacctccctatcaaagtcattattaacattgtttacatttccttcctggctctttttctatgtttaaaaaatagacttaagaccatgctgcctagttgtagaggctgcttttattatttaaaattatatgatacagacaggaacagtgatgcatgcctgtaatcccagcattttgggaggccgaggcaagcgcttgagcccaggagtttgggaccagcctgggcaacatcatgagaccccatctctacaaaaacaagtaaccaggcatggtggtgtgtgcctgtagtcccagctagtgaggggtctgaggcaggaagatcgcttgaaccctgcaggctgaggctgcagtgagccacgattgtgccactgcactccagcctgggtgacacagtgagaccctgtctccacaaataaaatttttttaaaaattataagatatgtattaccccatgctgttacatcattcttacaactttacatagccatcttttaagttaatttatttatttagcgatggtcttgttttgtcacccaggctggagtgcagtgacacaatcatagctcactgcagccttgaactcctggcctcaagcgatcctcccaccccagctccagagtagctgggactacaggcacatgccacagtgtccaactagacagctaggtagaagtcttttttttttttttttttagcagacctattcagtagccaaagccatcattttaatagctgaaaacattccattgatagatgaaccattattgaactcatcattcagctaggactggacactgaaattctgctattgtaaataaggccataatgaatgcccttaactcttgattttcttttctctttttcaggtggagtctcgccctgtcacccaggctggagtgcagtggcacgatctcagctcactgaaacctctgcctcctcggttcaagtgattctcctgcctcaatctcctgagtagctgggattacaggtgcccaccaccacacctggctaatttttgtattttcagtagagatagggtttcgccatgttggccaggctggtttcgaactcgtgaacccaggtgatcctcctgccttggccacccaaagtgctgggattacaggcatgagccaccacacctggctaagacgattttcttaggatagtttttcagaagttggttcagtggggacgaacatttccaaaaagcagcatctgctgtccttccctgggctgcctcctaactctttgttttcaagcccctgcctggcacaaggaagcccctgctatgtactccagcagcttgcttcatgcacttatcacagtttgccattatgtatctgtctctgtgattatctgtttattgtttactccccaccaattcggctagaatattcatggaggtcagggaccatggtgtgtgttcacagctgcacccccagcacctagcatgtgcctgggatacagcaggcactcaatgtctgtttgcttggtgaaaaagccttgcaccagtggatacactcaagggcatataaggagaagcctagtctattgcaacagagcatgtctttgtgccatggggacaatgcaaccagtgccactacaggaaccagttgagtcctctggaggccctgactctgccagaaataaaaaataatatgctatggccagatgaggtggctcatgcctgtaatcccagcactttgggagcctgaagcaggagggttgcttgaggtcaggagttcaagaccagcctgggtaacagagtgagactccatttcaaaaaatgcaaaaagtaaaaaaaaaaaaacctgcagtattgatacatgcaacagtctggatgctctctaattccatgtatagaatatttgttttatttttttttgagacggagtctcgctctgtcaccaggctggagtgcagtacagtggcgcgatctcagctctctgcaacctctgcctcccaggttcaagtgattctcttgcctcagcctcctgagtagctgtgactacaggcgtttgccaccacgcccagctaatttttgtacatttagtagagacagggtttcaccatcttggccaggatggtcttgatttcttgactttgtgatccacccgcctcggcctcccaaagtgctgggattacagccgtgagccaccgtgcctggccttttttttaaataaaaaaaaaaagaaagaagagacagagtctcaatctttcacccaggctggagtgcaggcatgatcttggctcactgcaacctctgtctcctgagttcaagagattctcctgccttagcctcctgagtatctgggattacaggtgcctgccaccatacccagctaatttttgtattttaagtagagacagggttttgccatgttggccaggctggttttgaactcctgaccgcaagtgatccgcctgcctcggcctcccaaagtgctgggattacaggcgtgagccgccgcccccggcagcattcttgaaccatcaaaattacagaactggagaacagagtggtttccatggctacggaggaagtgggtgtggctataaatgggccacacgagggattccagtgcggatggaaatattaatactttgtgttaaggtcctggctatagcctatgtgccaaaggacagggcctcctcgggccagagaaccgccaatgctcaaggtctgagttcgagccctccattccacacccacttgcgaccacctcctgtcccaaatgtgaaggctccagagtgaagaagcagggctgggggcccctgggaagggggctggggcagagcactcactttggtgaaaagcctccaccactgccagttccgcagcttgaggtaggcggcgcagttcctctgaatcaccttcatggcggtcagctgctgctgcctcttggcaaaagccctagggaggggggaagagaaggtgcgggggtcatgaagccacaccctgctgtcaacagagccctgccctgcagcatcctgaacctgcacagggacatgccccaatctccccaactcaggttcttccagaaaccctgtgtgacacatgtgttgtctggctgcaaacaacttaaatcatctacaggacagagcctttttcagtggacaaggaagacccagggctcacaacatgccctggacttagctgagatccaaacaccactcagaaaacacaactatgtgcatcattcctaagggggctcccgtactccccagctgcactagctgtttcttttttctttctttcttttttttttttttttttttttgagatagagtttcgctcttgttgcccaggctggagtgcggtggcacgatctcagctcactgcaaactccacctccggggttcaagtgattctcctgcttcagcctcctgagtagcttggattacaggtgcccacaaccatgcctggctaatttttgtatttttagtagagatggggtttcccatgttggccaggtgggtctcaaactcctgacctcaggtgatccacccaccttggcctcccaaagtgctgggattacaggtaggagccaccatgcccagcctacaccagctgtttctgactaacttatttatttatttgtttattttcagagacagggtctggctctgcggcccaggctggagtgcagtggtgtgatgatggctcactgcagcctcaaattcctgggcttaaatgatcctcctgcctcagcctcccaagtagttgggactacgggcacatgctaccatgcccagctaatttttaaagttttttttttttggtagagataggggtctcgccatgttgcccaggctggtctcaaactcctgggctcaagcaatcctcctgcctcggcctcccaaagtgcctgggattacaggtgtcagctaccacacccagccctgtcaaacctattctctcctgggttgttttaggaatttcacactgtgaccctgaaccagcactcttcccgtttaagggctatcgatagattgagaaacgatagaacagtgaacgtaattctgtcttccctgcttggctgccatcttggacacaggaaaactttaagaataaaattgccccagttatccaggaaggacagcaacagggaacttagtaacgaaacttgacaagttaggtctgttgcgggagggccaagagctcccaaagctggccttgaccatcttgggtccatgtgtcaatgaatgaacctgacacatcagggtcctactggtgagggtgtggtctctgcccaatgacaacacacaccccagacagagagcgaccccacctgtccctgcagtccctggggtatgactttcattaaggaacccgaacccttccccggctcccagtcttcacagaacagctgggacatcacaccctccaaaaccctgccttataaatcccactgggacacggggatctagacaccgtcaagtcctctttcctcaatggtttatccaattctaacatgtctaggctgggcgcagtgggtcatgcctataatcccagcactttgggaggccaaggcaggtggatcacttgagaccaggaatttgagaccagcctggccaacatggtgaaactttgtctctactaaaaatacaaaaattaggccagtgtggtggtgggcgcctctaattccagccactcgggaggctcagacacgagaattgcttgagtccaagaggcagaggttgcagtgagttgagactgcgccactgcactccagcctgggcgacagagagagagagagagactctgtctcaaaaaggaagaagaaaggaaggaaggaagggagggagggaaggaaggagtgagggagggaggtaaaaacaacaacaatcatttctgacctgagaaccacgcactgttctaagctctcgtcatgcgttatcttagtgacacctcatgaacagctctctgaggtcaaaatgattatgctcagtttccagctaaaaaactggaagctcagagaggtagagtaacttgcccaaggttcatcagcaaaaactggggcatccacgatgagaacccaggtctaaaactcgttcccttcctgcactcgtaacttggtacatttatttaaagtagaagcatttcttccccttcaagaaaaggctgtcattcagtcaatgatgcatcttaaacaggtggcctcttagaatcagggaatcagaacagaaaggcccctgtttgtgattcgcgtttgaggtattaggatgcaggaaagcatctttactttctggccaagtagccacgacacatcgcctggaaggccatgatgacatcggtgatcttcaaatctcgctcctcctctaggtgggccaggacgccagttcggaagaagattttgctctgccctatcctgtataagttggggtcaagttccagggctttgatctgcaaaaggaaggaaaggaagagctcctgatttccactgtgccatttggccagtgatgacatgggtaagaacggtcccaccaagagcagcaggtggcttgcggccagaggttgggaggtctctggtggacttctgggctcaccatgagaatgcaggcctgcttcccgtccatgaagcctttggggatggcattcgccgccaggatctcgtagcttgaaacacagagcagaagtcaccccgggtacctccagcatccattcctccacccagtcccgctcaccccctgccctacctgggccagaccttgggacttaccgttggcggaactcctggaagacgatccggttggggaagccctgccggcagatgcgaatgccttccagcaccccattgcaccgcagctgctccagcaccaggaacgcatccagcttgccggactgcaaaggtcaaagagggcagtggatccctggggccagaaaccatggcgcagcaaagccccaaacctcctacctggatgacccacctggccaggccatgagggtaccaacagaagcacccaaggagggcttagctgagggccgaggggcaaagcagtgcccccctctgggttttcatctctttgcttcggcaatggctgcctcatgatctctctggttcttggtgacactagcatcgcctggctggaacctggggcttcctcctcatcacctcgtctccctcacttcctgtccatcagcagtttgattgcttctagctcccaaatatctcccaacccccccacttctcttcaccaccattgtctccactatcttctcctgcctggacaaccacagaaaccacccacctggtctctctctctggtcttgcctctcccctcaatccctttgtcctttttattttttgagatagggtcccattctgtcagccaggctggagtccagtggtgcgatcatggctcactgcagcctcaaactcctgggctcaagtgatcctcccaaatcagcctcccaagtatttgggaccacaggtatgtgctaccatgcctggaaaatttttaaaaatgtttttgtagatatagggtcttgctatgttgcccaggctagccttgaacacctggtctcaagtgatcctcccacctcaacctcccaaagtgttgggattataggcatgagctagcatatgcccagccccctcattcacttcctaaaatgtaaatctgaccatgatatagccctgctttaacacccccaatggcatgcctagagagagaaggccaagctccagaaagaacacaaggagcaccacgatctagcccctgcctacccattcagcctcaatcctacctcacaccatctgattcctacctcatgccatcacacatttgcaacatgaaatgacctatttagcattttctttccttttttttttttttttttaagatggagtctcgctctgctgcccaggctggaatgctgtggtgcaatctcagctcactgcaacctccgcctcctgggttcaacagatttttgtttctcagcctcctgagtagctgggattacaggcgtgagcaacacgcctggacactatctagcattttcttacctagttccttcacttctcacctccacactcttgcttagcctgggccctctgcttatcctaggccccctgcttatcctaggccccaccctgccttccatgtcaccaagttgatggccacacattcttaacgttcaagttcaccagaagctttctctgagtcctgaggctgtgggaggagccctggctctttggtgttctcctaactgaccacattccatcaccatcatcagctgtatgtttacctctccccgtgtctcccataacctcagcactactggcatcttgtagggattctgtgctgggggttgagggaccatcctgtgcattgtacaatgcttagggcatccctggcccctacccactagatgctgactaacagccccctcctggttgtgacaaccaaaaatgtctgtagcatgtccatatagaggacacaatcgccccaagctgaagatgcctgcaccagattatgagaaacccacagggaagggctacaatttttctaacactgctccccagcacccaggacagggcagagcccagtgaatacttcctgggataatgaatgaatgagtggctggatgacctgcacagcaactccacaactgaaaagtctctggatgcatcctcccttcctccttttcctccagggatggggaatgggtctgagattcagatagccttccccacatggaaaatggggtcctcggggtaggtgggggcagagggcgccctggggacgctgtgaccgcttgggacagccctggcttctgggagccccagggtctgggcggcgggcctcaccctcttctcgtggttggggatgatgcagcgcacgaagttgggcgtggtgttgcgtagcgtggtcatcagcttgcccagctgctccttgtacagctgccccactgtgcggaacatgcccttcttggtcttggaggcgctgggcagcgagctctccgtcatcttggccatctggtccaggcccacgatgcggtccactatggggcacagccagggtggcatcagcctctggcccacccacccctaaataggccagaggctcagccccagccccacccaccaacctgcccactccaatctttccttccatcaccaacgcctccttcggcagtcagggtttccaagtattgtctattggggaaatcctgagagcacctgagtggcagaaagaacaaattccctgtgatggagtcacgctgacctaggagtcaagcctgctctcgctgtccactcactgactagccttggcttggcactatcctgtgcctcagtctccctttctacaaaagggaggtaataataccgtctaccttctagggcaggggtaaaaaaaaataaggcacagaaggcacttattccctgccagcctccaatctttcatccaccaacaaatagttattgaggaccttctgtgctccaggccctggggacactgctgtgaacaaaaaaagacccggccccctcaccccgcttatatcacagggaaggagacagacagagatcacagatgttaagtatggaatatcttgagtagtgaggtgtgcgtagaaaaataaaaatagggtaaagcggagagagagtgaagagggtgctctcttagacaaggaggtggtgggctctgctaagttgatatttgagcagaaaccagcaagaaatgagtgggtaaccatgtaggtatccacggaagaaatattctgaggcagaagatacagcacacactccgagatagcctggcacatcagtaagtgctcaacaaaaagtaggtattattattattattattattattattattattattattatcattattttattttattgagacggagtttcactcttgttggccaggctggagtgcaatggcgtgatctcggctcaccacaacgtccgcctcccgggttccagcaattctcccgcctcagcctcccagtagctgggattacaggcatgcgccaccacgcccggctcattttttttatatttttagtagagacagagtttctccatgttggtcaggctggtctcgaactcctgacctcaggtgattcccctgccttggcctcccaatgtgctgggattacaggcgtgagctaccgcgcccggccatcatcatcatcatcatcatcatcatcatcatcacctccaaggttctttttctaccagcccagcaggtcctgcacatgccaagcccaacccacaggccatggatggcaccatttcttcaccttctactcagattctgtgtaacaatcttttttttttttttttttttttgagacaagctctcactctgtcgcccagctggagagcagtggcacgatcttggctcactgcaaccttcaccacccaggttcaggtgattctcctgccttagcctcctgagtagctgggattacaggcacccaccagcacacccggctaattttgtttttattttttatttttagttttattttttcaagacagagtcttgctcttttgcccaggctggagtccaatggcacaatctcagctcactgcaacctgcgcctcccaggttcaagcagttctcctgcctcagcctcccgagtagctgggattaccaccaccacgcccagttagtttttgtatttttagtagagatggggtttcgccacgttggccagactggtctcgaactcttgacctcaactgatcctcctgcctcagcctcccaaagtgctgagattacaggtgtgagccaccatgcgcagcctcatgcttgtctctctgcttgtctttgagagtctcatctctcccacaagactgtgggtcccgcagaggagggactacaggcttcatcatgtgtcctgggatgacacagacccagggtgcgatgttgttccctaggcccagagcctggcatatggttagggcacagctggcccctcctggagccctttttttagcatgcttaaaacaaggggagaccagtcctgtaagccccaggcccatgggccctgtgccaagaataaaacctgctgtggacactgatggccagggacaaacagcaaaccccctcccctcatcatcactccagcagctcttcacagggatcatctattcactggttctcaaagggagccggagtgtggtccctagaccagcagcatcacctgggatgaatgttttcaggcccgccccatccctggccccagacctgcagaattagatcttagggtaggcccagccatctgggttttaaaaagccctccaaagagggccaggtgcagtggctcacacctgtaatcccagcactttttgaggctgaggtgggcggatcacctgaggtcaggagtttgagaccagcctggccaacatgggggaaccccgtctctactaaaaatacaaaaattagccaggtatggtggtgtgtgcctgtaatgctagctacttgggaggctgaggcaggaaaatcactggaacccagaaggtggaggctgcagtgagccaagattgcaccaccgccctccagcctgggtgacaaagcaagactctgtccctaaataaataaacaaagccttccagggggtcatgatgcctgcttgagtttgagcatcactggtctaatttaaccctcataatacctctagtagagacggcaactattattgcatctcctgttttactaatgaggacaatgaagcttaatgacatcaagtgactcatccaagaccacagagctaggaggtggcagagacaagatacagtgaagtccttctgactctggacagggcagtctaactccccgtgcctggcatgctgtttctcctctattgcctgagccctgacctcaggacctcaatcccctcgggacatgtaggattgaggggctcagggacccccactcaggaagaaattgtttcaacgagacatcaccagcccatgccaatgctcttccttcccctgcccccatgtaaaggcctcccctcctggggcaggtgtgagagtcgggggacttgggtgttcaattctccagctcaaagcagaacatggacccgagcagagaaggccttaccgtccttccacaggtcggccacaaacttgtcggaggaggcattgagcagggaagtcacgttgtcattcagcgggtccatattcttggtcagccaggcactcgcattatagtccacctgccaaggacaccctgctggtcagaacccctgggaaactagaaacttagaaaccaaggccaggaccccagccctcccattgtccttccagatcttctgaggtcagagaggaaatgacgtttatgaccaccatgatgggactccacaaacaccagtgaagagaccaacagcccagggacctgtgcccacgtagtaggacatcagccagtgatagccattgctgggaaagcctagtttccattccatattctcctactaacgctgctgtggtagcctccctcctcctaagccagcacagtacctgtgagttatacactattaagagatttcatgacggcagatgccctcctgccgacatgcaaaactcccccctcatcatcttcccaatcatcctggtttagaaattaagcatggcagccaagcgtggtggttcacactggtaatcccagcactgtggaaggccaaggtgggtggatcatttgaggtcaggcgttcaagaccaacctgaccaacatggtgaaaccccatgtctactaaaaatacaaaaaaaaaaaaaaaattagccaggcatggtggtgcacacctgtaatgccagctactcgggaggctgaggcaggagaatcgcttcagcctgggaggcggagattgcagtgagctgagattgcgccactgaactccagcctgggtgacagagtgagactctgtctcaaaataattaaataaataaattaattaagcatggcatcctattttccactctctaatgagcataatttgtaactcagagatcctgatatatggatatacagaaaaaggacatataggctttttacattcctgactcaaacaatgacaatgcccaaagccgtaatttttactatggtgaatattaaatgaaaggaactgataatacagctttgctgggttatcatgggatgtgggttatcaggataataggtaggcttgatctgagagaagactgaaaataataataaaaaaaatccactgatgaagtagggaaaagaaaagtgttgtctctatatgcttaaaggaacatatacccccttgaatataggctaggagttgggaaacttttggtgaaggcccagatagtagatatttttggcttggcaagtcatacaatgttttgtttgtttgtttgttttggtttttgagacagagtggttctctgttgcccagtctggagtgcagtggtgcagtctcagctcactgcaacctccaacttcctgggtcaagcagttctcttgcctcagcctcctgagtagctgaggttacagttgtgtgcctgtaatctcacagctggctaatttttaaattttttttattttttatttttagcagagacgggctttcgccatgttggccaggctggtctcaaactgctgacctcaagtaatccacctgccttggtgctggggttacaggcgtgagccaccacacccagccaagtcatacagtctttgtcgcagctactcaactctagcactgtagtatacaaaagcagccagccatagacattatgcatacaaatgggcatggctgtgttccaataaaactttatttacaataacaagctgtgggccagatcggactctgttgccaggccctggtagagagcattgtttgtgcccatgatgcagtggaggtactgaggagtcaatagaatactacaattctgcaagccagactaagctatgtcctttgtacattatccaggactcttgagagccacagggcaagggcctatacaataacagccaaggcatgttgatgatgatgatgatgatgatgaatacaactatcatagatttccctggccagagcaggctggcaatagcaaactcaagaccgtgacatgggagatttttgttgaagccaggtgtggatgtattagtcaccccattccagttggccccgcctgttgggtataacttgtagcaggaaggatttagagtctatacaagaaaagcaggctgaggccaggtacagtggctcgtgctcataatcccagcacttcaggaagccgaggcagggagatctcttgagcccaggaattcaagaccagcctgggcaacacagcaagaccccatatctatacataatttaaaaatttagctgggcggccaggcacggtggctcatgcctgtaatcctagcaccttgggaggccgaggcgggtggatcacctgaggtcaggagtttgagaccagcctggccaacatggcgaaacccttctctactaaaaatacaaaaattagctgggtgtggtggcaggtgcctgtaatcccagctatttgggaggctgaggcaggagaatctcttgaacccggagggagaggttgcagttagcagagatcacgccattgcactccagcctggatgacaagagcaaaattccatctcaaaaaggaaaaaagattttagctgggcatggtggtgtacacctgtagtcccagctacttgggaagctgaggcaggaggatcgtgtgagcccaggaggttgaggctgtagtgagctatgatcgcaccactgcactccagcctgggcgacaaagcgagaccctgtctccaacaaaaacagaaagaaataactgtctggacgtcacggttggaaaacatgagagtggctacagctgatgccttacagatgcgtagacaaattacgaataggacttggttgggattcgcttagcagcagatggctttgcagtttccaggcagcccaaggttctgccactctcagactgtctctgcgctgagcagccactgggggtcccctgagacagagtcccctgggccctgtggctggtaccttcccagcataatggatgatggagaactcagtcttgtccttgagctgcttgggcttctggaacttggggtggctgccctgctccgtgcacagcttctccacgaaagacttgtccgtggctttggggaaccagcattcctcgtccagcagggccagcacacctggagggttgttctgtgggagacaagtagggcttgaatcagagagaacacccaacctcaggcattccatgaagagctggccaactatacacaacgcatgggcatccgccgagatctgatactgtatttgcccacatataaagatgagtttatgacccccatgcttccaaatctaccttcaaattaccctgtgcccaatggaccagtaacagggatggaaggcagaacataatgtttgctgccgccccctagtgggcaacacgcaggcaacatcatgaagagttcataactcttttttttttttttttttttttgagacagagttttgccttgtcgcccaggcagacggtgcagtggcgcgatctcgactcactgcaagctccgcttcctgggttcacgccattctcctgcctcagcctcccgagtagctgggactacaggcgcctgccacggcgcccggctgattttttctatttttagtagaggcggggtttcaccgtgttagccaggatggtctccatctcctgacctcgtgatccgcccgcctcggcctcccaaagtgctgggattacaggcatgagccaccgcgcccggccgagttcataattcttgcaaatgaatttgttgcttgacttgaattcacctagggttcctgttagaaaagttttttttggagacagggtctcactctgttatccaggctggaatgcagtggcgcaatctcggcttacagcaacctctgcctccagggctcaagcaatcctcccacctcagcctcccaaatagctgggaccacaggcgtgcaccaccaggcccggctaattagtagaaaccctgtctctactgaaaatacaaaagttaggtgggcgtggtggtgcacgcctgtagtctcagccacttgggaggctgaggcgggaggatcacttgaggcagggaggtggaggttgcagtgaggcaagattgtgccactgcactccagcctgggcaacagagtcagaccatgtcataaaaaaaaaaaaaaaaaaaaaaaaagcaatggcagagaaggaaagggaagggaaagagggtagggaagaaaaaaaggaagaaaaaagaggatggaaggaaggcagaaattaaagaaaatacctttgatatgaaaatgtgggttaatggaaattgtaagagttcacaaggattcagcttacagcctttcaggactgggtgatggattgggtgggggaatgctatgtgcatggggagagtgtggggtccacgtcggctccacagaggccacacacgtgtacaaggtgtgacggagccccgcacgcccacgtgcccctcaccggtcgctcgatgagctcgatgcagggctgtaggtccagcccaaagtcgatgaagttccactcgatgccctcgcgctggtactcctcctgctccaggatgaacatggtgtggttgaagagctgctgcagcttctcgttggtgtagttgatgcacagctgctcgaaggagttcacctgagcacatggcgtgggggcggggcgtgagcatcttggtatgaagtcagaagacaaggagccccacagaagctccacccgacagcgcccccatggcccgcccacatcctgttctgccatcccagcacccagacagggctgaggccccaaaacatgctgcctagagtccaccagggctggtgaagttgatatcacatggccctcacacaccttaaagatgcttatctcctccatctgcacaaccatctatggatggacaaacctcgtaaggcacgctactgcatgtacagatgtggaaacattttacagatgtgaaaacagaggcgcagagagaaagtgactcggtagtacacttctttcgggacatctatcaatcttaaaacctcctggctgggtgtagtgctcatgattgtaatcccagcacttagggaggccaaggcgggaggatcacttgaggtcaggagtttgcgaccagcctggcaagcatagcgaaacctctctccactaaaaatacaaaaattggccaagcacagtggctcatacctgtaatcccagcactttgggaggccgaggctggtggatcatttgagatcaggagtttgagactagcctggccaacagggtgaaactctgtctctaccaaaaaaaaaaaaaaaagtagccaggcatggtggcactaatcccagctactcgagaggctgaggcaggagaatcacttgaacctgggaggcggaggttgcggtgagccaagattgcactactgcactccggcctgggcaacagagcgagactctgtctaaaaaaaaaaaaaaaattagctgggcacagtggtacactcctgtagtcccagctactcaggaggctgagacaagagaattgcttgaacccaggaggcggaggcagcagtgagacaaaattgtgacactgcattccagtctgggcgacagagcaagactctgtctcaaaaaaaaaaaaacaagacaagacaaaaaaaaaaccttccctttctctgagaactttcttcaaacccatgggtaaaggatccaatatccatgtttctactacatgaggtattgcaagctcctgcaaacagttcttggcttggaggtgaccatgtagcccaattcaggtgagtaagagtcagtgagacttaattccaagattttggttggaactgttagaaaagagatatgtgctttttttttttttttttttttaccaggattactgagaggcagtctggagctgtggcagccatcttgcccccgtgaggggagagcctgcttgagaatggagccaatatggaggaaggcagagagagagagagaacgatggcgggagatcagaccctgcctacgggatccagctacatgtctggccttctcagttccagaaaccaatgcatttcctgttggatttctgtctcttataccctcaatgatccacccttaactagacagcctcctaccctacagtagccatctacatgcctttctccaaaatcatgactcctccaagaaaaagcccatctcagacaaccaagaccatggctcttaggatcccaccgagctgtacctcaaagatctcaaatccagctatatccaggatccccaggaaggaagccccttgccgatgggtcttgtccagggctttgttcacgcgggtgagtatccagcggaaaaggcgctcatatgttgccttggccaaagcctctacagcaaagtcagcctgcagagggcaaccaggggaacccggttattctcaatgggctccattttcacataagccaggctggtggtgaagatttttattcttggccgggtgcagtgactcacactgtaatcccagcactttgggaggccgaggcaggtgggtcacttgaggtcgggagttcaagaccagcctgaccaacaaggcaaaaacccttctctactaaaaatacaaaaattagccaggcgttgtggtgcatgcctgtagtcccagctgcttgggggactgaggcaggagaatcgtttgaatctgggaggcagaggctacagtgagctgcgatggcaccactgcacccccccctgggcaacagagcaaggctctggctcaaaaacaaaaaacaaacaaacaaacaaaacctgacatgggactgtgaatattctagtattgaataaatgagggataaagagatggatgggtggatgcatggacagatgaatgaatgaatgaatgaatggaatgacagctggatgggtgatggatggacggacagatggacagatggctgggtcatggatggatggacagatggatgagtgagggatggagagatgatgggtgagcagatagatgggcagatgaatggatggatggatggatggatgaacagacagatgaatgagtgggtagaaagatggatggatggacagatgcagaggcagaccatgggtgaatggattaatgaatacatgaatgagtgaacaggtggatagatggatgaatggatggatgggtgggtgcatggatggataagtgataagtacatcattacctgttcttttgtctgagctttctgtaccacatctcgcccaaccttgatacgaggagtgaggatggatctggtgaaatctgtcacattaattcccatgaggtggcaaactttctgagcagctggatggagaaaagaaacatcgtgagtgcatcacaaaagaaatagcttggcaagaagacacatcgcatgggatatttgtgatctgtgaatacagcgggttctcttggggaaatgggacccgctgaccatgaatatagcttgaagtgtcctaaaggctgctgtcattagtggtcacactccccagtattttgctgagaggcaatgattggggtgggctgaagcaggccccagttgggggtttagggtcaggtagttctagtttcaagtccctgtcccttcacacttccaagtcatgtgactttggaaaagctctttaccctcccagcatcttgcttttctcagctttaaaaagggtcagctcttcggtaccttgttggtacccaggactaaataaggtaaagtatgtaaagtccctgagatagatagatttatttatttatttatttgtttatttatttatttatttttggagacagagtctcgctctgtcgcccaggctggagtgcagtggcgcgatctcagctcactgcaacctccgccttccgggttcaagcaattctcctgcctcagcctcccgagtagctggcattataggtgcctgccaccacacccagctaatttcttttgtattttagttgagatggagttacaccgtgttgcccaggctggtctcgaagtcctgaactcaggcaatccgcccacctcggcctccctaagtgctgggattacaggcgtgagccactggcccttgagatttatttaacagttacttagtaagtattaaatagttattaatagtaacatttattgaacagttactgttcaataaatatttctttcacccttctaggatatgtgttgcagcattgtttgcaatagcaaaatgctagagtcaacctaaatgctcttcttttattttgagatgcagtcttcctgtcgcccgggctgaagtgcagtggtgtgaccacgagctggtcccttaacatgaaaatagcattacatgctgctttgcatgtgcaaggcagagtaaatagagtgattttaggatttttttttccccatctcttggcaagagcactttttcatttctctttccctgaggtctttccttggcatccggattccattaatttgccagatttagggactctaatacataacaaacacctgagaatgaaactgccactgcaaaattataactgagacactgaacaagatctgacctaacggactccaccttgcttctaacctccaagctccactgaaccatttgtgggtgtaagccgaattaacttggcaggaacttagtttatagtttattttttatgttttggacacagagtctcactctgttacccaggctggagtgcagtggcacaatctcggcgcactgcaatctccgcctcctgcgttcaagcagttctcctgcctcagcctcctgagtagctgggattacaggcgcctgccactacgcctggctaatttttgtatttttagtagagatggggtttcaccatgttggcgaggctggtcttgaactcctgacttcaagtgatccacctgcctgggcctcccaaaatcctaggattacaggcatgagccaccacgcctagcctcttagtttatagtttaaaacacaagaaccctttcccaaaacaaacccccttcttgcctggagactagactgcctttgtaggaataacaaattagcccaaaggtttgaaattatggtttaggagtcctgtaactggaggctacaagagtctgaccctccctaaattgctcctggggataacatcactattgtaaaacctaagaccagtacttgagatatttttgcggaccctggcaccaggtggatcagctgacaccacccagatcgagaaactggctcatctgatcttatggcctctgtccaggaactgactcagggcaagaggacagcttcgactccctgtaatttcatctctgacccaaccaatcagcacccccaactcactggcctccccctaaccacattatgcttaaaaactctgatccacgaatgctcaaggagattgatttgagtaataataaaactctgttctcccatgcagccggctctgcgtgagttactcttactctatcgcaattcccctgtcttgattaattggctctgtctaggctgtgggcaaggtaaacccagtaagcggttgcaacaggtttgatcaaggtgggctctagggagcgggaaaaagcaacacaatatacagcctgggctgggaaataagaaacctaagttttgctctcagctcagccaccaacaagcatagtggtagccaggccagcttctcaaaacacaaaatactgtttatttgtgggtaggtttatcagatttagggggaaaattacaggatgctcagttaaacctgaatttcagataaacaagaatactcttttggtataatcacggtccaaatgttacaagggacataattaaaatttaaaaaaaggtttgttgtttacctaaaattgaaatttatctggacatcctgtattttatctggcacccctaattctcagggcaattgaggtctgtctccccaagacgaccacagataccgtaagaagagctattcttgtgtcatttcctgctgtatcccagtggcatattgcaggggcttgagaaatatttctttaacaaaacaattaagtggggtattttagaagagatggtccctcgggatcttgtctggtcactattaggggtaggacgtgatgactcttgcctgtaatcccagcattttgggaggccaaggtgggaggatcacttgagctcaggagttcaagatcagcttgggcaacacagcgagacctcgtctctattaaaacttgtaaaattttgtatttaaaaaaaagaacaaataaataaaactattaggtttgtttttttttaatccctgcgctctgattcaataactttccacatagggtcttgagcactgaaaagtttgaaaaagtgagtgataagaacctagtccaactgttgttaaaatcccagataccttcaccttgaaaaataaccagtggttaaatgtcacctcccccacccccccaaccccaaagtcattggtcatcaggaaaaagtggcaagtacctgtgttatctggcatggacgcctggtctgtgtttctttccttcttgaagacgatatttccaagctgcaggaccgatgataccaccttcaatatggctgaggtggggagagaagggcagagcagacacaaaggtcaatgccaaggtaccctggagttttggagcctaaagccactggggacccagagccagcttacatctttcctctgaagaaactagattctgagctcaatattttcatatggttgcttaaaaccttgcattacaatggaatgccacgcagcagggactggcaaattacagcccatggaccaaatctggcccactgcttgctattatacataaagttttagtggaaaacagctatactcattcatttacatattgtctgtaactatttgcatgctacactggcagagttaatgagttgcaacaaagatcgtctggcctacaaaggctaaagaatttactatctgaccctttacagaaaaatgtgttagcaacccctgccacagaacagtgagaatgaatgagctacaactaccacaaatcaaaactgatgtattggggccagcatagtgactcatgcctgcgaccccagcactttgggaggctgaggtgggagaactgcttgaagccaggagcttgatacagcctgggcaatgtagggagatcctgtctctaaaacaaaaaaaaaaccctgacatatcttccagacacaaataccgaacaaaagaggacagatggaaacaagaacatactgtctaagtccatatatagaccgtccattcaagaagaggcaaaactaatcgatgctgttagaagtcaggataatgattatccttaattgagggaagttcttagaaggtgcatgtgggagcttccatggggctggtggcattgtcttatttaaaatggattctagttacacagacgtgttcagtttataataattctttgcactgcacgctatggcatacacaattttctccatgtaaatcatatgtcaataaaaggatttttgaaataaaaaccctgtgcttcttacatactcttctgggtgtaacagatgcccatgttgggatgaagaagatatacatttgtttccacttgttgtccaggtgtctccaaacaaaaacgctgtgttcccagaatacttggaacctttctgactccatactcaggccatgttactgttaaaatagtttctatgtctgaaatccccataagaccatgagtttctggagagtggagggcctgccctaatcatctttgaatttccaaagcctattccaaggtcctgatacacatgggagggagggagagagatggatggatggtaggtggaaggtggatggatggatgaatgaataaatggatagaggatgggttcatggatgaatggacggatggatggatgggtgggtagatgaatgggtgaatgatggacggatgagtagaggatagatggatgaatagaggatggattgatggatgaataattcatggatagaggatagacggatgatggatggatggatagaggatagatggatagatggaatggacagaggattgatggatagacgatggatagatggatggagaattgatggaggaatggatacagcattgatggatggatgatggatggatgaatggatggatggacagatgatggatggatggtagatggatgaatggatggatgatgattaatgcaaattcttggcttagcttaactcaggtacaaatcacccagagttctggcttcaaatcagtcactatgttccaggaacaaagcctagagatcccagacttctctggttcctcaggccaaaccagacattacaaggcccttcacaacagctattctcacgccatggggtccctggcccagctcagcaaaaggacccagctgctgaccacccatccatttgctcccacttactatggtagaaagccttctccccaaaatgaatgaagctgctgttgacagggcttggaaacacacttccttttaaccataacatctatgaaagagtctttgtaaactatgaagagttgcactcacagttttaaaagtgtcaatttaaactaaagattcctgaaatgcctgcacagcccaggcgagccggccaactcagggtttctcaatcttgtcactgcagaaattgggggccagataattctctattgtggggagctgtcctgggtatcatgggaagtttagtagcatccctggcctctaaccactagatgtcagtggtggttaccctgacagagttgtgacaaccacaaatgtcaccagatactactcaatgtcccctgggaggcaaactcacctctggcagagaaccactggtctaaatgaacaaagccaactaatgaggactgtggggacccaaggaggccacaaacccatctgaaggggccagcagctactccgtcattgccacaggggatataagccaagtgttgctggaacttctgatttttctagataatggaaacccagagtttttatgtgaagtgtacccatgttttttggtgtgtgtgtgtgtgtgtgtgtgtgtgtgtgtgtgtgtgtgtgtgagactgagtcttgctgtcacccaggttggagtgcattggtgcaatctcggctcactgcaacctctgcgcttcccaggttcaggggaattctcctgcctcagcctccagagtagctgggattacaggcgtgtgccaccacacccggctaatttttctatttttagtagagacggagtttcaccatgttggccaggctggtctcaaactcctgacttcaagtgatccatgtgccttggcctcccatagggttgggattataggccacagtgcccggcctacccatatttaaactttaggaaccaatttctaaaaattttgaaggttgtagtggccgatctctcctgtgggctcaggaaccattggtttgcactttctggtatagttaaatgtaattccagaaatgacaaaagaatgccaccactcccaggccataagagatgaaccttggggcagaattagcagacagcaaagaagtaaaccagtgaggagacacaacacagcaagggtggtgacggctggcagcatcctggtgtgctggtgcaaagcacgcgctctgcagttagagagtcctgagttcaaatcccagctttgcttcttataaatctcattatctctgaatttccaaatcctagttccgggtccagatacacatggggagggagggagatggatggatggcagatggagggtgaatggatggatgaatgtataaatgtatagaggatgggttcatggatggatgggtgggtagatggatggacggatgggtgatggatggatgggtgatggaaggatgagtagaggatagatggatgatagaggatggattgatggatgaatcatggatgaatagaggatagagactctacatgagtctcaataagtcccatgagcctcagtttccctatctgcaaaacggagatggtaacagtagtacctgcttcgtgaagtttaggtcttgtaagatgctgagcaagggcctggcctagtaggtgataaagagtggaagccacctatattaggttgaatgttggtctttctaaaatatgtccacctggaacctgtgaatgtggcctaatttggggggttacatttatttttttttcctttttgtggataccggggtctcactatattgcccaggcaggtctcgaactcctgggctcaagctatcctcccgcctctgcctccctgagagctgggactacaggcgtgaaccaccgcgcccagcctgaacgtggcctattttggaaaaaatcggtcttcgcagatggaatcaagtacaagatctcaagatgagatcatcttggattaacctggtgggccctacatttaatgtcaagtgtctttatgatggacagaagagaagacccacagagtagaatgccacatgaaggatgaggcagagactggagtgagacaagccaaggaaaagccaggaacagccagagccaccagaagccaggacagaggcaaggaacagatctccctcagtgcctccaggaggaacaacccctgccaacatcttgtcttttaaaaaaaaaaaaattttttttttttaaatttttagtagagaaggggtcttgctatgttgctcaggctggtcttgaactcctggcctcaaacgatcctcttgccttggcctcccaaagtgctgggattacaggcatgagccattatgcccggctcctgccgacaccctgatttcagaaccctggcctccagaactgggagagaataaattcctgttgttttaaggcatcaagtttgtgctaattttttacagtggccttacacctctcttcttgctgaggaataagaaacaggactttccaacatcagacatgtgtaccaccagggatacacaggatggacaatttaggtgattttattttttatcttcaaaatacattagaagcagtataaccaggccaggcatggtggcgcatgaggatatcttgaggccaggagttcaaggctgcagaacccaatgtggtggggaaaatcctggtgtcccctggtcacttggagcctcatgaagctccagcctgaagcctgacccacccccttctccataggccccttgatggagggtttggaagtagctcttggtttataaatggggttggtgtacatttaggactaagttggttcctatgagagttcgtcatttgcacgccatcgtctgaatgcttgctctgtgtaccatctgctccattatttgcttaatcattttctttaaatttacttccttctctttccttacatttgttttaatagaaaactttctctatcttcagtgacaaatcatcttcacttgccataaatagatggcaattataaatataaatacaaggaaaacagtattaccaaattctagctagatgcttggggctgccgaaggtgctgggcctggagtctggtctctgtggttaaaggggaaacaagtgccaaagtacattgagaacactggggactgggcatggtggctcatgcctgtaatcccagcactttgggaggccaaggtgggctgattgtttgagcccaggagttcaagaccagagaatactggataacatggtgaagccttgtctctacccacccctccaaaaatcaaaccaaaacaaaacaaaaaaccccaggccaggcacggtggctcatgcctgcaatcccagcactttgggaggccaagatgggtggatcatctgaggtcaggagtttaagaccagcctggccaacatggcgagacccagtatctactaaaaatacaaaaaaaattagtggggcatggtggtgggcgcctataatcccagctacccaggaggctcagccaagagaattgcttgaacccaggaggcagaggttgcagtgagccgaggtcgtgccactgcactccagcctgggtgacaatagcaagcctccatctcaaacaaaacaaaacaaaaaccctaaaatcaaaaattagccaggcgtggtagcacatgtctgtagtctcaacgacttgagaggctgagctgggaggactgcttgagcctgcaaggcagagattgcagtgagctgagactgcgccaccgtactccagcctaggtgacagagtggtgtgatctcggctcactgcagcttcgacctcctgggctcaagcaatcttcctgcctcagtctcccaagtagctgggactacagtgtgcaccaccacacccagttaattttttgtattatttgtagagaagggatcttgccatgttgcccaggttagtctcaaactcaagctcaagtgatctgcctgccttggcttctcaaagtgctggaattacaggcgtgagccaccatgcccagcaaaacaatttaaatggtctcattgttttctttcacaaggacagacaatgatttaataaaccctctattaatcaacctattttagtttgttccagtttttttctatttattttttttgtagagacagagtctcactgtgttatccaggctggtctcgaactcctgggctcaagcaatcctcttgcctcagtgtctccaaatgctgggattacaggcatgagccactgtgcccagcctgttccagttttttattatttaaataaaactatactgaacagtgtagtacatcaagaaaaaaggatttggtaaattcctggcacacagcaaatacttaaccattgttcattgttatttaaaagcaagattagaagcaaaactgacccctgtcccaaatgaaatgaatcattcttggagggcctatgtcattcagacaaggaggctatcagcactagattctgatgtgggaccctggccaagacccacatacaccatccatttgtcaactgacccatacagcctaattttccagaccccaagttatcttcggaggagctgcccctccccttatgcagcatttcagcaacctcagtgctattctggggctccaaacgggcgtaggcgtgggaaggaagggaaactttccacagttctgtcctggtgttcctgaaagagattaaccttcaacactgaggcacatctaacgcagaaggaaaatcgtttctggaaacacagtgtcccgaccaagaatttctttctgagctgtcctgttctcaagacccagtgtgtttcttggccattggttggatgattttgatcaatatcaattgatcaccagagcaacccctccaggaaaagcctgagtaaatccactgcctcgatcactccccctcccctaaaccctgcccacatgttcctgatgaggccaacatctctaccttcagctccaagaatccattcttagggaccataatgaaaccaccctgcgctttccacaaccctgcctatgctgcatagctcaggaatgtgcatatcaacctaagccaaccaatcagagtcaatgacactccattcaggaacttaagccgggaatctactctgttctttggacataaacccaaagaatataagggctggaacccagctatgttgctgtcaacaaactgcatcctatagagaaacaatgtagtcgagagagatagaagacaagaaattaggttctagaaaaatcttttgaacacctagatctcactgtacctgaagcttgaattcctgaactttttttttttttgagatggagtctagctccatctcccaagctggagtggagtggtgtaatcttggctcactgcaacctctgccttccgggttcaagcaatcctcccacctcagcctcctgagtagctaggactacaagtgtgcaccaccagccctggctaattttttttttgtatttttagtagagacagggtttcaccaaattgaccaggttggtctcgaactcctgacctaaagtgatccgcccaccttggccccgcaaagcgctgagattacagacctgaaccactgtgcctaacctccctgaacttctcaacattctgagttagtcactttccctttggtttaagccagctcgggttacttgcaaccctagttatacagccacttttctacaacacaaacaaaccacctagaataaaattcattttcctccttttttttttttttttttaatggaaggtggggaattcagagagcagaaatctgtcctgaccagagaagagttcttaacaggttccactggtatccaggcaagctaccctccagactcaaggtgtgaggcttacatagctgctcctcctcgctgaaacccatgattgccatggcctccacggtttcctggaacatctcatcatcctgggctgctgggatgggcacaaagccattggagaggaaggtgtagttgttgaagccctccaaaagcaagtcacctagaaggagaggaagacaggtcagggtcaataagacatacttctaatttcaacatgagaccgagatctggtcaagggtctgggccatcataattcctttccctttatcaaggcttgaaccgtttaaagccctcacgcatcgtcacgtagacagcctcaccaaccactgccagccttacacagcggtgcaggttgtgcactgctccagtgactgcagctgatatccagccttggttctgcttgctaagccacaatccctggcacgaagttacatttacctggaggaagggatgcctttacctcaattgtctagaggcaccctgccttcagccttcagagacaaagctgtcagaagagttagatcaacctttactcttttttttttttttttttttttgagacggagtctcactctgtcgtccaggcaggagtgcagtggcgcgatctcggctcactgcaacctccgcctcccaggttcaagcgattctcctgcctcaacctcctgagtagctgggattacaggcgcccgccaccacgcccggctaaattttgtatttttagtagagatggggtttcaccatgttgaccacactagacttgaactcctgacctcaggtgatccacccaccttggcctctcaaagttctgggattacagacgtgagccaccgcacctggccttattcatgtatttataaaatttttatcaaattcaaacaggcacatgagttttaaaaatcaattactaccaaaggtttataatgaaaaatagcattctcctgtcacatcccttctccaactctaccttactccataatacctgcttttatctcttttagctgctttttatctggcagttaccactatctctctgtacaataggcttgctatatatactagcctattataatgtatataccattatgtattacatatcataggccaagggttccccaacccataggccatagaccagtaccggtccatgttaggaactgggccacacagcaggaggtgagcagcaggtgagcaagtgaagctttatccgctatttgcagctgctgcccatcgcttgcatcactgtctgagctccgcttcccataagatcagcagcagcattagattctcataggagcgcaaaccctatcgtgagctgcacatgtgccctccttataacactctaatgcctgataatctgtcactgtcccccatcaccccccgatgggactgcaggaaaacaagctcccaatgattctacattatggtgactagtataattatttcattgtatattacaatgtaataataaagtgcacagtaaatgtaatacacgtgaatcatccccacaccatccccccaaccctgcccgcccagtctgtggaaaacttttcttccaggaaaccagtcctcagtgccaaaagtaacaggtgcttttggcctattggaagaccagaggcaaagcacaatcgctgtaataggcgatttctggatatgtcaagtttagatagtatctagtgacttcctgctatggtaggcaaaaatgcagctttcttatactacctttcctttcctccagctatttttttttttttttttgagagggagtttcacctttgtccaggttggagtgcagtggtgcgatattggctgctcactgcaacctctgcctcccggattcaagcaattctcctgcctctcgagtagctgggattacaggcacccaccaccatgcccaggtaatttgttgtatttttagtagagacggggtttcatcatgttggctagtctagtcttgaacccctgacatcaggtgatccacccgcctcagcctcccaaagtgctgggattacaggtgtgagccaccgtgcccagccacccccagctatttttagttgaatcaatatataaggcttatatcacaggttggcaaatctggtcccctgttgtttttgtaaataaagttttattgaaacacagctgctctgatgtccttgtttatttctcatggctgctttctcactaggcaacagagttgagtagttgcaacagaggccatctggtccttaaagtctaaaacgtttactactgaccctttagcaaaaacagtttgccaactccctttttatgacattaattagatattctgtgtcaaactgtatcctatgattacatttcctttgttgttgttcagcttctcccccacccccaactttataattgcctttctttctcctgcaccatttgcttttattataccctccaatacatcaaggatcctcttccagatcaatctttaattaggatggattcggttatacttttggagagacgtcagcaagatatttttctttcaaaatcaaggtcttttatgggtcaagtcacttggaagctgcttgataaactcgaggttaaattgactgaaggcaccagttaactcaaacttttggattaacttgaaatgcctgattcaagtcacgaggattgaggtctttgccaagacttcattatcccgagtttggatgcatttagcaatatttggttctttctaaaagcctaacatctttccagttctatcatctagaatacaaacggcccctgggaatttagttctgagccctatacttgcccatttctggaagaccagaggcaaagcacaaaactggaacccaaggtaccaaacaaccaaactgttttcttgggtgccaaataaaaggaaaaggaatgtcaacatttttccctggcccattccacagggtcctgcactgtaactgctaatataccatgtttgctggtacataaaaaatccattcagcattccccctttaccaaaaattgctccacctcatagcctatgttcctgaaagccagccattaaggaaacttatttttattgtttgagacagagtctcactctatcgcctaggctggagtgcagtggtgcaatcttagctcactgcaaactccaccttctaggttcaagtgattctcctgcctcagcctcccaagtagctgggatgacaggcgccagccaccacacctggctaatttttgtatttttggggagacagggtttcactatcttggccgagctggtctcaaactcctgacctcaggtaatccgcccgcctctgcctccgaaagtgtgggattacaggcatgagccactttgccccaccctggaaatttaaataatggataatgccaccccctagtagctgaggtctacaatacactccgacacagcgaagttctgagctcacacagatccttttggtaactgtcttaaccaaaataactaaccttgggccacaaaagagatgggaagcaaagtctgtattgttcccatagaatttcagactcaaaacttattactaacatgtagactctactatgtacagatagtcactgatccattccttttttaagctatgcgatttgtatatatttttaagagttagtaaacagctgcaggtccagaactcataacttcctactggagtttggtatacagtgtattatatttacataaaaaaacttttccctacaacagaggtcagcaaacttctgcacactgcctgtttttgtaaataaagttttattgtaacacagtgatgcatctgcactcactgatttatgtgttgcctatgttcattggtttatgtgctgcctgtgctcattggtttatgtactgcctgtgctcattggtttatgtgttgcctgagctcactggtttatgtgttgcctgagctcactggtttatgtgttgcctgcactcattggtttatatattgcctgtggctgctcttgtattacaatggcagagttgaatagctgtgccagaagccacctggcctgcaaagcctgaagatttactatctggccttttacagaaaaagtcttgacccctgttctacaaagtcactggcaaaacatgtataatgaaaaatgcttagtcctgctgcccctgcaaattccttataaaaccagaatgcatcttttatatttgcaagttttataaattggcaagtaaggcaaatgtctttctccctttccttgaaggcgtagattgtgtctagttggacttgatgctctctggtctaatgagacatgaatcattaatgatctaatgtctaattggagttgatggctactatgtcacatagtaggtgctcagtaaatgagaatgactgaacacaagccacactcactcattgggaggagatgaagaactgttcatatgtcactcacagacatggtcctttctggcaggatctgagactgttttaatagccaatcccttaaccccggattctgatgaaagggaaggctcaagccatccaatcacatgtcattgctagtcacttacttctcatcttctccttggctccagcaatcatgtagtaaaagatgtggaatgtcctctcgtctctggcttggcgaattgcccgtgatttttctagcagatctggtttggagggagttagggattctggggatactgcgggtgttcctctggtcttccacctccatccctgtcacacccaattcacatgggatgactttccagttctacccctgggatcggtaatgtctaactttgaccattgcccctatggacaaatggaaccgctgggtgctgccagcagacttcagatgcaaaaaaaagggaggggaatagagtgaaaagaaaaagcataaaaaggctccaggaagaaggtaatggtaacgagatgttcccctaacagccatcaccagcaaatcttctttaaaatgagctgtcttcagacatgacagaatacaaataatgacaccatctatgatcctatgatttatgattcattcctgtgtgaaatgattgatataaattgtctcactgaagcctcacaaagtatgctaggaaataagtgcaactattatcggtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggagagggcagctgggaggctgggctactgtactgggtggatttccacagcactaagcatgatggtgcgggatgatggggctagatcagcagaccttgtcttcttcaagtcctaaagccagctagcagtgcccgggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggcagtgtgtgatcttggctcactgcaacctctgcctcccggatccaagcaattctcctgcctcagcctcctgagtagctgggactacaggtgcatgccaccacgcctggataatttttgtatttttagtagagacagggtttcaccatattggccaggtggtctcgaactcctgacctcaagtggtctgcccgcctcggcctcccaaagtgctggaattacaggcgtgaaccaccgtgcctggctgagatgtgtgtttctaaagagctcccaagtgatgctgatgctgctggtttggaaacatactttgagaaccactgatctaaaaggaaggctgaggccagaaggacggggctatgcctggggctcgctctaaacacaggaaatgaattgctgagaggtgtgtgcagggctgcaggacaagagggccctggctctggacttgaccgaagcctgacagccctcctagctgcaggatgggaatcctggctggtttgggcagattaaagtagaaacgtagaaaacattgagttaacgcaatagccaccacctatgagatgctcactttgggcccagtaccgtaccaagggctgtgcatattattatgcatattatttcatttaacccctgcaccagctccagaaactaggtgcaatcacccccattttaccgaggcaaaactgaggcccagagagcttcagtgattttcccaaatccccacagcttagacaagtacagtggagaggaagctactccacaacccaccctcttatccagggcacataacgtggaaaaatgggaccactaggtgctgctagaggacctcaggtgcagaaagaagctaagtcaggcccccaggtcctatacattgccaagcacgtgttccacaggaagcctgagccctagggccgcctgcaaagctcctgaggctgatcagtcactgaactctagacctggttgttcccccacgtccagaaatttctaacttggctccacttcaccgctcaggttcatgaaagagatgctctacttgttccttgcgataccagcattcttctgggtaaactctgttttcatcaatttcctacctaagaagtggagccgatcacagaccaactctctaagaggacgacaggtccagaatttggcctcggacaatggctgaataaggatgaagtgaagatcatacgatagacactacgtagccagcccttactctgcacctcgcatggtgcctagagctttatatgagttcattcactctattctcacatttctatgaggcaggtaccattcattatcatccccattttgctgatgaggcacagagaggtggagtaaccagcccaaggtcactcagctaagggacagatcatttgagcatcacatgcagcctaggctgcttgtttagggttcaaaccaggggtccggtccacacatgtataaccactgcaccacaatgcctgctgttaaggggagatttgttctggaagaaacctaagaggctggaaagatagaggtggctcttggactctcccagcctctgggcaggagattggtagggggcaggggtacccatttggcccaggctcagggaaaggatacaggtctcaatgttggctcccacgatgtaacccgtgacgtcgaagttgatgcggatgaatttgccctgccaacaggaaaacacagttcaggctttgctgcccaacttcagccgttaaccccatgctgtgggcaagcaggaggcagatggtacagaggatgggaggtggggcggggagattcttgcgaacactcagaaccccacaggtcaagttgtcaggcggaaccaacatctgctgagctgaaaccaccccaggcctgacagcaacagaacgtgtaaaacatgttcacagatcaatttcattcggcttttgcaatgaccgtagtccatcatggctatccctatttaaaaaaacttatttatttattagagacaaggttttgctctgtcagcgagggctggagtgcagtggtgcaatcacagctcactgtaaccttgaactcctgggctcaagcaatccccttttccccatgacctcaccctcccaagcagctaggactacaggcatgcaccaccatatctggctaatttttaaatttttttttgtagagataggatctcactgtgttgtccaggttggcctcagactgctgcactcaagcaatcctcccacctcagcctcccaaagtgctgggattacaggagtaaactaccacacccagcccactatccccattttaaagctgggaaaactaaggctaaaagagatcaagtgacttgtccaacgtgacgttgctcctgagaggtagggccctaagcagaaagaaggtttttccatattcaggggctagagggctccctccccagaccccaccctgctccaaaacatccacatcatccaactatggattaaaccttttctgtgggacaggtgagtatgcattggccacactgcccaagcaggccctgtgtaggatgtcctttaggcaggaatggctcatgttcctggccctagaggctcaacaagtatctccaaagatggccctatctacctgcctcagctaagccatgaaaccaaggatggaacccaatcctccatctgttggcatgaacccttttcctgtttcctcaacaggtgagacaggatttcatccttttcccccatcatgacataacatggtgggaagtgttggcgtgtgtggacacaatcccctaggcttgctcagtccttgacaaaaccttcaaactttccccattgggaaacatgcagtagagtgatttgggatgaccatatcccagatggagccagggagagccggctggtcacaggcaaggcccaggcaccttcttcactctccttcccaagatggcagggacgccagtgagtggaggatgtttttagggatttgtcttgcacgtgcttccatttatgacaggctagaaacattgcacagaattggaacatgcaaacgcagtgcttctcagtggaggcggcacatctgctatggagattttggaaatcggtggaagccattatttggcttgtcacatgttgggggggggccgctgttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacgcttttttttttttttttttttttttgagacaagagcctcactctgtcgcccaggttggagtgcagtggtgtgactttggctcactgcaacctccatctccccgggttcaaggaattctcccacctcagcctcccgagtagctgggaatacaggcatgtgtcactgcgcccagctaatttttgtatttttagtagagacagggtttcaccatgttagccaggctggtctcaaactcctgacctcaggtgatcttcccaactcagcctcccaaggtgctgggtttacaggtgtgagccactctgtgcctggtctagatttttatgcttttaaatgaaagcattaacaagtgtttaaaatgttgttctaatacaagaatatcccatctgtgtgactctagagaagattgttctttggttcagcgcttcactgagagtcagttgccattctggaaaatcccatgccaacatcatcagtgcctgaacttgacccttttccttgtatttgtagctgtcgccgtggatagacctaagtgtctgtctcttactgtgtcttctgttggtgtggcctggcccgagcattgatatgctgaaatgcactttatttatttatttttgtagagatggggtttccccatgttgcccaggctggtctcaaactcttgagctcaagtgatctgcccgcctcagtctcccaaagtactgggactacgggcatgagccacctcgcctggcctgaaatgcacactttcattatgaattgtcttatgttatttcttcttcatattccagttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagagacccccttctcctggaatgcagaggcaatttttccttcatcttttctcactaaaatatctttctgaccctcctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtgcctaccagagtaattgtacacagtaggtacttactaagtatttcttggaggaggtgtgtgcctggtacacagttggcactcaattcatgttttgttacataaaatggtatcggatataagggtctagcccataccaggtgctcaatacctaattttttaaattttattttaataatagagatgggatctcgctttgttgcccaggctggtctagaacccctgggctcaagtgatcctcccacctcagcctcccaaagtgctgggattacaggtgtgagccaccgcaccaggccaatcaatatttgttgagtgaatagtgaataaattaatgaatgaatgagagagtgagaggcaggagcccttgcaagattgtgagatacagcccatctctccagggtcagatgcccctcccacctctgcacgcaaacactctgcagccccaggcaggagatgacaccaaagcttttctggaaaatccatgtggctttgctacttacgaatcgtgaggagttgtcgttcttcactgttttggcgttgccgaaagcctccagaatcgggtttgcttgtagaagctgcttttccagctctccctaaaattcattcacatctagttattggagaaagcaacctaggtcctgacagttctaccttggatggatgttgtcacaaaactctgcccttaacccacaggttctctcctatctcctacctcctcttagaccctgatgctaatgttcagatttacaggaggatttcagaagagaagcaactgtctgagctctctaatagctaggacatctgctccctaggaaggtcacttttttcaagaccagggcctgctcatctgtgcaacatcactgccactcaaagccactgccttgcacaatgtcggtgatgtcatttacatcatgatgaatggtgccccccggagttgtgcagtgcaccacctgtcccactgtacatggcagtcgtgctgctgttcatgtttaacaagcagccttcttcaagttaaaccactacaagcctccttctaattattttagtgcaattttttttaagttgcaattttttctttctcaggactggttttctgaagtcttctacagcagacaagtaaggaatgcacaaaacccaccaggaatcctcttagcggactgcggaataaagcttcaaagcaggttgcctgagctccattcattgggttaaaggaagctgagactgtacacagcccaccggccccctctgccgggatgcctttgcacaaacgcggtcacgtgattaatcatggcaggaaagggccaatgtggtaagttaagctgggaaagcaaacgagctgctcttggcctagccctaaaacatggcggctgcagttgggccccgaggcctccaggccctggattctgggagtttttctccttgtcctcccctcctgctttcccttccttatttttccaggcatcagggctgggctggacaggagccgggaaagtgtctagaggggacaaggatgggcatggcttcctcctcattcctccgcatgctaggaaggcatcagggtacctggtctacaggacaaagcaggaagctgctatttgtttctgttttgatttgtccacacatcctcctttttgtagctcccagagaaagatgaagcaaaagcctcatccgcatacaaatctcagctacaagtggaatcaccacagctgagactggtggaaatttacaaggagcaccacgggcatttctttgttggtgggaagacgactaaaggaatcacttttgttcacataaacttggggtctccatgctctctgaaaaaggctccctttctagaatggggattctggcaggtaaggttgaaaagtcttggcaagagagctttaaatcgggggacctggttcaaaccctcaattttatagatgatgaaaccatagccccgaggagttaactgactcggccaaggtcacacaaaagcagatcccaaataagaactgtaattctccttctgatctgcaacacagtcacccagggtctaactaagatggattgaatgatcttttcgggagccaaggaagacacctgtgggtttcttctaggctgggacccacacatcagccccccaagctctgtgttagagatgagtttacatatgcacaggtccaagcaggaccaggttatgcgttgcgtagctggggccttaccgcgccaccaaagctagtgcatcgcgacctccaagactgtttctggaggcttgagtcaagcaaccagcatgcaagagacagacacgcactgcacacgcatgcacagggacacactggtgcaccagggacagggctgagggaagacacttagggatgatggcagggagagaagagggaggcatgccacagctgtgccatcgactgtccatcgagccagggaagctttggggcctgacagtcctaaaacactcagccagatgggacagacatctctgtctaggttgttccagtcaagggtaccaggagcggatgctttgaagggtgcaggggttcattctgaaccggagaaatccatttcaggctggagcgcaaccctggggactccaataggcgtcccgtgggtggtaaatgcacccccacacccttccctggcatcagacacccacaggatggtattttggtgcatttactgatttaagttgtgaaactctagggcctaccccatttctaccaccagctacgggactcggtgggtgcaagaggatcatgcagatctaagttcactccgtgcctcccctacacaccaggaaaacactctcagttactcacgtaggcaaaagatgggccttgctgtggttgaacaacacagtataaaacaaatgtcagcgttatttccatcacatggacatcaggggctggagaatatatgactttgatccccccaaacagcctggagtctcccagacagactggtcagctccttttccttgatactgtttcttttctctctgtttagctgcaggaatacgatcacagctcactgcagtctcaacctactgggctcaggcaatcctcctgcctcagcctcccaagtagctaagactacaggcatgcacaccaggcccagctaattctcttgatttttttttttttttttttttggtacagacagggtctcactatgtcacccaggctggtcctgaactcctgggctcagaccatcctcccaccttggcctcccaaaacacagattacaggcatgagcccccatgctcagccattccctcctttttctaatttcttagagatccagacatttcaaaggttttcataattactggggccacattaggctccttaaaacagtatccagtgagacaatgtctgagatgtgtttacgcatgcagccaaaacaagcagcacatagtaggcccttgataacgatgagttgttagaaagtattatctcctgtgtttactctttagggaaagggaaggcagtggaaactgtgtttaaactgccacacagcctctggggccattgttcccactcactatggctggaaaccaacttgccagagacaattctaggatgctgaatcttgagtttcctgcatttgtttggagaaggaaagttctccaaagccacgaccagcgcccatcctagatctccaagggcctccagacaagccggccatggtggctgccccagagtcccctctgaggacgcaaagtgacatctggaatggcgaacactggagacaccccatgccgtggtcagatctccatcctaccatcttcccacccacaaacctgcagacggaggcaccggccagtcctagcggccctaccacgtgccccctcctgtgggatagatggggcagggctgacacacgaggaggaagagaaggatgggccctagaggtgatgactctagaaacctgctcttcttttcctcccaagctcttagtcataccgtgtcatcatctgtttatttgagggattctttgacaactacatgctcttccacaggtctggaagctcagagaagagaataacagcatctctcagacttatccccaggtccccaccccaagtggttcctggcatacagtaggtgctcaatccacagttactgaatggcattgcactgaagcccacgggccgagtgataccagcatctccatcccagggacagggggacacgtggaggaatccgggaacccaaaaggtaccttaacccctgggacgttacagagattcatgaaaggagtgcttctcaatcaagggcaactgtcccaccccagggaacatctgacaatgtctagagatatttttggttgtcacaactggagggaagggggctgtcggcatctggcgggtcgaggccagggatgttgtgaaacattctacgagccacagggaagcccctccaaggaagagttatctggtccaaaatgacatcagtgccaccactgagaagccccgacgtggaggaagatctcgctatggaaggaaagggcttattctcatttcacaaaacgggcccccttctggagggatgcttctagctgagccaagaaatcacccacactcaacaggcctgctcgccaaaaagacggtccctctttgagtcttcaggggaggggtagtcagatggggcctgagttcttgcaatgatgttctgtttgtatctcggttgggctgcaagctggagaccggttggctaaatcatggcctctgattgggaactgccactcaccgtgatacttgtgtctttcttgcccttgtgggaggaggccaccacggccaggtactgaatgaccttcttggtgttttcggttttcccggctccagactcgcctctgaaagacacgggaacatcatctatgcacacgttccatggtgacctttccgcagttccatgagccaggcaggacaataatgatcatcaccaccatttcccagagggtgaaacagaggctcccagaggggaagtaacttgcccaaggccacatctctggtagtgagcggaactgggtccccagcctaggtccaatgcccaatctattccttccaagaggacatagaaaagaattcagatacaaagagtgaaaaggtgggccggatgtggtggctcatgcctgtgatcccagcacttggggaggctgaggtgggaggatcatttgagcccaggagtgtgagaccagctcagcaacacagagagacactgcctctagaaaaagatttaaaaattagccaggcatggtggcacatgcctgtagtcccagctatttgggaagttgaggcaggaggatcactcgagtccaggagttcaagaccagcctgagcaacacagcacaaccctgactctataaaaaataagaaaaattaaccaggcttggtggtgcatgcctgtagtcccagctactcaggaggctgaggtgggaggatggcttgagcccaggagtttgaggccacagtgagccatgatcacaccactgcactccagcctgggtgacagagcaagacctcatctctaaaaaaatagagtgaacaagaaaaccttagttttcttacataggtccaaacaggtttatttggaattatctacttttttttttttttttttttgagatggagtctcactctgtccccaggctggagtacagtggcacaatttcagctcactgcaagctccacctccctggttctcctgcctcagcctcccaagtagctgggactacaggcacccaccagcacactcggctaattttttgtatttttagtagagacggggtttcaccatgttagccaggatggtctcgatctcctgacctcgtgatccgcctgcagacatcattagcattgctagaaatggaaagaccaggcacaaggcagccttcaagaaaggatgtaagtgcctctggagtaccaggacctaaagtttaagaagctcccttatggaaagaaaaatttaccaaaaaaccggttatcccattggtcactgggcagatgcaagcccctttatcctctgaggaatcccaccccatgtatcaggaagctggctgatgatctcagccaagtatctaagaataaacccagttgaagtaattcacactaaagtgtaaatgactgatatgtttagatcagcacgacatggtttgtcgtatcaaaaaagtatgtcctcctggaatatgaaggtagatcttttttttttttttttttaccaagatggctttcgtgcactagctgcctgttttggccaccagaaatcatcacaatggaaccgctccatccagatactgcctctatgttccaccactcctagtgaaagataaggacagtgccttgaccaaaacttcacttgtttatcgtcttcttctatttttcagtttacttttgttttttgtgtttcctttctttgccttatctcttttattttctgagctcacttaatactctaaaatataagagagttttttttttaagttgaaaaaagaatttgttcaccccgaggtcagcccaaggttctctgtgctgaaccagtgccaccaaagctagtacagtctctgctcttcttcctaattaggaaataaagaaattaattttctctgccaaaggcccattaataacttggctcatggcttaaaaaagaaatagaagaaaagaaaaaagaaagagaaagaaaaaaaaagtgccccaaattgctgtgcctaatcctacaggtcccactgtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatatgtgtgtgtgtgtgtgtgtgtgtgtgtgtgtgtgtgtgtgtgtaaaagaggagaactggccaggtgcagcagagaactggccacgtttataatagcagctactcaggaggctgagttgggaggatgccttgaggccaggagtttgagagaagcctgggcaacatagcaagatcccatctcttaagacagagaagaattggcgtttgtcattggggggatatagggggaagggtccctttgctaaatgctctacatgaattatttcctttatcctcttcctgcttccatgttattatagaaggaagagtcttgcccagagtgggtaagcaattttccctaggtcacacagcaaagaagggatacagtcagaatggaaagtcaggtctctgattctaatgcagtcagaattccttttactacatttcaccaagttgttccatgacacaggcccaaccctctagggacttgctttctaaggccagaagaagggcaggggaaggggaattgatatttgttgaaggcctgcacagtactaggctttgggctcacagatcttttcatttactctacccagcaatctaatgagagagttattaattatccccatcacccatccggggaaactgaggcaaagagaggtttgaagtaaattgctccagcccacaattgctcctgctttcacacagataggaaatggaggagaagcaggatttgaacgtaggtccacttgacaccagggcccatgttctgcctcctacccttttattttaacaaatcagcaaagagaaaagacagagtgaagtcccagccccactccactggaattctgccatatattccaggaggctttacttgccccaatcaatgaaccaagccactcagtcattcacacctaagtatgaattacttcaatcaggctaacgtcagaaccttgcttgacttcattctaaagtgaaggggttggattctgattaaagcaagagaaaggagagaaatttttggatgtaggaaaccacttgcgtaggtggtcatgaacctattcagatccaagacaagaatcaggacagcagtgtgcacaaacaacatgtgtggatcacactcttcatgctgacaaaccagtgctcctagactgctgctgctcacttctcctttcccacaatagttccttcctttccaccctggccttgaacctctctcacctcctcccttttacaacaaagacatcaccgggtgtggtggctcacgcctgtcatcccggtactttgggaggctgaggcgggtggatcacttgaggtcaggagttcaagaccagcctggccaacatggtgaaaccctgtctctactaaaaatacaaaaagtagctgggcatggtggtgggtgcctgtagtcccagctacttggggagctgaggcaggagaatcccttgaacccaggaggcggagattacagtgagctgagctcgtgccactgcactccagcctgggcaatagaatgagactccatctcaaaaaacaaacaaacaaacaaacaaacagacagacaaaaaaaaaaacaaagacatcaatgtgccctatccgtggctatggtctcccactttgcctgggatggggagtgggacataaactctgggcatctaccccttcccatgttgctgctgggctccactgtttccaagttctgttgagaaaaataaattgccctgggaggttctgccaaagaaaacatcccaagctccaggctcgtgggcgtctgaaggttgatgtgcttagagctggttctagaaacattcatagcttggcttttctgacccctgacctctaggggtgaagatgccttcctggtctgagcaccctaaactcctttcttatttcttggggaatttggtactgagctccctcttcccggagaaggaccagactcatgaccacgttatggcctcctggccttgtaactaccccagtgccaagtccttttaatcagtccagccccagcagctgggaagaaccacccaatggccacttaatcccccagccaggctggcttcatgagtgtgacctgtaccgtctcacagggaccaccctgtgcttcatactctaatgttgccatctggaaattcttcctaattctttataaacgctctgcattttttttcttttctttttttttttttttttttgagactgactcttgctctattgcccaggctggagtgcagtgtgtgatggcggctcactgcaacctctacctcccaggttcaagtgattctcctgcctcaacctcccaagtagctggaactacaggtgcccgccactatgcctgggtaatttttatatttttagtagagatgggatttcaccatgttggcgaggctggcctcgaactcctgacctcatgtgatctgcccgcctcagcctcccaaagtgctgggattccaggtgtgagtcactgcactcagccagcattttcattttgcaaaattctacaaattctgcagctggtcctggctcccagggtcgaatattgccaagtccattgcagcctgtggtttgccactggtaggaaagccaaattgtctctgatgaacctcacagctattcagtccctggtctttatgtgactggcaaagcaccctggcattttgtactgtacaactcctacacgtcctgcaaaaccccaggcagaagcaacgcctctctcccctatagcatcaattggcagaatagcataatgggctccaggaccaggttgctcaagttcaaatccctcctctgccagttacctgggtgaccttaggcaagtcatttagcctctccatacctcagtttctttaccccattataaaatgggtataataaaaacacttaccttgtatgatttttttttttttttttttgagacaagatctcactctgtggcccaggctggagtgcagtgatgcaatcatagctcactgcagctgagaattcctaggctcaagtgatactcctgccccaatctcccaggtagctgggactacaggtgcacaccaccacagctggctgatttttaaattttctgtagagacaggggtctcgctatgttgctcaagctggtctcgaactcctggtctcaagtgatctctagcctcagcctcccaaagtgctgggactacaggcatgagccaccatgcctgaccttttatatgattcttatgaggattaaatgagtgaacatttatataaaatgcttagaacaatgcctggtatgccaaaatgttagttattattacttttgttttttgagacagagttttgcttcttgctcaggccggagtgcagtggcacaatcttgactcactgcaatctcgaactcctgggttcaagtgaccctcccacctcagcctcctgagtagctgggatgacaggcatgtgccactacacctagctaattttttgattttgtggggtctcgctaagttgcccaggatagtcttgaactccaggcctcaggcaatcctcctgcctcggccccctaaagtgttgggattacaggtgtgagccactgtgcccacctattattacttttataaccactgcttccacagaagttatatattgtttgtataatgattttcagcattcatcctatcattacaatataaataatattcacattttcccactgtttaagctaggagttagcaaactctttttgtaaaaggtcagacagtaaatattttagactttgagggtcacgcattctttgtcacatctgctcagctctccactgcagcacaaaagcaaatacgtaaacaagtgggtgcggctgtgtttcaataaaactttatctggaacagacagacaagggcctgatttgacccactggttaaactttgtccttccttggcttgagtcccttagcacgttctcatccatttcatttatttattttattgttatatatattttttgagatggggtctcactgtgtcacccaggctgaagtgcagtggtgcagtcttggctcagtgccaactttctgcctcccaggctcagtgaaccgagatcctcctgcctcatcctcctaagtagctgggactacaggcacatgccatcacgctcagctaatttttgtttttgtagagagggggtttggccatgttggccaggctggtcttgaactcctgagctcaagcgatcagcctgccttggcctcccgaagtgctaggattacaggcatgagccaccatgcccagcctgtcatccattttagacgaaagtttaaactcctccccagggcctggaagcacccccttacctctctctaattttatgtgaaaccaccctcctcctcttactttagccccctgatcacacagctctatctccagccaggcccatggcctctaattaaactgattatactggatggattacatgctagacaaaatacaactcaggcctaaaaattacatttattcagctttcagtttccttcctttcttgtcttccttcccttcctttccttccttcctgtctctgggtcttgctctgttgcccaggctgaggtgcagtggtgccatcatagctcacttagcctctaactcccaagctcaagtgatcctccctccccaacctcctgagtagctgggactacaggcatgcaccatcccacctagctaatttttaaattttttgtagtaatggggtcttactgtgttcctcagtttggtctcaaacttctggcttccagccaccctcccgcctcggcctctcaaggccctgagtttccaggcataagccaccacacccagccaattttcagtttcttttcttttcttttttttttttttttttttttgagacagagtctcgctctgtcacccaggctggagtgcactggcgtgatctcagctcactgcaagctccgccccccaggttcacgccattctcctgcctcagcctcctgaatagctgggactacaggcacccgccaccatgcccggctaatttttttgtattttttttagtagagatggggtttcaccgtgttagccaggatggtctcgaactcctgacctcgtgatccacccgcctcggcctcccaaagtgctgggattacaggcgtgagccacggtgcgtggccaattttcagtttcttttcttttcttttttttttttttttgagacagagtctcgctctgtcacccaggctggagtgcagtggtgcgatctctgctaactgcaagccccgccccccaggttcacaccattctcctgcctcagcctcctgaatagctgggactacaggcacccgccaccatgcccagctaatttttttgtatttttttagtagagatggggtttcaccgtgttagccaggatggtctcgaactcctgacctcgtgatccgcccgcctcggcctcccaaagtgctgggattacaggcctgagccacagtgcgcggccaattttcagtttcttaactgcataaccaaacagttggctccagcctggcttctcttaagcaccaactacgcgtaaaagctcagccctgctgtcaacttgtaggtccttcaagtcactttggctgaatttcacaacaagcaaaataaaattgaatacagagactgaagatgttggtggttctgggctgactggatgcatttgcaaataaaagtctgatcgttttgggatttccttcctaacaatggctaaggcctccttctccagcactggctgtgtgtgggcagtgtgccaagtccttgctaacgctgcattccaggagatggagatacacaatagccaagtaaacaaataatcaagatagttcgtggtggagatatcattgctacatctgggtgatgtgactgagaagatcgaggggaagggaggagaggggaggctgtggatggggaagccagggagttgctgagccttgaaagttacaagagagccctgtgggaaggatggagggaagggtgggccaggcagggcaaacagtatggacagaggtccaagggagggaaatgctgggcccaggtatgagacagaatggctcccagcatggctggagggccacaacagaggaggacagcaggaagtgaagagggaagagcagatcacactcagtcttccaagtcacagtaaggaatctgagttttattctcatgggtgcaggaaaccatttcacgaggggaacgggactttagaaccagtgtggggagaatcagaactgcaggatgggctgggcgaagtggctcatgcctgtaatcccagcactttgggaggctgactgaggtgggtggatcacctgagatcaggagtttgagaccaggctggccaacatggagaaaacccatctctattaacaatacaaaaattagctgggcatgatggcataatactcgggaagctgaggcaggagaattgcttgaacccaggaggcgggggttgcagtgagccaagatcgcaccactgcactccagcctgggcaacagagtgagactctgtctcaacaaaaaaatcaacaacaacaacaaactgcaggatgggccaggctcagcggctcatgcctgtaatcccagcacttgggaggccgaggctccccgggtcacctgaggtcaggagttcgagaccagcctgaccaacatgacaaaaccctgtctctactaaaaatacaaaattagccaggcatggtggtacatgcctgttatcccagctactcgggaggctgaggcaggagaatcacttgaacctgggaggtggaggttgctgtgagccaagatcacgccattgcactctagcctgggcaatgagagcaaaactccatctcaaaaacaaacaaacaaacaaacaaacaaactgcaagatggatactggattgcaggaaggatttttaaaaaatagtgagcactttcactacaatagcagctgatccttacaaagtgctcaccatggggcagtggcctgtttctcagttcttcacatgtagtgactcatttcatccttccaacaacccaatggggtgcttattgttcccattttacagatggggaaactgaggctcagagaagtgaactgacttatttcctggagcatacaactaactagacgatgatggggccagaattcaaacccaaggggttaggttctggaatccacactttatgacagcatgctaatgaatatttattcaatgaataatgagtgaatattcttataatgtatatttattaaaggaaggaagcaagcaagcaatgggagcagggagcttaagagactgctacagaggccctggtgagaggtgacgggaccctgaactaggaagaggcggtggagtcagaggaatggacagagatgagaaatatttcagcatcataccgtccaaggcaggaaccgctatctaaattaactaaaatcttaaaaattcagttctgcaatatacttgccactttttaagagctcaattaagtgaacttttaagtgaactttgtgctcatcacaaagttcttttggatagcaccgttttagatgaaacagcacctgctgatggcatgggtgctggaaatgagagcagggtggcctcttcttcatcttcacagcctctccataagctcagctcagagaggtcaagtgacccgtgcatagctacatagctaggaagccatctgaaagtcctactctttcctgcacctctctgttaccacacttaattcattcactcaacagagggcagttgagctacactattttggttcctggggagatgacatgtggctcacacatgggtttggctcctaggggatcaaatgcctctgtggctagctgaaaaacagcccccacaagaatgtccatggcctatcctcagaatctgtgaatatgtttgcttgagatgaggagactgtcttggatcatctaggtggggctaatataaccacaaaggtactgggccttataagagagaggtagggggaccagagaaagagatttgaagataccatgctgcaggatttaaagatggaggaagagaccatgagccaaggaatgcaggtgacccctagaagccagaaaactaggaaaccaagtcggcaggttgttttagcatttatatcctcatagctaggtagcattatatctctagatccagactattcattgtcaaacatcaaatgtgtacatcctaccatggaatatgagaattcagttcccatctaatcctcttccctttccccacagagccaagtccatcacagggagttattctggttagataaatactccaaacttgcacagctgggctccttagtccaatgtgattacttctccttccatcccaacttttgttttttcctggagtttataattgcctttgttttattgtttccaggttttctatctatatcaaccccaaacttattaattgtttcaatcttctctcaatacagttcattgccatcctaccatccatcaccatctgaaattctaattactagtttttaattgtccttccagataatttcatgcaaataggaaacatatgcacgtccatgcaatcctgctctttttaaagacacacacggttacattatgcatatgctggtttgcccctgtgttttccactcaacggtattatctataaagagcgttctctctcagcataaatagatcagcctcactctttgtagtggctacctggaaatgctatattttatttaaataacctctgttgattatagctttagttgcttccagaccttcaaatatatatatatataaatataaatatattaaatataatacatattatatattatgtaaatatatatatgcacagtctatcctcattatttatatattctatattttcaaattcaccgacctgctgaaagttatttgtaaccccaaaatcaatattcatggcacttttgtagtcatttgtgaacatgtgcagagtaaggaaaattcgattcccccaatgcacacgttcccagctcaggttgaacaggggaatgctctaccttctagtttcaactctcatactgtaaacaagtgtcctttctgtagtgtatttagtgccacctttttttgtatttttgtggctttttgttagttattttgcagtttaaaatgtcccctcagatgtgctcccttcggcagcacacatacaaaaatgtccccagcatagtgctcaagtgttggctcatgtttccaagcacaataaagttgtgatacccattatgtaataaatacacatcagataaacttcatccaggcatcagccacagagctgctggctgtgagttcaatgtcaatgaatcaacaatatatattaatatatgttacttgcatataaatacaatagtgaaaactctctcaatgattctaaaattgagttactatcttctgcctatgtacctaggtcttcaaagaaacagtgataccaatcaccaaatatggcactgatgtgtttgtggcttgataaatgtgaaatactaaagtgacagtttaacatcttccctatcaacacagatggctgttatgcaattagataagattctgcatataaaatctttagttcaagtcctggcacagagtacatgttcaataaatgctagttttttagaaggaggagaggtatggaaccaaatgatagcaggtgtcattaagagtttaagtttgcctgcctccgcagaagaccatatatcacaaatgtttagtgagcatctacatggtgccaggtataaagagaggcacttggaaccatgaacaaatcaaagatctctgcactcatggatcttttctttcataggttggatctcgactacagattaaaaaaaaaaaaaaacaaaaaaaaaacagaagaaaaagcagttccacttacgtgcatagaatggactggtcctcccgatctgcaaacagaaagaagaaaaaagagccatgaattaaaatgagctctgagctaagggtctggacttggctcctcccagggccctcccattctaaagcttctccatgctggcctcattggaagtgacaacaggtcagctgggctcattgcccaggctacaggggccacgaccaaagccaaaagggcagccccaaagtcccagaggcagccccagaaagatgctggagcctgactgatccaggagtcattagcatccagccacatcagctctggaggtgtcccgggaggcccaccccacccagattaggttagggaccaaacgcagatgttggatctatacagattggggtcccccttagccacttctccgctctgtggccttgggcaaatattcttaaactccatgcctcagttccttcatctgtaatatagtattgtgcacatttgtgtttttttgtaaatccagcatccatttcctcttcttccagaagcatcctgtggtccttgaggtttcccccatcacccctaccgtcatgtacagtcttagtgggactgcctcataagtaccttcaacaaagaggtaagaatgtgttccaggctgcattggtcagactctctggcctaaaactccaagctcagtcaaggacagggaagcacagcaggtggacagagccctgaggcagacttcctttctgcccctgggcccaagcagcccagtttctgtcatttacctagcctgattcctagtgttcccactgcaactgtgagctcctccatactcccctacaaatccctttcctctactagatgacagagtcagtctctcttgtttaccaccagagaaacccaaaagatacagaggtcatcaaagaactagatgtgattaagcagacattatccatcaccttctactcttaaagaggcctctgaggtggagccaggctctgaagacccatttccttcccaaagagagatctgagaacagttaccaatacgttcaatggtcacctaacaatgtagaaatcccagcatcatatctgctggtagacaatgccacagtggcaagcatttcttaaatccactccctggcttcagtcctactagttcagtgctcagctctcacaagcttcatttcatcaaaaatctcctaggcttggttttacattgtatctctagtactggcacatagatggtaggtgctgaattatgcttgttagatggatggattgagggatggatgagtagatggatgggaagatgagtggacggaaggaaggaagaaaggaaggaagggtagatgggtgaatggaagggtgggtagatgggtaggtagatggatgggtgggtgggtggatgaatagacagatggacgggagggtggataagcagatgagtaggtgagtaggtgggtgggtggatgggcagatgggtgggaaaatggatggatagatgagtagatggatgggaggatggaagaagaggtggatgggcaagtgagtggaaggaaggaagaaaggaaagaaggaaggaagaaaggatgggtggatggaagaatggatggataggtaaatggacgggaggataaatggatgggaggctgggtgaataggcagacagatggctggatggaaggatggatagatggacaggtagagagacaggaagacaaatggatgagtgggtgggtgggtaggtggacgaatagatggatggaaagaaggaaggatggatggatagataggaagaaagaaagaagaaaggagggaagggtgtgtagatgggtagatgggtgggtatatagctggttggacggatggttggacggaggagggaaggatgagtgagtggatgagagagtggatgggtgggtgaatgggagggaggacagagtgtataggccggtaaatgagttggatggatggatggatggatggatggatggatggatggatggatgggaatatgaatgggaggatggatgggactgaagaaggcaaggtgaaagagatgactctttcttccatctgtaatcttaagagagaactgattggatgtgggcacgttcctcagattctatgcccaactccaatcagttctctctctcttccctcggattatagatggatgtttgggtggcctggttgaacgaaatcctcaagacaaaaggcctaaagactagtcagctctggggtttcaattctggtgtgtttatataatggcacatttaaaaataggcaggccgggcgcagtggctcatgcctgtaatctcaccactttgggaggccaaggagggtggatcacttgagttcaggagttccagaccagcctggctaacatggtgaaaccccatctccactaaaaatacaaaaattagttgggtgtcatggcacacgcttgtaatcccagctactcagaaggctgaggcaggaaaattgcttgaactcaggaggcggacgttgcagtgagccgagatcgtgccactgcatgccaggctgggcaacagagcaagactctgtttcaaaaacaaataagatataaatacataaataaaataggcagccattgaaaagaaccaggcagagctttgtggatggacacagaaaaatatccaaaatatattaagctaaaaataaaagatgaggtagcatagtgttataccttttgtgttttaaaaagacagatatataggtaggatgcagtggttcatgcctgtaatctcaacactttgggaggctgagatgggaggatcacttgaggccaggagttccagaccagcctggacaacatagcaagacccagtctctacaaaaaaaaatttttttttaattagctatgtgtgatagacataccccttgtcccagctacttgggaggctgagacagtaggatcccttgagccaaggagttcaaggttgcagtgagctgtgattacaccactgcactccagcctgggcaatggagtgagaccctatctctaaaaacagacctgggatgggtgcggtggctcacacttgtaatcccagcacttcggaaggctgaggcgggcagatcacttgaggtcaggagttcaagaccagcctggccaacatggtgaaacgctgtctctactaaaaatacaaaaattagctgggcatggtagcatgcacctgtaatccaaggtactccggaggctgaggcaggagaatcacttcaacccaggaggtggaggttgcagtgaggtgagatcatgccactacactccagcctgggcaacagagcgagactccaaaaacaaaacaaaacaaacaaaaaaaaccaacaaacaggcctgagcctgaagtattgagaaaagggacaggaggaagacctactttcacccattctacttctatcctggttatgtttgtgctatgaacacatacaatcttttcctcatcccaccaaaaatggtcaatagaaaaagagtcggtattgttctttatgaaaccatcatgaccacaaagctaaaaaaagacagaaaagaaagagccaccgcattaggatcccactaacagctccgatctcccgagcactcactgcactgcaggcgtatgctgaacttctgtgttgaagtgacccactgaattctctcagcagctcctggggtgggcactggcattgcctccattttacaaataaggagagtgaggttcagaagtgaggcaacttgcccaaggtcactagggtgggttgaactgtgactcccaaaagctatgttcactcagaacctcagactgcgatgttattgactaaccaattgattgagatggggtctcactttgtcgcccaggtgggtgtacagtggcgtgatctcagctcactgcaacctcaacctcccaggctcaagcaatcctccctcttcggcctcccctgtagctgggactataggcacatgccagcatgcccggctaatttttgtattttttgtagagattgggtcttgctatgttgcccaggctggtttcacactcttgggctcaagtgacccacctgcctcagcctcccaaagtgctgggattacaggcgtgagccactgtatcccacctgtgattttatttagaataagggtcttgcagatgtaattaagggaaggatgttgagatgaggtcatcctggcttggagtgagacctaaatcaatggtgtccctatttataagagaaaggaggccgggcgtggtggctcacacctgtaatcccagcacgtgggtggatcacctgaggtcaggagttcgagaccagcctgggcaacatggtgaaacccatctctactaaaaatacaaaaaattagccaggcatggcggcaggcacctgtagtcccagctactcgggaggctaaggcaggagaatcacttgaacccaggaggtggaggttgcagtgagttgagattttgccactgcactccagcctgggcaacagagcaagaccccatctcaaagaaaaaaaaagcaggaaaaaagcaatcaaactttaatctctccattatactctggagacagacagatacccgtgcctttagcttccacccagggggagaaattcactcgaggacagagcaaaatgggaaaccagtttaattttttttttttttctgaaatggagtctcgctctgtcacccaggctggagtgcagtggctcgatcttggctcactgcaacctctgcctcctggtttcaagcaattcttccacctcggccccccgagtagctgggactacaggtgcgtgccaccacgcctggctaatttttctattttttgtagagacggggtttcaccatgttggccaggctggtctcgaactcctgacctcaggtgatccgcccgcctcagcctcccaaagtactaaaaagtgattttttaaaagagggtgaaggatagaagaaccaggtaccctgtgattagaacccagacagagagaacctcctgggaccggcccagacaacctccactatcttaaggaaagattttgagatggacagacagatgggctgtgttgatccactacttcagggagagaggcaggctttcctggcagccttgtgaatcctaggcccagagcaggagagatttataggctcagatgctcacagggcccccaggagagggagcgggctccaggagaaggcctgggagctgccagcgcggctccgagctgggggctgctgggagacctctggcctgacgttcccatcaaaaacacaccacttccaggcgtgggaagcttgcagggtgctggttacgagcagaaggactccatgtgggtgctgtctgccaacccgtgtggagcacagggaactctgagatcctggaaatttttatctgattccttccccaagcctgagcttgtgttggactcaaaagcagtgttctccaccgtacaaagcagtttcactccctccttgctttgcacaagtgatttcttctgcccagtgcacccaccaccacttcttctctggcctaatccattctctctctctctctcttttttccttccattgaggtaaaatttacactacataaaaagaaccattttaaagtgaataattcaagccaggtgcggtggcttatgcctgtaatcccagcactttgggaggccgacacagctggatctcctaaagtcgggagtttgagaccaacacggcaaaaccccgtctctaccaaaaatacaaaaattagctgggcgcggtggtgcacacctgtaatcccagctactcaggaggctgaggcaggagaatcgcgtgaaccagggaggtggagtttgcagtgagctgagatcgcgccactgcactccagcctgggtgacagagggagactccatctcaaaaaatagtaataaagataaaaaaataactaaagtgcataattcaggagcatttagtacattcacaatgttacgtaactaccacctttatctagttctaaaatattctgtcacccccaaatgaaaccctctacccgttaagcagccactcccccataagcccttgcaaccgccaatttgctttctgtctctatggtcttacctattctagatatttttgcataaatggaattataacatgtgcggcctttcatgtctgacttctttcactcagcatgtggctgaagttcatccatgttgtagcaggtcccagactttatgcctatttgtggctgagtcatatcacattgtacggatggatcatattttgtttatccattcaacagttgacggacatttgggttatttccaccttttggctattctgcatagtgctgctatgaacattcctgtacaagttttagtttgagtaccttttcaattcttcgggtacataccctaatctgtatctgaaacatcgtcttgggagtcaactcttctatgataccttctctaactctgcacttttctagagctgagttggagacctttccacttgacctcctacctgcaggatggccatggaccgtggtgcatgttgtacactgcataactctatggagaaactatttgcattggtcatttattgtattgcattgtgtatttattgtaataatctttcagcagatggaggaaaagtgctttgagaaaacggtgcctttctctaatataaacatgagtgtcacatggcctagtggttcccatggtccacaggttctctccattttagtaattatcatcattgtgatccttacttaataaatgtctcaaaacattctggcggaaaaaggtacagatgatatggaatgataataggccatctatccatgatatggcattcagagtttttcttgtttttcttttccatattggtaaaaattatggactttattcataatatccaaaaaatagaaacaaccaaatgttcatcaatgggtagatggataaacaaaatgtggtctacccagacagtgggatagtattcagccatgaaaagaaaggatgttatggccggcggccatggctcatgcctgaaattccagcactttgggaagctgaggcaggtggattgcttgagcccgggagtccgaaaccagcctgggcaacatggtgaaaccctatctctacaaaaaaaaatgcaaacattagctgggcatagtggcacaatccctgtggtctcagctactcaagaggctgaggtgggacaatggcttgagcccaggaggtggaggttgtagtaagccacgactgcaccacggtactccagctggggtgacagagacagaccctgtcttaaaaaatatataaatagtatgaatccatgatacaacgtggatgaaccttgacaacattatactaagtgaaagaagctagccggctgggcacggtggctcacacctgtaatcccagcactttgggaggctgaggtgggcagatcacgaggtcaggagttcaagaccagcctggccaatacagtgaaaccccgtctctactaaaaatacaaaaattagccaggtgtggtggcacgtgcctatagtcccagctactcgggaggctgaggcaggagaatcacttgaacccaggaggcagagtttgtggtgagccgagaccacatcactgcactccagcccgggcgagtgcagtgagacactctgtctcaaaaaaaaaaaaaaaaaaaaaaaaaaaaaaaaaaaagaagccagccacaaaaggtcacatatgattccatttatatgaaatgtccagaataggcaaatccatagagacagaaagtagatttgtgaattcgtggctgccaggagctgcgggtaggaatatggagtgacaaaaaaatgtgcacaagatttctttgggggatgatagaaatataaaattatattgcagcaatggctgcataaccatgtaaattatgagtgaatttagacagttatgcagacatagctgcaattttaggtgtgaactgtatccttaaaatgaatttatttaaattataccgcataaaccttttttaaaaatgatgttcattttataccacctctgaatgattataaatctgacttcttccacttcatgcagctctattaggtttccaacaattacaaaattgttcattttcaatgcttttcccctgaaccaatgagctcctgaaggtacaaggaacaatgcctgacacacagtaggtgctcaggaaatgcttgttattttgaattgctctctggctcagagaggcaaccaaggtagaagcaatggaaaatgcatattcacgtgttcacatattcattcaacaaacgagtcctgagccaggtaccgaaagcacaaaagtcaataagatctgcttttttttttcttttcttttttaagagatgaggtgtcactctgatgcccaggctgaagtgcagtagcacgatcatagctaactgcagtctggaactcctgggctaacagatccttccatctcagcctcctgagcagctgggactacaggtgcatgccactacgcctggctaatggtttttttgttttttgttttcattttttttgtagagacagggcctagtaaggtaacttagtaatattacccaggctggtcccaaactcctggcctcaagtgatcctcccgccttggcctcccaagtaactgaaatcacaggctcaagccaatgcaccgagcttcatgacttgcttatccttgcttttgagaagttcatgacccagggtgggagtcagatgggcaaagaaatgaccgtaagagatgagcagtgctacgatggatgtgaacccaagtgctatagacgtcaggttttttgtttgtttgttttttcacactgacctgagcaagacaggaagccttcacggcagaggtgaccactgaacagcattaagaaaaatgtgaaagaatctcctggggagaggtcgaggcagagcatcccaagcagagggcctgggacagaagctccaaagtgggcggggacacagtaccgagcctccgtggagtctgggaaggctggagctgggggcggccggccatcatcaggacccgcctggggctgagcttcccagcccagatccctggggctcatgtcacctcacaccccatccttaaacatgcctctctcccttcctcctccccagactccccacccagcctcggatgtgtaaggccccaggcacgtttcctgagaagataaagggcttcagcggttcctcccccgctgtgggcctgaggactcccaggaggtacccagctccccacagaccagctatttcggcccaagcccaaacacaagctggtggattctgtctgggaagccagagcactgtaggctgaccataaaaggagaaaacccagcggggactgagcacagacccaggctccctgcgtctgcccttctttctggtaacaggctgctgggggatccagtgagaggtaatcaaaacccgtctctgcagggccatcaatacccctgggctagtaaagaagaaaggtctcagcctccattgcctgcagaaaagtggctctctacctaatgccccgcacggaggcagatgccagaggttctggatcttctgtggtgtgactgtgaaggtggccactgcatggcccttgacggtgggtcctcggcagctgactgctaatgcctgttgaacttgtcctgtccatgcaccgtgtccctacacactgaccgaatcacccttgtaacaactggagtaagcacagtcatcatcctcacgggacaagtgaggaaactgaggcacaaagtaatagccggggcagagctgggaggtgaacccagctccagagcccatgacctaagccattctgtaagtgagggcccttctctttctccagccttcatctccccactctactctcccggcagagttggttaggatgacatgctgagtaagaagagatactttgagagcctttgctgcaacccaacaggtgttttccaaacctacaggaagccctggtattgtaaaagcagaactgggctgggcataggagctcatgcctgtaatcccagtgctttgggaggctgaggcagaaggattgcttgaggcgaggagtttgagactcaaagcgagacccctatctctatgaaaaaaaaattttttttaattagctgtggacagaggtgtgtgcctgtagccccagctatttggaaggctgaggcaggaaaattgcttgagcctaggagttcgaggttacagggagctattattgtgccactgcgctctagcttgggtgaaagagtgaaactctgtctcaaaaaatatataataaataaaaacatgaaagcagaactggccagtgaaggggtgtaggagacaggaaaaccaacgctctccctcttgggcctccactcctacctcctacattctcccccttctctctgctccagccccagcagcctcatagaacctatatcaagttccctagccaagcctacacttcaccttccaaggaagcctcccctgtcctcccaaggtccccagggctacacttccccactctctggacctcctctacttagcagctacttgtgggatgattcaattcgtatttacacatacgcacagtaggctgtgtctagggcaacatctaataatcaatattgttagaatgaccgggcgtggtggatcacatctgtaattccagcactttgggagaccgaggcgggaggattgcttgaggccaggagttcgagaccagcctgggcaacataatgagacctcatctctacaaaaaatcaaaaaattagccaggcgtgatgatctgtgcctgtggtcccagctacttgggaggctgagaggggaggatcacttgagcccaggagttggaggctggagtgagctatgagtgtgccactccactccagcctgggcaacagggcaaggccttgtctcacaaaaaaatgctgttggataaagaaaggaatggggagccagactgcccagaggctgggaggacaccgagggaggtggctgacacatgcaatttaacaaggaaggtgctggccaggcactgtgggtcacgcctataatcccagcactttgggaggccgaggtaggtggattgcttgggctcaggagttcaaggccagcctgaacaacatagcaaaacctcatctctacaaaaaatacaaaaattagccagttgtactggtgcatgcctgtatgcagctactctggaggctgaggtgggaggatcacctgagcctggagaggctgaggctcaggtgagccgagatcacaccactacactccagcctgggcaacagagtgagactctgtctcaaaaaagcccaaaacaaacaaggaaggtgttgccaagtgtcagctggggcttttcaggttcactcccttaagtatgtccctttttcaatttaatatttacggtttttgtttttgtttttgtttttttttgagacggagttttgctcttgttgcccaggctggagtgcagtggggcaatctcggctcactgcaacctctacctcccaggttcaagcgattctcctgcctcagcctcccgagtagctgggattatagtcgcccaccaccatgcctggctaattttttgtatttttagtagagatggggtttcactacattggccaggctggtctcgaactcctgacctcagatgatctgcctgcctctgcctcccaaagtgctgagattacaggtgtgaaccactgtgcctggccaatatttactattttataacaaataattctcctttgctgtctcccttccctgtaatgcaccatgggtaccaaaaataaaaataaaataaagataaaaacgtgaacttttcatgattagtcagagcaccaaacagacactcctagcacctctgtaaagactgagccagccagacagagccattcattcccacacacagtcccccatcattcccaaccgggccagacacatagctgacagccactgcaaaacccacaagagacagagaagcatttggctgtaccccttcctggagatgtgtttgtagcagcactgcctctgcagagaaacagctgggaattacttcttggctccaccctatcacctctgcccccagggcccgtttcctcaccagggaaatcgacaaaaatccagacctttcaagggcatgaagatgattgaaagagactggattcagaaagagcttaaaattgttttacccacagcacatttaagagcttggtaattgccgttaatatcatctttatcatcatcatctaaaacagtgatctagggaagaggttatagacagcagtgattctgaatcggcaggacaggatattcaaccaaagatatttaacccctttctgattacaaggtgtcatggtctgaatgctcatgtctccctcaaattcatatgctggaatccttacccctaaagtgatgatattaggaggtggggcctttgggaggtgatgagatcatgggggttcaatcctcattgggggagagacccagagagctagcaggtcccttccaccatgtgagacacagcgagaaggcagcactaggccctcaccagataccaagcttgatcttggacttcccagcctccagaaccacgagaaacaaatatctgtttaaaagccacccagtctatggtattttgatatagcagccttaacaggctaagacacaaggcctatgctagtcccttagccttctgggggcctcagtttcctcttccgttatatggggacaagaatactacactatctataccacgctacccaggagggaagagtaacattctgagggcagcgaagctgggtccccaggtttgactctcagttctggggccaagtaggtgtgctgagttttccccattgatcaaatggggaggctgccacccaccctgtgtggtgctagtgagggccgagcaatgtgggattgatggagcagtgaacccaggtcctgacctattgcaggggccctgaggacatcagtgcccttcctctctctgcctctactggggagcagcctcaggggagttgggtgagcaggaaccatccccagggggctgccaatctcaagcagaaggatacagccgagtgtgggaacttgcaaagtggagaaagtcgtttggatcactccacccgcagagttgtcttaagcttaaagaggaattagccaagagccccaagctgataaaggctggctgttatttctttttttaatcccctgagtgtggccatttgttgctaatgaggtgaggacaaaacattacttgtggctatcttgcatagggcaagtgcagaggctcagaatggaatcttatctgctttcctgcccctcctacaccccagggacccatggaggggctccaaagtggttcttgtctggagggctttaatggcgcttttctcctattcatcacgttcatttattgaacttagctccagcctcctaagctttgagctgtcaacactctgagatgaagacagtagacagccttccgtgggattgagggggatccctgtggttgcccggtgtcaccgactgaccagcagggctccggctttggagtcaggataatccaagtgtatatttggctctgacacttaacaaatctgcagcaagttctccactcctctgagtctgttttcccagctgtaaaagggagctaataatagctcttgcggctagcgttggatcacccaataaaccttgtaagcatatgctgagggcacacccacacaggcatgcacgagaaggaagaatgccatagttgccatttcataagcaccacgaagataaacatcatgggaaaaatagcaactttaggctgggcacggtggctcatacccataatcccagcactttgggaggtcaaggcaggaggatcacttgaggccaggaatgagagaccagcctgggcaacacagtaagatcttatctctaaaaaaaaaaaaaaaaaaaaaaaaaaaaaaagttttttcactaggcacagtgggctcacacctgtaatcccagcactttgagaagcctaggcaggtggatcacttgagctcaggagttcaagaccagcctgggcaacatggtgaaatcccgtctccacaaaaaatacaaaaattagccgggtgtggtggtgcatggctgcagtcccagctacttggggagctgaggtgagaagatcactggagcctaggaggtcaagcctgcagtgagccgtgtttgtgccactgcactctagcctgggtgacaaagtgagaacctgtctcaaaaataaaaaagactgggcacggtggctcatgcctgtaatcccagcactttggaaggccaaggtgggtggatcacctgaggtcaggagttcaagaccagtctggtcaacacggtgaaacaccatctctactaaaagtacaaaaattagctgggcatggtggcatgtgcctgtaatcccagctactcaggaggctgaggcaggagaatcacttgaacccaggaggtggaggttgcagtgagctgagatcgtgccattgcactccagcctgggtgacaggggtgaaactctgtctcaaaacaaacaaacaaaaaacagttgtttttttttaattagctgagcatggtggtacatctctgtagtctcagctacttgggaagctgaggcaggattgctgaacccaggagtttgaggctgcagtgagttacaatcgcaccattacactccagcctgggcaacagagcaagaccctgtctctaaaaaaagcaaaaacaaaaacaattttgtcagccttctttactttataatttaatttttttttatgacatatgcctgcaccttaatagtttcagggcttaattttaaaattcctaatctggtcctgtccaccttgtaggtttgtggtaaagattaactgagaatatttctgtaaagccctgagctttataggaagcatataataaaaatccatgattattattatcacttctttgtaaaagaaggcatgagagaattcccatgagaagatggtaggctgagtgcatgcatttagctctcttccttcctaaaccttactaaaataactgtaaaagactttccaaaaatacatgaaccagtttagccgggcatggtggctcatgcctggaatcccagctcttaggaaggcacaggcatgaggaaagctggagcccaggagttcaagacctgcctggaaaatataacaagaccccattctccacacaaaagaggggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccccaaaaaaaaacaaacaaaccaaaaagtgtaaaaatacatgaggcagtttaaaaagaactagagaggggagaacagcaaagccatcttggaagacagaaaatgggataagcgttgaaaagtaccaagaaaaagtccagacaccgtggctcacgcctgtaatcccagcactttgggaggccgagttgggtggatcacctaaggtcgggagttcaagaccagcctgaccaacatggttgaaccccatctctatttaaaatacaaaaattagccgggtgtggtggcggatgcctgtaatcccagctacttgggaggctgaggcaggagaatcacttgaacccgggaggtggaggttgcagtgagccaagatcatgccattgcactccagcctggacaacgagagtgaaactccatctcaaaaaaaaaaaaaaaaaaaaaaaaaaaaaaaggtaccaagaaaaaagtctaggtgagcagtgaggaaaggtgggaaacgacctaatttcaacaccgaattccccatttctgccccaaacctcagaaactggcaatgccaggggcctctggaagaaaagatcaaggaggagacaaaaacataaggactgggtcaaatataaggcactgttagacccctcccatatcttctacactccctgaagccaagtgactgcccttctcacaccccacagaaggtggtgggtttagtctctggtgagggttaaacagagggtctccgtcctggggggacaccaggaaccatactgaaagaaggaaggtataatgtacaaatttcactgcacattttgaaaccctcagcttcttttcaactagaccctcaaaatgatgctagacaaatctttaacctccaggcagaagatttttctacaaaccttctctgaagaatcagattagcccatgaacaaaagactgaaagacgaaacagaagtgtcctaatggggtagcccagtgctttcatattatagccaagcacatcagcaagcccatcctataagcactgagcttccatcaacaatttggtatcctgtgtactaaagcatccaagatgaatggatagccaagaatcccaagacatctgaagaaatccactaatatgacagacagaagttaaaacaattaggaaaatatgtatcttggaggaaatagactctgcattaaatatcctctgagaaacaggatattgcaaccacagaaaaagaatgtcatatgaaagaaacatttaaaaataaaatagaatttttggaatttaataaaatatataccagaaatttaaaacgcaatggaagggttagggaaaaaagttgaggtaagtgcccagaaaataccattaaaaacattaaagtgatgaaaatgacaaaagaaagagatttaaattataggattggtctaggaattccattatggaaataaaaagacttctaagaaaaagaaacagagaacacagggagaaagacagcatcaatgaaataatttgcaacatttcccagaatttgtggacacacgtttatagattaattgggccactaagtgtccaggataacaaataaaaatggactcatagcaagtcccatcatcctgaataggggtacaaagacagtctaaaagcttctagagaaggaggaaaaacaaaaactggtcatgtacaaaggatcaagaatattcccagccaggaaggtgaatataatcacacacacacacactcacaaacatacacacatacgaatcagattgggtttcatcttctcaaaactgaaactagaaggcaacaacacaaatgccttaaaaagctcaggcaaaaaaagttatttataactttctgaaaacaactttcttgcctgaaattttaaacccaactaaactatcctttaagtgttagagaagcatcaagcctctcagatatggaagttctcaatgcctcaagatcacgtacattctttcttgggaagctactggacaaagtgcttgatttaagcaggagagtaaagcaagaaagaggaagacatgaaaactgggaaacaaggaatccactatgaaagcactaaggggaatttcaaggatggtgaaaaagatcctatatgacagttactagctatagagaaagccagggcagatcagaaggctatagtagagatcacattcaaggagatgatatcaatatgatatccaatacatgtctggacatattaaaaggagattaacacatttagaaagagattttggggcagaattggtggttaaatacatggaaaacaagattggggaaaaaaaaggcaattgctaactccaggaaaaagaaaagtcatacagaaagaagaaaaatagtcacaaagcagtgcaaagctcagctttgaataacatctacataatcataataatgtaaactctagatagcattacatagtcataataatggaaactctgaacactgagtttgtcaaaactaagataaaattatactgggactctgatatgaggcatgtgtgttggaacgaggaaataggggcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccgtctgcatgaatacttttaacaaaaataaaaaccaattttttaaaaaagggaacaaggaattcctacatgcactgatatgtaacatcctctggcaaaatataggactgtatatatatggaatgctagtatttgtagggaaatcttagggaagaaaatagatacctatttgcttatacttgcaaaaatatctctaggagaaaacctcatacactagaaaccataattgtctcttgggagggaagctaagggtctaatgcacaagggttgaagggagaagttcaccttttgaatttgtatgtaacatctttccaaaaacaaaccacggccgggcgcagtggctcatgcctgtaatctcagcactttgggaggttgaggcgggcagatcacctgaggtcaggagtttgaaaccagcctggccaacatggcaaaaccccatctctactaaaaatacaaaaattagccaggcatggtggtgtgtgcctgtagtcccagctactcaggaggctgaggcacaagaattgcttgaacccaggagacagaggttgcagtgagcagaaatcataccactgagctgagatcgtgctgctgcactccagcctgggtggcagggcgagactctgcctcaaaaaaaaagggggggagaatttaaaaaataaacatgacataatttatgcatatgcagatataagatacatattttaaatatcagcttctcttcccataccctcaaggggcttggcttccacttgggagggtgccatgttgtgaagtatctcttagaaagtccctcccattttcccaactcctgtgaggcagcaaagggctgagctctggctctgagctccctgccacagtatactagtcaacccctctaaaccagctcctgccacactcatcatacccattctcacccctacatttatgcttttattattcttggctagaaagccatccctgcccccttctctcaccttagcaaaccattcttcgaggcttataaagccccacctctctcaaataacccaccccatccatcctgaccctggtaggttcttttctataaataactctaataattcattgattcaacaaatactgagcagctactatgtgccaggcaccagaaaatgtgctggagatacaatgatgcacatgcaagaaggatggagtttataggtcctcaggaacttactgtctatgtgacacaactgcaatgcttcatcttatattcagtgcatgtgtgttacccatccctcctcaatcccgccttttcacaccccatcttttccatgaagaactcaaggaagaagccacatgtgctagctttctctctccaccttcatggtaagcttagtgtggatcgcagcccagtgacttaacagaatgagatcgtgccatttatcaatggagtcaacacactgggcctacgtgtttcttcacaaaaaccaatttcctacttgggaatggagaaaaaattaagcaggtgaacggaattcttcccaagcttaaatttttctccattatttttgacattctttttattttttatttatttatttattttgagatggagtctcgctttgttgcccaggctagagtgcagtggcgtgatctcggctcactgcaagctccgcctcttgggttcacaccattctcctgcctcagcaccccctgagtagctgggactacaggcgcctgccactgtgcctggctagttttttttgtatttttagtagagacggagattcaccacgttagccaggatggtctcgatctcctgatctcatgatccccccaccttggcctcccaaagtgctgggattacaggcgttagccaccgtgcccgattctttttatttttggagtccgccatcaatgatttgccagaaagcaccaggtcatgccaaaatagacgagggcatagcaggtgttggttaacatttaaattaagtaaagagtttatcttttatggatgtgcatattcacggttttcattttctttctttctttcgtgacagggtcttactctgttgccaaggctggagtaccatagcacgatcatagcacactgcattcttgaagtcctgggctcaagccatcctcctgcctcagcctccagagtagctaggactacagactcacgcactgtggccagctaattatttttttgtagagacaagagctcactatgttggccaggctggtctctaactcctggcctcaagtgatcctcctgccttggcctcccaaagtgctaggactgaagacatgctgctgtgctcaatcatgatagtcatttcctattggagcttactatgtgtcaagtgagcatttctaagtagtttcaagagagctgactatgcaattttgtgttaaaacctagagaccatgaggaatcaaatatatgaacacagggtgtccttgtcaattacaacattgcctcacagttaagaggtggtctagcgcaggcatctcaaaccaccgactggtactgcacagcaggaggtgagtagtgggcttcatctgtatttacagccactccctatcactccaattactgcctgagctctgcttcctctcagatcagaggcggcattagactcttatagaaccaccaaccctactgtgaactgcacataagagggatccaggctgtgtgctccttatgagaatctaatgcctgatgatctgtcactgtctcccatcacccccagatgggaccgtctagttgcaggaaaacaagctcagggctcccactgattctacatgatggtgagttgtataatgatttcattatatatgacaatgtaatcatagaaataaagtgcacaataaatgtaatgcgctcgaatcatcccgaaccatctctcccctgcggtccatggaaaaactgacttctatgaaactggtccctggtgtcaaaaaggttggggactgctggtctaggaaagcaaaagtccccacaacacaaaagtattcttcaatgactacaagagcgatcaaactccaccgaaacctccttctccgacgattcagtggcttcaccttgccaattattgggtatcaatagccaccatcatgatatgaacacaaaacaaagtggcagttctggaaaacaaggtgcagtgactggcaaagtcagtggccttggaaaggccaaaaaaaagattcaggggccaagtgtggtggtgcacacctgtaatcccaccactttgggaggccgaggtgggaggatcacctgaggccaggagttcaagaccagtctgaccaacatggtaaagccccatctctactaaaaatacaaaattagcctggtgtgatggtgcatgcctgtaatcccagcactatgggaggctgaggcgggcagatcacaatgtcaggagatcgagaccatcctgggtaacatggtgaaaccccatctctactaaaaatacaaaattagccgggtgtggtggcacatgcctataatcccagttacttgggaggctgaggcagtagaatcgcttgaacccaggaggtggaggttgcagtgagctgagatcacaccattgcactccaacctgggcaccaagagggaaactccatccggaaaaaaaaaaaaaaaaagaaagaaagaaagacaaaagaaagaaaaagattcagggcaattcacagctgaatgaacgctaagaccacaggggctttgagagacttaaacactaaagaagtaaaagaagcccttaggaaaactggtgacccatcaaataaatctgtaagaatgatcctttttagctcgggctgcagaagtcaagcatgacatgaagatgtcgttttatgctcacatgatttcatccctcagcccagaaaaagttacagaaaaaaaccccacacccactcttaattcattttatactgaatctacaaattagcacctacttgtaattaaaataaaattcttattacatgtaagctgaaattaacctatttttataatttgcaatgttggttttcttttcttttcttttgagacaaggtctggctctctcacccaggctggaatgcagtggcgtgatctcggctcactgcaacctccacttcctggtctcaagcgatcctcccacctcagcctcccaagaagtgggactacaggtatgtgctaccacaccaaagtaatttttgtattttttgtagagacagggtttcgccatattgcccaggctggtctcgaactcatgacctcgagcaatccacccatctgggcttcccaaagtgccaggattacaggcgtgagccactgtgcctggcctgcaatgtcatttttcaagctcagtcaaatattttgcccactctctttccctcctccacacacatactatctacagtgaaactttggtctctgttttaagtgatctttttctggaacgaattatcttcagatagtaaaaatttccttcatttcatgccatttagttcagttagtgtaatgaaaggtcacgtaacaaaatgttaatggtgatgagttttggatgatagaatcataggtgccagcaagttctcttttacttaaatatatgtttaagtttttctagaatgaatatacaatattaaagactttttcaagttacaaataaattttttcagagcactgtagaaatgcttacccatctgtcgctccccctccttctcctttgctaacagaattttctttctttttggtatttagattaaaatgtgcttagtgggacctcagctccagaaaagaaccaggaattgctgggtatggtggcttatgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaagacagatacctgactccaggagccatcactttacaacctgagattacagctccaagattgcctttgcaaggctccacctgctggtctttggaggtaatggcaggccctgcctagaagggccaagattctggtcctacctgtggagtctggctcactgtcagaaagttggggcacttatacctgagtccctctatcttgggggcggggtcgtggcatctctcaggcacacctggattccggcctcaagaacttccagaattgggctcctctcaactcccaactcagatccctgggttcccacctgttggtgccctttcagagggggtgtgagttttcgagtttcttgtactcttcgcctgacctggtacacttgtttgcattaactgcctagtccctctgtttgacttgggggtggctatttcaggggctccaaagtgttctaaatagaaggtgagaaggcctgggtgcagtggctcatgcctataatcccagaactttgggaggccaaagtgggaggatcgcctgaggccaagagtttgagaccaaccagtatagcaagatcctgtcacttccaaaaacaaaacaaaacaaaacaaaaacaaaacaaaaaaacccacctttttaaaattagcttgacatgacagtccacacctatagtcccagctacttgggaggctgaggcaggagaattgcttgagcccaggaggcggaggttgcagggagccgagatggcaccactgcacttcagcctgggcgagaaagtgagaccctgtctcaaaaataataaaacaatagtaaaaataataacgtataaacatgaaagtaataggcacaagtcttaagtttggaaaaaccagcattaacaatcttcacaagaagctacaagatagagactatcaccccttttgacaaatgaggaaactgaggctgaagaggaaaagatatttacccacagtcccacaggggttgagggacaggtaggtgtcaacacagaccacaatggctcagccccagggctgttccccaccctctttccatcctttgcagacagctggcccgacggggaccttgggcagcgagccccggagctggagctggagcgggcccatgcccgtatttgcccaagctcttggctctccctcaccctcccaggctgcaaacacagatgttccttttgctttttccctttttcagccacagtaactcctggtccctcgcagtgcctgccaaactccacattcctggcaagaactgcagacaagcaggacaggaggggctccctggagctggccccgtgcagccctgagttcactcaccttgaagcatgctccggtaggccgtgtctgcgatggcgtagatgtgaggcggcatctcgtgcctcttcttgcccttgtacatgtcgacgatcttctccgagtagatgggcaggtgtttataggggttgaccaccacgcagaagaggccagagtacgtctgcagacagagaacccagcttacttccagacctcctccagggtagacagattgcacagaagcactcaatattctcatgttagagatggggaaactggagcttggagtcttagtggaaaccctgggcctcactgatattccaggtacgtgggaagaggagaaagggcgagagtgggtttccaagctgcctatgttttattttgcaactgtggggggttttgtgtttgttttgagatggggtctcactctgtcacctaggctggagtgcggtggtgtgaacgtgactcactgaaaccttgacctttctggactcaggtgatcctcctacctcagcctcctgagtagccaggactacaggcgggcgccaccaggcctggctgatgtttatattttctgtagagacatgggtttcactgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgacctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggtgtgcacaaccatgcccaggtaatttttattttgttttttgtagagacagggtttcaccatattgcccaggctggtctcgaactcctgagctgaggtgatgcgccagtctcagcctcccaaagtgctgggattacaggtgggaaccaccgcactcagccagagagggaatgtcgttaactgaacattggaggcatagaaagccacacacccctaaaaaggggctgtccagagggatccgcagtcatacagaaacacagctgccaaaactgtggtccaggagggagggaggaaaaggtaataatcctccaagctctctctcctcccaccaccctctgatctctttctgggacctcccaatgtccatatctaagaagaaaccccagtgactcagtctctagaagatggcagaggcatctcctcgtggcatcttcacaactactcagtaacagtgatttccccaccgcctgtttgacaggagggcaaagtgaggcatggtgaggttgtcaccaggttacacagctggagggaagttgggaactagaactcctgtttaccccacagcgcctgctcctgatcattaataccttccccatctgcaaaacagagaccaacactgacatgagctctccaatgtggatgaagcttgaaaatatgcctagtgaaagaagccaggcacgaaaagtcacgtactctatcatctcatttatgtgaagtgtctagagtaggcaaagccatggagacagaaaacagacttgtggttcccagaggctggaaagaggtgggaaatgaggaggaactgctcatgggtataaggtttccttttgaggctataaaaatgctctggggccaagtgtagtggctcatgcctgtaatcccagcactttgggaggccaaggtgggaggattgcttcaggctaagtgtttgagaccagctcaggcaacaacagccggaccccctctctacaaaaaaaaaaaaaaaaaaaaaatagctggccatggtggtgatcacctgtagtcccagctacttgggaggctgagtcaggaggattgcttgatcccaggagctcaaggtaatagtgagctatgattgtaccattgcactctagcccctgggtgacagagcaagaccctgtcttgaaattgatagctgtacaacattgtgaatgcacttaatggcactgttttctttaaaatgtttaaaatggtaaattttatgtcatatgcactttaccatttaaaaaatagcagtcctctcctactgggtgaataggagcatctgaaaataatcagatcagggacggaggagtcaaggcacaaggcgagtcccgccatgctgtacgtggtaaggcactattgtcatgatttttccttactggatactagattttcccatggttgaggtcacagttcaggagacaggctccaacccgtctcacaggaactgctttccccaaacgataaacatcagtactgcccaagactctgatggccataaagcgtatcctcttccctgcaagtgacttagggagaaccacagatccatctctcagttacagctagggtgaaccaagcaacagagggttaagtgacttgaccgaggtcaccaaagaagatcctggcagcaccaagcccagcctggcccgcccccaggtatgagcatggtccattatgctatccagcctaggcccatccaacagaaacagaaactactgatcgttcgttcattcattcattcattcattcattcattcattcattctgtacgtcccagatgccatgcaaaaggtgctgggactacattagaacattaaaaaaacacaggatcccagccctcaagggccttttagtcaagggctggagccaattagagagtgggaaagtctggctgggtgtggtggctcacaactgtaatcccagcactttgggaggtcaaggcaggaagattgcttgagcccagaagtctgagaccagcttgggcagcacagtgagacccccatctctataagaaatttaaaaattagctgggcatggtggcattcacctgtagtcccagccacttgggaggctgaggtgggaggtttgcttaagcctgggaggttgaggttgcagtaagccgtgattgtgccatgcactccagcctgtgtgacacggtgagaccttgtctcaaaaaagaaaaagaaagaaaaagagagagtgggaaggtccttccagggctcagtccactcagggacaatggtatgtaatgtctgggggtgctgcagaggaatattctttgaaggtacaggattgttgggcgcagtggttcacacctatgatcccagtactttgggagaccaaggagggcagattgctcacactcaggagttcaagaccaacctaggcaacacagtgagaccctgtttctaccaaaaatacaaaaaattagcagggcatggtggcacatgcctgtagtcccagctactcggcaggctgaggcaggagaatcacttgaacctgggaggtggagggaggttgtagtgagccaaggtggtgccattgcactccagcctgggtgacagagggagaacccatctcaaaaaaaaaaaaaaaaaaaaaaaaaaggaaacaggattgatggagacggaggttctcaccatcccctaaaaggagaatgaatgagtcaacatatgcctgtctaaatagccatcaaccatttactgagcacctactatataccacatctgtgtcagaggctggagataaagaaatcaatgatagctcctgcccttaaagaacttaaatcagagggggagacaagtacattaaaacacgtcgtaagaacagagaatgataggaacaaggaagggaaggccctaacccacattgggggtggtcagggaaacctccaggtggggaggtattccctgcactgagtcttaaaggacaacaaggtgttaaccagctcaagacaaagcagggacatgggcagaaaaacaggacacggggtccgtgggggtgaactataagcagcttggtataagcggctccatcggaccgaaatggagaagcaaagcaagggttagaggtaagcggggcccaggagcaacatccagcctggtggggctgggagtggggggctgcctgcctggacacccctcttccccattccatcacccaggaccctcccacccatcctgcaaacaccagctgcaagtgccttgagtccggggaaccccctttctcctcttcagtcccagcacaggccttggtatagaataggtgctaactaaatgcttgctaaatgcatgccaggggaataaattaatgatacagcttcctgggagcagggacagcctgacttcacctccgtgacctgggggccttgcacggcggcagtaggtactcagtggactacactgagccaggccaggggctatttcctgttcaatcagtgtcccctgtccccaggacaagcctcccaaagagaagagcccagtctgtggtcacctgaacaaaggtcaatcaagccccaccctccttcaggcctcgactccatctccagctcctctggggccatgtccactgccacgccccttttgaatgtaggtatcatttacagcccaacctgtcctcactcaagcccttgacctggaggcagtaaagggcagtggctaagggctcagaactgggtatggggtacttgaatttgaaccttcactttgctacttcttcgctgtgtgaccctgggcaagtcccttaacctctctgagtctcacttatcctcatctacaaaacagggaggcatacgaacaagcccttcatagatgtgctgcgagataatgctcgaaaagcatttagcatggcggctggtatgtagtaggtgctcaatcaatgttatttagtgactcttactatgctcccttcatttcacgagagggaagtcttgccaccttagagccttcaatatgctgttctctccacttggaacacttttcccctcatcttcccacagctggttccctctcctcttttagagctctgcctaaatgttacctcctggactgtgacccacacactactgtatctcctgcaccccgcacagtgccagggacagggtagacactcagtcagctgtaatcccagcacttcgggtggccaaggaggtcagatcacttgaggtcaggagttcgagaccagcctggccaacatggcaaaaccccgtctctactaaaaatacaaaaattagccaggcatgatggcaggcgcctgtaatcccagctagtcgggaggccgaggtaggagaatcacttgaacccaggaggtggaggttatagtgagctgagatcatggtgctgcactccagcctgggcaacagagtgagactctaaaaaaaaaaaaaaaagaaggaaggaaggaaggaaagtaagaaagaaaggaagaaagagagatgagagatagagaaaagaaaagaataaaaggaatttttaaaaagaaggaagaggccgggcatggtggctcacacctttaatgccagcactttgggaaatcgaggaggtcagatcacttgaggtcaggagtttgagaacagcctggctaacatggcaaaaccccgtctttactaaaaatacaaaaattagctgggtgtggtggcgcatgcctgtaatcccagctactcaggagtctgaggcaggagagtcacctgaaccaaggaggcagaggttatgtgagccgagatcatgccaccacactccagcctgggtgacaaagtgagactgtctcaaagaaaaaaaaaaaaagaataaaatgaatttttaaaaagaaggaaggaccacactgccttttcaactccatcactagcttctgaaagaggaatatgacttccatcctctttgtttgggacatctctcccagtgccgtgcacacaacaagcacttaatccatacttccaggtagatctgaatctctgctgagttctgtaaaagctttctaagcaagccagggtatgacgatggagtgaaggtaagactggtgcaggcagccgcacatctcacggcagggtcgtggggcttcagcatcgggctcttcctcccacattattcagccacttctccttcacctcgacccagcccaaccatagttggctgtgtttctgcctctctggccccacgagcccctctccagctggttaaattcagaggtttcaacatcccagcctcctgtgtcccagccggcatctcatgggccctgtgccaccagcaagtcccagctgcaggcccaggatttccctcttgtgaccgtattaggaagcagctccagtttttctctgacgctttatatggtcagccacagagccctgagcagggggtgctcccggggcctgcagcagaaatgaggaacagggagggaagggagggaagtggaaggaacactggctttcagacacacagggatggccgggcgcagtggctcacacctgtaatcccggcactttgggaggccaaggtgggtggatcacctgaggtcaagagttcgagaccagcccggccaacacagtgaaacctcatctctactaaaaatacaaaaattagcaaggtgtggtggcgcgtgcctgtaatcccagctactcgggaagctgaggcaggagaactgcttgaactcaggtggcagaggttgcagtgagctgagattgtgccactccactccagcctgggtgatacagcgagacttggtctcaaaaaaaaaaagacacacaggcctgggcagagtgttggctttgccttatcacctgcctgacttgtgcatacagacctacccctgagcttcctcagtaaagtgatggataatcacggcttctttatgaagctgcagtgcaatatcacggctttctaaatacccaacctagagacagacgtggtccaccaagcacgtgcttttgctgcagccttgcttttaagagcaaaaagactagaaacaacctaaatacctgtcaatagcagacaggcttaatcattatggttcatccctatagcagaagactgtgcagtggccctctctctactaccatggatgaatggccaaaatacacagttagatgcaaagattgagacgcacaacagccggggcctgtgctgccattttggaggggtgcaggaggggctctctatgtggctgcatgtgtataaaacatcactggaggctggatggagcagctcacacctgtaattgtagcactttgggaggctgaggtgggtggatcacttgaggtcaggagttcaagaccagcctggctaacatggcaaaaacccatctttacaaaaaatacaaaaattatctgggtgtggtgatgcacacctgtaatcccagctactcaggaggctggggcgggatgatcgcttgaatccagaaggcataggttgcaggagccgagatcgcaccattgcactccagcctgggtgacagagtgagactttatcacaaaaaaagcaataggctgggcacagtggcttaagcctgtaatcccagcaccttggcaggccgaggcaggtggatcacctgaggtcaggagatcgagaccagcctggccaacatggcaaaaccccctctctactaaaaatacaaaaatcagctgggtgtggtagtacacgcctgtagtctcagctacttgggaggctgagggaggagaattgcttgaacctgggagggggctgttgcagtgagccaagatcatgccacttcactccagtctgggtgagagagtgagactccatctcgaaaaataatataaataaataaataacatgactggagggctacatatgtaaccagcaaccacagtgtctctaagaaggggaactggaagggcgagaaataggaacgaagggggaagttctatattcccttatacactattttatttcatatttgcatgtcttacctattcaaaaacatatttgaagtctgactagatagttatgaacagacagaaaaaactataaggtagggttaagtggaaaaaaaatcatactgcaaaacatacaaggagtgactttttcttatgtttggggtgtgtgtgtgtgtgtgtgtgtgtgtgtgtgtgtacatacatgaacctgtgaatcatgtttgcctccagggaagagggctgctttttgtgatacatacttatttttaaatattctcctgaggtctttgcatagattatccttgtattactggaggaggttctttgaagcaataatgacttgaaagatcagaaggctgggtgcagtggctcatgcctgtaatcccagcacgttgggaggcggaggtgggaggatcatctgagttcaggagttcaagaccaacctggccaacatggtgaaaccacttctctactaaaaatacaaaaattagctgggcgtggtggcatgtgcctgtaatcccagctactgggaggctgaggcacaagaatcgcttgaactcaggaaatggaggttgcagtgagccaggatcacaccactgctctccagcctgcgtgacagagcgagactccatgttaaaaaaaaaaaaagatcagaagggctaatgcttggggcttgacaaagggcagcttccagttacagtgtctttctaccctctagggaccagtgcagtggctggcacccaggaggcctctgttcacaatctgcttgttccttgtgtccccgggtggacactgcttccagagtaggctaagattgctgggccaggtctctaaggcggaaaaattgtcacctgctaaagtttggaaggagggcttctcctgaccccctgggcattccagaagcagaaccagaactggaaaaatgtcctttggggttcatggttcagggacttgggcttggagttccaatgagcaggggggcccatccaccttggctctggatcatgattttcccaaccccagaggtttggtatagggtggagggtcccactgtctacagagacaaagcaggtaaggcatgagtgaagcagggcgtgtgtgagtgaacaaaagaggtgccacggtcaatggttaccatggcctgggagacgacagggagtggtgaggtctgcggaaaagcagagcaaaaagcccatctcacagggactgctactcgcactctgcattctgcagtgtcaggtcctctgctttttcgagcaatgccagaaacagatttctttttttgatatattaagttaactcaatttaaaaacaaaaatcactcctctgtgttagcaggttgtaatcattagtctagcacctagttaggtgctcaaggaatcataataaaaggttcaattccttcttgctctgcacttaaagcttgtctacctcaaagctaacaaggcctctggcactgtcccctcctgctccagcccacgaccatcacctcctgctctaagcctattaccccaagagccctttgctactaatcataggtagtcaccctggccctggactcacacagaccttgtctgaatcccagctctgcccaccttccagtggtgggactaagcacatctgagcttcagcaacctcatctttttttttttttttttttttttttttttttttttttgagatgtagtctcactctgtcacccaggctggagtgcagtggcacaatatcatgcctgtaatcctaacactttgggaggccgaagtggtgaagattgcttgagctcaggagttcgagatctgtttgggcaatacggtgtgaccccacctctaccaaaaacacaaaaaaattagctgggcatcgtgctacatgcctgtagtcccagctactaaggagactgagataggatcccttgagttccaggaggcagaggttgcagtgagctgagatcatgccactgtactccagcctgggcaacagagtaagaccccatctcaaaagaaagaaaaagaaaaaagaagaaagaaaaaagaagacagaaagacagagaaagaaaggaagaaagagagagggagggagggagggaggaaggaaggaaggaaggaaggaagggaggaacgaactaactaactcgaggcagacgaactcagccaaaagacagcattcagaagaccaagggacccttaggaccaggcgtcaaagccatgctccccgccaggtatgccacaaacggtcttcagcagtttaggtagactgctggacattgctgagcccagaacctgcatctctaagattaggaggaaagctcctctggcttctatagactcttctagatccaagagcacaagaggtctgccagaaccttctcaagggcacatcgtttgaggcgagccttgcagaacggaggagaaagtttatcttcatcacagagggcaaagtcatgcatgccagaccacggacctggtatcacctcactacccgcctattaacaagactcatgcatgctgctattatgggctgggagagtaagttactgtgctcccccaccccaacccctttccttctttatcttctccgtcatggacgacggtttctattaagcaattaaactgaccagaaaggaacaagagaagagcgggaccatcatcacaaggctgaaaggattttaatctaatctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggcctgtcctgaaactccctagatggtgatgatacgtcttagatgaaagacctgggccccaaagagtccaattttccctctagctccctacagacgggcctctttagaaatatccaacatactggctgggcgtggtggttcaggcctgtgatcctagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaacccgggaggtggaggttgcaatgagccaagatcgctccacttcactccagcctgagcaacaaaagtgaaattccatctcaaaaaaaaaaaaaagaagaaagaaagaaaaagaaaatgtccaccatacaaacagccccagatcaataatttttccatacaaacagtgccacagacaagagacttcccctacttaagaaagtaaagatacattttgcaacactgcacctcagcttccttccctaaaaggggcaaacatttttaactcaggggatgctgtgttaaataaaatacaatgtgtcaatgtacagcacttggattggaggacatatttaatagttacggccaggcacagtggctcacacccgtaatcccagcgccgtgaaaagtcaaggcaggagatggcttgaggccaggagtttgagaccagcctgggcaatatagtgagatcccagtctctacagaagtttttttttttttttttaattagccaggtgtggtggtgcacacctgtggtccacagctactcaggaggctgaggtgagaggatcgtttgaatccaggacttggaagctgtactgagctacgatagaaccactgcactccagcctcaaagacagagtaagcccccatctcaaaaaaaaaaaaaaaagttatgagttgctaagttgctcactcttaccatttggctctttaaaaagccactctaactccttctgaaatatctataagaacagtggaaaaatggcctatccccatgacagattctatactaccccttacaaggggtatctttggggcttcctgagatatattacacaagtcaacactgagcatttccaaatggaaaaaagagcaagtcactaaactgtgtgcccaataggcttttaaatatgtaaacagataccatgctcacaaagagacaaagaatgcaccgcatctctggttaaggactaatttttctgttttgtgttcactatgctttctgaactctccaagtgttccatagtgaacgtgtcttagtttcctaattaggaaaaaaatgtgcaggacatttttagagatgacaaggggctttttgtaattttcatttggcaaaatgtacagaccagaaccaaagagacacaaggatgccaagtgatggaagaagaacatcttactagtaaaatcaaaagtgatcatgaccacagcaaaaaccaatctagtaacacttaacattttcagtgcctgcacttaacatgtagcaggaagtgtattaagtgctttctatttagagtaacccactccatgaagctggtactatttttttttttttttttttttgaaacagacaaggtcttgctctgtcacccaggctagagtgcagtggcacaatcatagctcactgcagccttgaactcctgggctcaagtgatcctcctgcctcagcctccctgagtagctgggattatgagtacgcaccactgcacctggctaatttatttttgcagagatggggtctcgttgtgttgcccaggctggtctcaaactcctgggctcaagtgagccacctgcctcagtttctcaaagtgctgggattacaggcatgagccactatgcccggctcccaagaggctggcactattcttgcatccattttacagaaaaggaaacaaagcttcagaggcatgaggtaacctgctcgagggtgagcaaggcctttcagagagaagacatagacataggccgggttgggtgacctctgcacatcagtctggcgacccgtgccccacaacatcacactccaagccccaatcatctagtccaagcagtccaacagaactttctatgataatgggaacattctgcacttatgctacccagtacaccagccactagccacaggtggctattgactacttgacctagggccaacacaacaaaagaaataaatttgttattttttattgtcttttacttatgtatttatttagagatgaagttttgctcttattgcccaagctggagtacaataacgcgattttggctcactgcaacctccatctcccaggttcaagcgattctcctgcctcggcctcccaagtagctgggattacaggcgcacaccatcatgcccagctaatttttgtatttttagtagagacggggttttaccatgttggccaggcttgtctagaactcctgacctcaggtgatccacccaccttggcctcccaaagtgctgggattacaggtgtgagcccacgcacccagctaataaattttttaatgtttcttttttttttttttttttttttgagatggagtttcgctcttattgcccaggctggagtgcaacggcaccatctcggctcactgcaacctctgcctcccgggttcaagcaattctcctgcctcagcctctcaagtagctgggattacagatgtgcactaccatgcctggctaattttggcatttttagtagagacagggtttcatcacgttggccaggctggtctcaaactcctgacctcaagtgatctacccgccttggcctcccagcgtgctgggattacaggcatgagtcgccaaacctggtctaatgtttcttttaattaatttaaatctaaatttagttagccacgagtggccagtggctaccatattgtgccatctctagtccactctgttctgcaagtctacctaaaatagtcctacgaccaacctgaacattcccctctgtgacaaggaaggcctccctaaaacctagccacatcctcatgtctcctacccacctggctgccaagacaaaccagcctttccaaagtggttatgagctcttctttactttcaagaggaaggaaggacagagaacgatgccaatgaaatctgttgagagtttatcatacgtcttggcacttggcacatgtgatgacatgggattgtcacacctcctgtctgtaatgagggtgattattcccattttacggataggaaaaccaaggcttcgagagaggaaataacctcttcaagggctgagatgtgaacccaccttggaatgattccacctcatcttgcaatctccctcgatcaaaccttcagcctcccatttcctttttttttttttttgagacagagtcttattctgtcacccaggctggagtgcagtggtacagtcttggctcactgcacctccacctcctggattcaagcaattcctctgccccagcctccccagtagctgggattacagatgcgcaccaccacccttggctactttttgtatttttagtagagacggcatttcatcatgttggccagcgtggtctcgaacttctgacctcaggtgatctgcccacctcggcctcccaaagtgctgggagtacaggcatgagccactgtgcccagccctcccaacacatttctaatgcctactttccttatgaggccaggagtaggtacctggctgcctgcaatactcacatatattagccctgagaagtaccgctccctcaggttgtgtagcacggaggcttcgttgaggcacgtcagctccgccatgtcctccaccttggagaacttgggtgggttcatcttctggatgtcatctttcccaaccgtgaccttcttgccattctccaccagctccacaaccacctcatcccccttctcctccttaatgctggctgcctcgaagccctgcttctccgaggggacccagacgagtctcttggcggcccagtcagcctgggccactgggctgttgatgaagtttttgtccacaaagaggaacttctcatcgtcactgagttggcccttctgcgccatggtgccttgttggtcccctgtggaataaggtaacagggtcagaatcagaccacaaccaagcccggaagacagaccaaccactcaccttgccctgtctaggaactcggtctgcagagacatcccaccaagtacaaagacctgcagtattgtgtatgtggtcaaagaacagagaccacccaaaggcccttcagaaagggatgtgtgtcatcgcctaaaataccaaaagtcagacaacccaaatgtccaccaacatacagctggatacataagccatgctatttccacactgtgaaatactacccagtgctcaggaggcaggaagtagggctggacaaggtggctcacacctgtaaacccaacactgtgggaggccgaggtgggcaaatcacttgaggccaggagttcaagaccagcctggccaacatggtgaaaccccgtctctactgaaaatacaaaaattagccaggtgtgatggtgtgcacctgtaatcccagccacttgggaggctcaggcagaattgctcaaacccaggaggcagaggttgcagtgagccaagatagtgccactgcactccagcctgggtgacagagccagactccatctcaaaaaaaaaaaaaaaaaaagaagaagaagccggaagtaagtgtacacgtgctaatatgggaagatggtcaagtctaactgtgcgctgcaaaataagagtcctcatacgattaaacatagaattacccagattccttgagcccaggagttggagaccagcctaagcaacatggcaaaaccttgtctctacaaaaaatacaaaaaattagccaggcatggtagcgcacacctgtagtctcagctacttgggaggctgaggtgggagaatcacctgagcctgggaggtcaagattgcagtgagccaagatcaagccactgcactccagcctgggtgacagagtgagactctgccttaaaaacaaacaaacaacccaaggtatataactggaaactcagtaaaaggaaagaaattatgcaataaaataaatgagtctcaaaagcatcatgctcagtgaaacaaatcagaaaggccacacgctctattactccttcaatacgaaaaactattaggctggtgcaaacgtaagtgtggttattgagatagaaggtaatggcggccgggcgcggtggctcacgcctgtaatctcagcaccttgggaggctgaggtgagtggatcacctgaggtcaggagttcaagaccagcctgggcaacatggtgagacccctgtctctactaaaaatacaaatattaatggagtgtggtggcacacacctgtagtcccagctactcaggaggctgaggcaagaggattgcttgaacccaggaggcggaggttgcagtgagctgagatcgcgccactgcactccagcctcggcgacagagcgagactctgtctcgaaaaaaaaaaaaagtaatggcaaaatagaaaaggcatatctatggtgacaggcaatcaagagttgccagaggaggccatgcacggtggctcacacctgtaatcccagcactttgggaggccaaggcaggggggatcacttgaggtcaggagtttgaaaccagcctgcccaatgtggtaaaaccccatctctactaaaaatacaaaaattagccgggcatggtggtgcacacctgtaatcccagttactcaaaaagctgaggcaggagaatcacttgaacctgggaggcagaggctgcagtgagccgagactgcaccattgcactccagcctgagtgacagagtgagacgctgtctcaaaaaaattaaaaaaaagagttgccagtggcaaggaaaggaatggattagtaagaggcacagaagaggtacataagaggtaagaggcaccacctttcggggtgataaaagtattccctgtggtcatggtggtgcttacaagactgtatacatttgtcaaaactcattaagaatgttctatccactataggatgagtaaagtgaacaataaaatattacatcgtttccaagagctagaagaaggacattgaatgttcccaacacaaagagatgataaatgtcattatataggaagtagcaaaataaaagtaatggcaaatgcttgagatgatggatatgctaattatcctgatcttatctccccacacattatatgtattaatatcaaaacattactaagagctggactcagtggctcacacctgtaatcccagcactgtgggaagctgagacaggaggatcccttgaggccaggagttcaagaccaacctgggcaacataagaagcccctgtctctgtaaaaaaattaaaaattagcctggcacggtggtgcatgcctacggttccagctactcaggaggctaagacgggaagatggctagagcccaggaggtcaaggctgcagtgagttgtaatcatgccactgcactccagcctgggccacagagcgagaccctgtctcaaaaccatccaaccaaacaactaaaaaaatcattatggaccccatgaacatgtatgattatttgtcaattaagaaataaattttttaagttgaaaaaactcactcaagctgtacacttaaaaaaacttgaatttgttttaaatcggtgagttttactttatatagattatacctcaataaagctgattaaaatatttgtcataaagtatttgtcttcattttatatgtttgtgtgtacatttctaaaagtctagaaaactgcataccaaaatattatactagggttctatctggtcaaatacgagacagtgtgaatatcaataagaaaaataattatatgtccatcaccctaacaccccaaaaagggtggaaagacaaatatatttaaatgcatttgttcaaaatgatttttgttgttgttgtttgagatggagtcttgctctgttgtctatgctggagggcagtggtgcaatcttggctcactgcaacctctgcctctgggttcaagcgattctcctgccttagcttcccgagtaactaggattacaggcgtgcaccatcacacccagctaatttttgtatttttagtagagacggggcttcgccaagttggccaggctggtctcaaactcctgacctcaagtgatccaccagcctcgggctctcaaagtgaagggattacaggcatgagccactgtgcccagccccaaatgcattattttttaaatgggtacagaaagtggggtggaaatgtgaaaatcttgattctgcgttttctatacaaattgttccttagggtaactaaattaagaaggggaagtctctcttgatggaagattaggtcattaaatgtcctgtctacatgggaagcccatggatggtagattcacgttatctgtcgttatccagatgtgtttatgaggagagggacagagacaacacactctataggcctgtccggccccccgttcctgactctctgaccatagctgcaggggctgtcctggaaacactggcttacagccccttctacctcttgctgctgggctccaaagaactgagttgctggctaagtgaggacatatggccaccaggatctatgcgtggttgacatccctccttcagcagggaattcacaactcctttgaattcactgataatccccacgcttgggccccaaatcccacagcgacagaataaagacccatgtcccactcctggatccctagagctgagcagccaactcctgaaacccaaccttttgggtgatgcagattttgcaagacagaatgggagtggcagatattccaatacctatttttttcctttcagggctgaaaataataattaaaaaactaattttaagaacctgctgctgggtgcagtggctcatgcctgtaatcccagcactttgggaggccaaggccggtggaacacctgaggtcaggagttcgagaccagcctggccaacatgtgaaaccccatctctactaaaaatacgaaaagttgctgggcgtggtagcatgcgcctacaatcccagctactcgggaggctgaggcaggagaatcacttgaacccgggaggtggaggttgcagtgagccaagattgtgcctctcaccgcactccagcctgggcagtaagagcgaaactcagtctcaaaaaaacgaaaaacaaacctggaagttgatttgctcagagattttctgctgggagacctgatatcgtagctgatgaaaaaaaagtggcggctaggtgcggtggctcacacctgtaatcctagcactttgttggggctgaggtaggaggattgcttgaggtccggagttcaagaccagctggccaacgtggcgaaacctgatctctactaaaaacacaaaaatattagctgggcttggtggcaggcacctgtaatcctagctactcgggaggctgaggcacgagaattgcttgaacccaggaagcagaggttgcagtgagctgagatggtgccactgcactctggcccaggcaacagagcaagacttcatccaaaaaaaaaaaaaaaaaaaaaaaaaaaagggcagagaaatgaggaaatcccatctaaatctgaataatcacttcagatatccagaaagagaaataaagatctggtagacaacatgtattgtcctaagtttaacaatcctcctttctgcattttaaaattgttattgaatttggcttagctcatagtaagaccaacagtgtcctgcccctgactccagttaccctatcttaaaaaagactcccttctacatggaagaattccagcgaatacatgcagaacaataaaactaggatgtaactgtttataaagctaatagtgggtctcaagctgggcacggtggttcacacctgtaatcccagcactttgagaggcccaggtgggcggaccacctgaggtcaagagtttgaggccagcctggtcaacatgggaaaaccctgtctctactaaaaaatacaaaaattagctgggcatagtggcatgtgcctgtaattccagctactcaggaggctgaggcaggagaattacttgaactccaaaggtggaggttgcaatgagccgagatcatgccactgtactccagcctggacaacagagcaagactttgccaaggaaggaaggaaggaaagaaagaagaaaggaaggaagaggccgggcacagtggctcacacctgtaatcccagcactttgggaggctgaggcgggcagatcacgaagtcaagagatcgagaccatcctggctaacacggcaaaaccctgtctctactaaaaaaaaaaaaaaaaattagccgggcgtggtggcggccgcgtgtagtcccagctactctggaggctgaggcaggagaatggtgtgaacctgggaggcggagcttgcagtgagtgggtgagtggagatgcgccgctgcactccagcctggacgacagagtgagactccgtctcaaaaaaaaaaaaagaaagaaaggaagaaagaaagggtcttggcaagttggcaagttctaccagtaattgctaaaaccattaggccaatggggctcacatttcctggtgcattagcttctgagtcagtaggactgggatggggcccaagaatatgcattcctaaccagcttccgggtgatgatgatgatgctggtctagggtccccaccacaagactgactatatcagatgaagagctcttgtggaatttttaagggatgggtccgcctgccatcacctaaatctactaattaaccctaacatcacaaaaagagagagctgactagacattataaacattacatgcctgcagatgggccactacaggaagtgccgttaccactaatgacatattcttgctcaaaagaaaaggggatggagatgggggatgaaggtgatgaagcctccagatctgacgcctgtctatggaaaatgcaaggcacaggagagcatgctaaacaatgcagtaaactcccaaaggtgagagactatgctctgtcgcccagctagagtgcaatggcgggatcttggctcactgcaacctccacctcctaggttcaagtgattctcctgcctcagcctcccgaggagctaggattacaggtgcatgccaccacgcctggctgatttttgtatttttagtagagacggggtttcaccatattgtccaggctggtctcaaactcctgacctcaggtgatctaccggccttggcctctcaaagtgctgacattacaggtgtgagccaccacgctcggccagtactctctttctttaacaaataaaatacaaacaaaaaggaggggaacccatagattaaaaaataattgaaagaaaagaggctggcagtagcccacatgtataatcccatattttgggaggccaaggcaggaggattgcttgagcccaggagttcgagaccagactgggcattatagcaagaccccatcccttaaaaaaaatatcagccaggcatgatgatgcgtgcttgtagtcccagctactaggaggctgaggcaggagggttgcttgagcccaggagtttgaggctgcagtgagctatgattacatcactgcactccagcctgggtgtcagggtgagaccctgtctcaaaaaagagaaagccacagagaacgagaacatttcataaatatagggcattttcattagcctaaaagatctttctgagcctaaataaagtacaagttcattggtgctggcaacatttgattggttgcctcctcttgagaggtaagataacctgtagtcatgtaaagacacccagactttgcaatcagatgctaattcaaacgtgactctgccactgcagaatgcgtgcttctgggtgacttacgtagatctgagactcagatttactgtatattaatactggggacctaacgggtgccctgcagagctgccatgaagtttagatgaaactctctacaccaagcttgtctaacctgcagcccacaggctgcatggggcccaggacggctttgaatgtggcccgatacaaattcataaactttcttaaaacagtatgatattttttcgcgatttttttttttttttttagctcatcagctatcattagtgctagtgtattttacgtgtggcccaagacaattcttctttttctggggtggcccagggaagccaaaagataggacacccctgatctacaccaagtaccttctgtttctataccctttctcacttccggtgactctaagccacttcgctcattcctaaccaatagcatttactactgttggatgttttaattatgtttatttctggacagccatagtcacagaagtggcttgatacgacgcgtcttcttttaatagtataaccaaggttagtttaaacaggcagcaaaataggaaatgcggcaaaatattcaatcattccctgataatctcttgtttcttaaggtgtcgcagcagatcgtgtgtgtgtgtgtgagagagagagagagaaaaagaaggagagagagagagagaaactggaggatgcgtaagagaaatgggagggtgtgaagatgaagtaagattgatcacaagtaggccgagtgtgatggctcatgcctataatcccagaactttgggaggctgaggtgggaggataacttgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccgggaggtggaggttgccgtaagccgacatcataccactacactccagccttggcgacagagtcagcctccatctcaaaaaaaaagaagtgtcagagctgggacccaaacctgggtctcattctggagtctatttggttctgcctttcacataaggtgggtgggcttgtcagatgcccataaaggaatcaatcctgtaaggcacctggcacagtacctgacacattacaaacacccaaaataggactcgaatcaggtgaagtaaactacagctccacaccacaaaaaaggacatctcacaacacatccttgagcaaaagaaggtggtcacaaaaagcacaggttctgtgactattgaactgaggtccaaaaccaggcagaattaatctacggtgatagaactcagataaggaatgaatgagtctccggtgtgcaatgattgcaaggacagaacgtgaggggggcttgtgagggttgacctctagatcttcatctgaatgccagccctatgagtgttcactttctgaaaattcatcaaactgttgggccaggtgacatggctcacgcctgtaatcccagcactttgagaagccaagatgggaggaccacttgagcccaggagtttgagaccagcctggccaacacagcaagacccatctctaagaaaaaatgttttttaattacctgtgtggaagactgaggtaggaggataacctgagcccaggaggctgagaccggcctggtcaacatggtgaaaccttgtctctagcaaacatacaaaaattaaccggttgtgatagtgtgcacctgcagtcccagctactcaggaggctgaggtgggaggatcacttaagctcaggaggtcggggatgcagtgagccatgatcatgccactgcactgcagcctgggtgacagagtgagacccccatctataaaaaatatatcctcttgaaaattcatcaagctgcacacttttttgcacatcaagcgtacttttttggttgtaaagtacacttcattttccttccctcttatctttaattgtggtaaaatacagctaacattcaccacctcggccacttaaacacagttcagtagcattaagtatattgatattcttgtgcaataatgaagagtttgtgcagatggtagccaattacatcccaagagggctaggagagtgtttcatttgttctaagcactatgacaagtaaagtggacttcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattctttgtagagacggggtttcaccatgttgtccaggctgaggtcttgaactcctgacctcaagtgatctgcctgcctcggtctcccaaagtgctgggattacaggcatgagccgctgtgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtacaaaaaaggagagcttggagcaggctggattccctctggctttgatgtctctgacagttacgacgtgcaaaatctgctttggtcaaaagacagcaagatgggggatgagaagcttcgactcatgctagaatggtgttttccatagcatgccccttggaaccctaattccctgaaatatctgggctggggtggagctgcggaggttgagaagctcttcaaacagtggcgcagtcaaggtcaaatccatctggaaggtgctacatattcccctttccctcattgagacacaaaacacacaacaggacacttgagtctctggcagatccggaaacctgaaagctgttttgctcctacgagccttgggtccccaaaacaacatttagccacagatttgccaaatgttttgagaatgttttcctaaaaatttgccaaatttttgagaaaattcagtgagcctgacaaattaataatactaatactagtaataatagttgctaagtcttttttttttttttttttttttgacacagagtctcgctctgttacccaggctggagtgcagtgacgcaatctcagctcactgcaacctccacgtttctgggttcaagtgattctcgtgcctcagcctcccaagtagctgggactacaggcatgcgctaccatgcctggctaatttttgtatttttagtagagatgaggtttcaccatattggccaggctggtcttgaactccaggcctcaagcaatcctcccaccttggccccccaaagtgctgggattacaggcgtgagccaccgcagctggccacaaactctgcactgtgactcttgggctgcgtcattctgtgtcgtgaggggagctcttccgtgcattgtgggatgttccgcagcatccctggtctctgcccacctgatgccagtagcaccccttcctccactcatgacaatcaaaaatgtctccagacactgctagatgtcccctggggtggcaaaactgcttccagttgagaaccacagctttagaataaaaacaagggctgtcttgggaaaggcagttaaagctgagagcagctctcacttagtcaaactcaactcggaataccaactgcagaagatcagacgggggcaaggtgaacacactggaccagagacggaccgccagttggcccaaccccagggacactcttcatctaccttgatgcaccttcccaaccctccctcctccaccatcgctcatgtttaaggtcctgcatcagctccaagggctgaaaggacatctctgaaattactacccagaactgctgaccacgaagtacagttcactcatcaagagctgctctcaatgtttttggttgggggaagggtctcactatatgcccagggtggagtgcagtggtgcaatcatagcttactgcaggctcaaactcatgggctcaagggatcctcccacctcaggtgtgggccactatgcccggcttattttttgtagagatgggggtcttgctattttgcctaggctggtctcaaactcctgatctcaaatgatcctcctgccttggcttcccaaagctctaggatgacaggcgtgagtcacctcgtccaactttctcgaatgtttggatgaaaacaaatgactctgtcacctttggcattagcgatgtttgacacatctgagtgtgtcagccttgtttacagtcctgtcctgaccaacaactgcttcattctttttttttgagacagggtctggctctgttgcccaggctagagtgaagtggcgcgatctctgctttctgcaaactctgcctcccaggctcaagccattctcccacctcagcctcccaagtagctgggatcacaggcacgcaccagaacacccagctaattttttaattcttgcatttttttgtagagacaggggtctcactttgtggcccaggctggtctcaaactcctgagctcaagcgatctgcctgcctcagcctcccaaagtgctaggattacaagcatgagccaccgcgcccaggctgcttcattttttgagcacaaacaagctaatcattagcctctggaagaccttaggatgtcaagtaacgagtctcagctttgccccaaacctgctgggtgactctggacaagtcacttgccctctctgggccttgtatttttcatttagggaaaataaatcaatggtaggctggcccagctctaccattttatgggacccgtctgtgactcccagtcaaagggctgaaactggaccaactgagaatgtcaggttgctttagtttgttttaccatcagtttcatttttcccagaagaactcaggggcaaaagatcttgccctctctgcttcagcattaataaaaagtaaattaggccgggcatggtggctgatgcctgtaatcccagtacttcgggaggccgaggcaggcggataacctgaggtcagtagttcaagaccagcctggccaacatggtgaaaccccgtctctactaaaaatacaaaaaatagccaggtgtggtggtgggcgcctgtaataccagctactcaggaggctgaggaaggagaatcgcttgaacccaggaggtggagggtgcagtgagctgagatcccatcactgcactccagcctgggcgacaagagcaaaactctgtcttgaaaataaataaataaatagtaaattaaatatcccagagcccagagagtataggatttgcacatcacctcacctggtcaacagcttccctcaggattttactgccaagccattggctaaagattttggaccagagacaaaaacccaaatgtttttggagatcaggtaagtaatacagagtgacccagaccagatgttagagtattgcttatattctaaataccatgcagggttcagcactgtggctcacgtctgtaatcccaacactgggaggccaaggcaggcagttcgcttgagcttaggagtttgacaccagcctgcgcaacatggtgaaaccccatctctacagaaaatacaaaaattagccaggcatggcagcacatgccggtagtcccagctactcgggaggctgaggtgggaagatcgcttgagcctgggaggtagaggttgcagtgagccaagatcatgccactgcactctagcctgggtgacagagtgagactccatctcaaaaagaaaaaaaagaaaaaagaaaaattgctcatattctaaatgtcataaagggctggatacagtggttcacacctgtaatccaagaactatgggaggccaagccaagaggattgcttgaattaggagctctagactagcctgggcagcacagtgagatcccatctctatttcaaataaacgaatgaatgaatgccacacaggcaaaacagaagttctctgaacctgatctgcaacacaattcgccagctggaaggacctctgcagtggaaatcctcgctcaaggcctggtccaggtgtagggaggcatcaaatgtgtcgcagggagaggcactgggcactctaaatgcacctgcttggcaggtccccagtagtaccaaaaaggcagtttagatctattattcataacagccactgtatttattgggccccttgtattcatcaggtatcaggccagacagcttcctatatagaccatctcactgtctcctaagcgctctgtaaggtggcatcacctgctattgctattttcctgctaagatgaccgaggtcctggaaggtaaatgcaagacccccacttgtaaaatttggagtcaggagtacaatccagaatctaatcctagttttctgctaagagtaaatggacacccgattaattcttagcagaaagtccctttcttgcccctgaccctactccaccatttctaccctcccctcaccattcacatccccccacctcccaagggcttgttcccaagaaagccctacttcacttttacaggaaaaaaagtgaatggtgaacctgtcacattcttattgccttgtgacatctgcctaatcatctgaataccaatggtttcaagtaactccagaaagaagttctcttaatgcataacactattttttcctcccaaccaagagaacttggttggcaagagttacggtagcccctgtgaaggatgcttctggaagcgagcaagaactgattatttctggccctaaaagccccactgtgttttatattttacaattctggcataccacagcttaaaataaatgtatagtctcctatgtcaggggtccccaacccttgtgctgcagtatcagtcaatggcctgttaggaaccaggccacatagcaggaggggacggtgggtgagtgaccatcactgcctaagctccgcctcctgtcagataagcagcattagattttcacagaagcacaaaccctattgccaactccacctgcaagggatctaggttgtacgttccttatgagaatctaaccaatgcctgatgatgaggtgggacagtttcatcccaaaaccatcctccccactccaccctggaaaatattgtcttccacgaaaccagtctctggtgccaagaggatggggactgctgtcatatgtgactgcaacaagttgcaatttgcaatgcctttttttttttttttttgagaccgagtctcactctttgcccaggctggagtgcagtggtgtgatctcggctcaatgcaacctctgcctctgaggctcaagcgattctcgtgcctcagcctcccgagtagctgggattacaggtgcccacgaccatgcccagataatttttgtatttttagtagagatagggtttagcagagaccatgttggccaggctggtcttgaactcctgacctcaggtgacccacctgctgcggcctcccaaagtgctgggattacaggcgtgagccactgcacctggtctgcaatgtctttagccagtcatttgcaatatctattaattttagatacgcatgccctttaactcagcaagcgcatttctgggaatttatcctacagataaattcatataattagacaaaaagtccaaggatgaaagagtggcattatctattattcccattttcctgctaagcctatcggggtcttgaaaggtaaatgcaaggccctcccttgcaaaagttggggaaccaggattagaatcccgatctgtttgaagcctaatttactcagagatggcattagcgatgtttgacacatctgaatatgtcagccctattcacagtcctgtcctaacaactcactgcttcatcccttgagcacaaacaagctattcattagcctgtggaagatccttaggtcttcgagttacaagtctcagctctgcccaaaactcgctgggtgatgctaggcaagtcacttgccctctctgggccttgtatttttcagcctggtacagtaaagttctatgcccctcaccttttttttgagacagagtctcactctgttgcccaggctagagaacagtgatgcaatcagggcccacggcagccttgaactcctgggctcaagcaatcctcctgcctcactcaacctcctgaataactaggactacagatgcatgccaccatgcccagctcattttaaaaatttttttgtagagatggtgcctcgctatgttgcccactctggtctcaaactcctgacttcaagccatccccccacctcagcctcccaaattgctgggattacaggtatgacctgccatacctggcctctatggccctttcctagcaactttgatgaggttgttcctccttagcccctgaaaccctgatacaagtcacagatgtccgacctcccctttcagccactgtgagcagcttcttcctctgtccttggatcacatacaaggtttctttcaaattcttgcctgcctttctctaaattcagtctttcctccattgtgtggccagggttaaaagttgaaaggtcaggagtggaaggagaagacctagagagcaaaaaggccatcccttaaagtatgccatcaagaccctaaataagccaggcgcggtggctcacgcctgtaatctgagcactttgggagaccaagccaggcgaatcacttgaggtcagcggttcgagaccagcctggccaatatggtgaaaccccatctctactaaaaatacaaaaaattagccaggcatggtggtgggcgcctataaacccagctactctctactcaggaggctgaggctggagaagtgcctgaacctaggaggcggaggttgcagtgagccaagatcgcaccactgcactccagcctgggcgacagagcaagactctgtctcaaaaacaaacaaacaaaaccctaaacaaatgtaattggaatttgtaacattcccaatccaggtaaggaatggtagcttaatatattaaagattctaatcaccactttcagcccaaatagaaacgaggtttatgagatcaaagggaagaaaattaagagaagcttctcctttaacggccacatagtttaggcttcccggttctgccaaagatgagccatgccatactgagcaaacatcttgaactctctggttgtgtttgctataaataaccatcactgaagcttaccaggggccaggcactgtgctaaacccttcatacacattagctcatcaaatcctcccatgagggtaatctgtgaaactctggagttagaaagacctagatttgtagaatcttcttttccttactggttagctgagctatcttaagcaagttattcagactccatatgtgtaaaataaagccagttagaataacagtatctactctaaagggttgttatgaagacgtaagataatgtccacaaagcgtttagcatctcgccaggcaaaagtgcccaaaaaacatgagttattctcattagccccatttcccggatgagaaagtgaggtttggggaggtgcgggagatgatttttaaatttgcttatggccttctatgattctactggattgaatattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaactgacgagggggccggggatggcctcatggaaaacgcttccataaatgggcatgtttgcctcaatctctgccctcccacggaaaagtaatgataacaaatccataacagataccttgtacggaataacacatctatttcggacatgataataaaaaaacatggtgtttacaaggcaagcctggcggcttctcggaaaagacccagctagttcacgttctggactctcggcatggcagcccacctagggtcactggtttcagctaggtcaccccctcaatcaggggacaaacagtgccttttattttaaatgtgcaaaaagtcagtttatgttttcttcaaaggacacggtgataaacatttactttgttggaagcatttagtcccaccagaaacctgaccccaacaagtttgtgtccatggtaaagaagaaagatagtggggtcaagggtatgaacttggactcaaactgacccgggaatgggttctaccacttgctggctgtgtgacactttacctctctgagcctcagctgccttgtatactaaacaggcatcataaagcctttcttatgaagttgttgcaaagattaaatgagataaattaagttaaatgttgcaacagcatgtggcactgaagtgttccatcaacggtagctatctcaaagggaaaacatcaatttccttcaaacaaaattctctatcttatttcacaccctgccacctaatgactttcagttcagcgtcaagttccgtctctgaacaattctaaaatagtatcgttgagtaaatcaaagaaacaaaaaactatgcaaagcagtttattaatagcctgcattctttttgccaaaccccggacggacagttcaccatttaatctctcagttcttcatactgcaactaaacactcccaccttgggtttctaaatattttcttttacttcttgacaagcatggctttggatggtaccttttctcaagtggcaaaatccctaccagaccctgtgctggaagaaaacttacaacaggcagtagccacactttctctcgttttacccatttggttgggcacgagagtggcattgacacaggtggctctgcgggaaattctagtgtaatcttacctaacgcacctgcagatcgtggaagcaaatggagactttggagcccacctgggtatctgggggccctttggggtcaacctgggtgagttgttttttttttttttaatttggagaagaggaaaaagtgggctgtaacaaactagatcacaaccagccttatctcccaggggttctcaacatagaagaacctcccctaaactgattaaaaaaaaaaaacaacaacactcctttctgctaagcctatgcccatgtgtttttaactgatttaatgcattatcaacacaactgtgcaatacggtcaaatccacaaggagcctcactttgcccttctgtgtgatagcaagtgacttttcagtgaagttcagctgtaaattttttggtgcctagaataaaagtgagatgccttgattgtctgcaccggacctctgagatttccaagggagcatatctcctggattagcctcttaacaagaatcactcgggactaatttttttttttttaaggcagtttttctggggattctagagttgggaaatggagttgggtccaggcattgatatcgttaataagcacccccaaaatggtacttctcactggcaatcttaagaaatgctgtttggggaaagtctaggataatctaagacgataaggcagagagagatccaaatcacaactctgcccccaccatggcccttacgaggttgacaacagggacccctaagtgcaccccagcccctatagaataccctataggacttttaacacccccctgccctgcaatctgcccccagaatgacaactactacttacagatctccaactggggggactagtggagaggaaactggatggcgagctcggatctgacgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaagagggccggctgtgcagcgtgaagggtagggaaaggggatttcttgaactttgcaaagtgcaagacaggaggcccccacccttgctgggaaccgtgcaggaaggggaagtttttacttttcccaacttgccatctccacctccacccacatcaccacgaccaaaatacaaataaaaattaaaaataagcccactgtgattatttcagctgtccccctcccctgtgcgccactcgccagctgcgtgaccttgggcaagtcacttcacttctctgagacttggtgtccatagctacaaaatgggggaaggcggtggcggtgataattacgttatttacaagatgcaagtgtcaagatccaaggagaaagtgggtgtgcccccagagtctgcgagttcccttcaacaacttcccttccccaaggattcctcgcctaaaattgcattccctgtctctctccatcacaggctctctcgctctgtctctgccactgtctctgcatgtctgtcactctgatcattgctgtctctcgctctatcttttgtctctgtccctctcgcttctctagatctgtcgatgtatctgtctctccctcctgtctcactttgtctctggtctctgtgtctcttgctctccatctctcccgcgtgtctcactcctatctctgcgctttctctctctctcttccccaggctctccgtcttctccccgtccctccctccccgctcctgtccacgcacgcacacacaggccataaaaggaagtcgaggcggtgggctggccccgcgccaggccggggacccgcgggcagcccgggcgctccgctccccgcgcggcaccagctcctccgaggttcccgggccgggccgggccgggccggtccccctccccgggagcggcgggagcggcgggcgggagacaacccaaaaagggcaggcgcggactccttcctgcaggaattcccagcgccgcataccagctctgggctgccggctccccctgactaaatatggtgccgagtggccttcctgctccccggcgtcgggggagggggcccttcacgcagccaccggccgccgttgccccgcggggctagatggggacccctctgcttggggaaggcccggaagggggcagcccccagtcccacgtgggtttctgctgcttcaggctagaggatttggagagagggttaaagttgggcagacccctcctgggttctgtacttgacgcaggcccttagtctacaaccactcctcttgcaaccaggtggaggggctgggggccgggggtgcggggggtggctttattaatacccccattttgcaggtgagaaaattgagtccctgcaggggtaaagggatttgaccaagctctcactgggacagtcattgattggtgctggcactggaacctttctgatgacaccattcacttccagagaggagacattaaagggaaatgcccaggcaaactggccttgaggcccagggcgtgtatctgagagtagatgtctggctttgaatctgccagtgctgctttctacctatatgaccatgggcaagtaactttgcctctccatgcctcaatttccctacctgtaagatgggaagaacatcagctacttcctggcctttttgtaagcagtccttgagatgatccatgtaaaatgaacatggtgcaccgcttcatgtgagctgctgttactcgcaacaaacatgaaaccaactagagttgcaccaggcctccgggatataaagagaggcctcttcccctgcaggctcccaggcccatctggagagctctgcatctcagacccttttgggtccttcttcatccttccaacatcaagcttacctggttttcaccctggaaactcctgagcctggccctcaccctgcaatgggcctagatcagagagtcaagaacagcctgcatttagctggctggggaagtgaggggtaaagctctgcggaaaatgatgaatgagctgctccgcacaggcttttaacatctacgctgtaaaaggagtggaaatcgtccctgcatcagcacagaaatgatgtggagcagagaagtaacggaagggggaaaattgaagtcaatcatccgcttcccatcctggaaagggaaggccatcggaatctagcttgctggcctcgaagtaaaaactggcattaatactagaggcatgaacactgtatttccaaagggttccattcgattctttaaataacttgttggtaacttttaaaagagaataattataatgtgattaacaactggagactgtaacactcaattttacttcattctctcacctaccccttatataacaaccctttattaaaaattaaagtaggcagccgggcacggtggctcttgcctgtaatcccagcactttgggaggccaaagtaggcggatcacttgaagtcagaagttcaagaccagcctagccaacatggtgaaacccccatttctactaaaaatataaaaattagctgggcatggtggtgcacacctgtggtcccagctacttgggaggctgaggcaggataattgcttgaacccaggaggcagaggttgcagtgagctgagattgtgtcactgcactccagcctgggagcctggatgacagagcaagactccaactcaaaaaaaaaaaaaaaaagcaaaactaaagtggccaaggccaggcatggtggctcacaactgtaatcctagcactttgggaggccaaagcaggaggattgcttgagctcaggagtttgagaccagcctgggcaacatagcaagaccctgtctctacaaaaaataaaaagttagccatgtgtggtggtgggtacctgtaatcccagctccttgggaggctgaggtgggaagatcacttgagcctgggaggcagaggttgcagtgagctgagactctgtcactgtactccagcctgggtggcagagtgagaccctgtcttgaaaaaaaaaattttttttaagtagccagcctgggcaacatggtgagatgcaatctcaataaataaataaataataaatagcagctgggcgtagtgtagcctgaagttccagctactagggaggctgaggtaggaggatctcttgagcttggaaggttgagactacagtgaactatgattgcaccactgcactctagcctgggcgacagagcaagatgttgtctctaaaaaataaggtacatactttaattccctccctacccccattttattgttgagaatctaggtttggaggggttaaataacacagcagtggtggaacaggaattccaaccccagtctttctgacacaggccatagtagacagcagtctgaggttttaaacccagatctcttaagcaccaaccaagcacctttgggattgtcagtaaacctctctgagcgcattttctcaaggaaaaacaaagatgatcagattctttgcctcaagtacctttctgattgttaaatatgacagcacatgtgaaggcctttatgaaccatctccgacctctctagtaccctctggaagcaggcagggacagtatgttcacttaagagtcattcaatagatatgtgtccaatgcatgaagttccgatgtttgaatcttcagaagtgcattgttatcattcgatcagatgcctctgtttcatttctcatggctcaaaaggtcagttcttttaagatggaggaggcaatagtctctttttaaaatgtcactttgactgagtgctgtcaagtaattttccttggcatatctttttctgtgaccggctgtttaatgggagtttccacgaatccatgaaacaagacagccaaggggaaatttctctcttatagtctttttttgctgttggcttaaaaaagccccaaagtggctgggcatgcctgtaatcctagcactttgagaggctgcagcggaaggatcgcttgagcccaggagttcaagaacagcctaggtaacatagcaagatccctgtctctacaaaataataataataataataataataataataataataataataataattagtcgagcacagcagtgtgtgcctgtagtcccaactagagagtgaagtaggaggattgtttgagccccagagtttgaggctgcagtgaactgtgatcgtaccagtgcactccagcctgggcaacagagcaagaccctgtctcaaaaaaacaaaacaaaacaaaaccatgaagtgtgatcccctccaatttttagtaacatcgaagattgggtctgagcatggcttactcctgcatgtgcctcaagatttaatattttttggccgggcacagtggctcacacctgtaatcccagcactttgggaggccaaggtggagggaacacttgaggtcaggagttcgagaccagcctggccaacatggtaaaaccctatcactactaaaaatacaaaaactagtcgggtgtggttgtgcacgcctgtagtcccagctacttgggaggctgagacaggagaatcccttgaacctgggaggtggaggttgcagtgagccaagatcacaccattgcactctagcctaggctagagagagaggctccatctcaaaaaaaaaaaaaagaagatttaataattttaaagtgttatcagccttgatctacttgactcatatagagtcaggtagatctggcccaagatctgtgaataaaggaacatcgttcctgaccacaagcagggccatgctccaactcttgcacaaaagcacttttgtttcactcatggtggcccccatgatggacctcacacttctcccgatactagactgcattgcatagtaacctgcaatgctctttccttcatcatcagtttccaattctgatgtcacgatttggttcatgacattcctgatagattctctatgtctatcaggaagggtcctaaaactctcaataaaagtagttctacagttttttaaaaatgaaacacacagggcacggttgctcacgcctgtaatcccagcactttgggaggctgaggcaggtggatctcctgaggtcaggagttcgagaccagcctggccaacatggtgaaaccccatctgtactaaaagcacaaaaattagccaggcatggtggcgggcgcctgtaatcccagctactcaggaggctgaggtgggagaatcgcttgaacctgagaggcagaggttgcagtgagccaagatcatgccattgcactctagcctgggcgacaaaagtgaaactccgtctcaataaaaaaacaaaaacaaacaaacaaacagaaacaaaaacaaacacgctcttaccatataatccagaaaattcttcttaggatttgcccaaaagagttgaaaacttctgtccatacaaaaccctgcacgcacatgaagtttataacagctttactcactatcgccaaaacttggaagcagccaagatgtccctcagtaggtgaatggatacataacaatggaatattattcagtgctaaaaacaaatgagctatcaaggcatgaaaagacgaaggaaaattacagctgggcattgtggctcatgcctgtaatcccagcactttgggaggtcaaggcagatggatcagctgaggtcaggagttcgagttcagcctggccaacatggtgaaaccctgtctctgctaaaaatacaaaaattaaccaggtgtgatggtggacacctgtaatctgagctactcaggaggctgaagcaggagaatcgcttgaatcagggagatggagtttgctgtgagccgagatcgtaccactgcactccagcctgggtgacagagcgagactctgtctaaaaaaaaaaaaaggcaggaagaaaacttaaatgcttgttactaaatgaaagatgctaatctgaaaaggccacgtactgtacgattccaactatacaacattctggaagagacaggaataggtggagtagagaagattttctagggcagtgacactcctctgcatgatactaaaatggtgaatacatgtcactagacatctgtccaaaaccatggaatgtgcaggcagtccccaacttataatggttaaacttaacgatttttcaactttatgaaggtgggaaaatggtgcattcagtgaaaccgtactttgaataccgacaaaaccatgttttttcactttcaatacagtattcaataaattacatgagatggtcaacactttattataaaataggatttgtgtttgataattttgcccaatggtaggctaatctaagtgacctgaacatgttaagtaggctaggctaagctaagatgctcggtaggtgaggtgtattaaatacattttgggctgggcatggtggctcacatctgtaatcccagtactttgtgaggctaagatgggcagatcacttggattcaggagttcgagaccagcctgggcaacatagtgagatcctgtctctacaaaaaatacaaaaattcaccaggtgtggtggcatgtgcctatagtcccagctattcaggagactgaggcaaaggaccacttgagccttggaggcggaggttgcagtgagcccagatcgcacaactgcactgcagcctgggtgctagagtgagaccctatccaataaataaataaatgcattttgacttattttcaacttgtgatagttttgagatgtaatcccatgagtcaaagagcatctgtacaataccaagagtgaaccctaatgtaactatggactttttgtgataataatgtgtcaaaatagatccacccattggaatacatgtgccactcgatgccggatcttgacagtgggagaagctagacatgcatgggtgcagggggcagtcaggagctctgtgcttccagtccatttagccatgaacctaaaactgctctaaaaaacgagtctacttttataaaagtagttttgttttgttttttttttccagagaatagtctcactctgtcgcccaggctggagtgcaatggcgtgatctcagcgcactgcaacctccgcctcctgggttcaagcgattctcctgcctcagcctccccagtagctgggattacaggcacatgccaccacgcctggctaattttgtattttttgtagaaatagggttttgcgatgtttgccaggctgctctcgaactcctgacctcaggtgatacgcccgccttggcctcccaaagtgccgggattacaggcgtgagccaccatgcccagcctaaaggtagcttttttttttttattttttattttttgagacggaatttcactcgttgcccaggctggagtgcgatggctcgatcttagctcactgcaacccccacctccacagttcaagtgattctcctgtctcagcctcctgagtaactgggattacaggcgcatgccaccgcgcctaattttttaatttttagtagagatggggtttcatcatattggtcaggctggtctcaaactcctgacctcaggtgatccacccgcttcggcctcccaaagtgctgggattacaggcctgagtcaccaagcctggccagcagttttatttcacttttattttaataagattcctgaacaccacacaatcctcgaatcgtggttgttaccaaaaaatcaagtaccaagtggccgggaagcattgtcccaaatgcctttaaaggcatattctcacaaatgttcatctttcatgtacacttggctttaaaagaacacatcaaattttacatcaacataaaggtatgtgagtgatacacaaatgtgttcttgcacatcattataaggctattagtttgttctgtgcaagcatatacactaagcttaaatttatcttcttcaaaagccacctctgctcctgctatgaggttttagatcacccaagttgtacatttcctaaatccctcttcagttcccattcccatcctgtttttgtgtaaatccaagttttctcctaaaacttctggagcatctctagaagataagttctcccgacaattccaagaaacccacgagtaaggtacttaaatataacacatttatgagaagggttggcttgtcctctgtgcttttccttccttcctataaacatgtgcagacggcaggaaagtacccccgcctccacccctcaacagcgaagcttctgaagatcccgacggaaggcatggcagccatctccaatcattcttctgtttttgatgtgtggcttttgatgagagaacagtgatatgaacaccctttgcaccaaagtgacttgcttattttttttattaaatgatacattgaaagtataaaaagttgccgcagtacaaacaaattacagaataatgcatataaaagcgctatggactacacgtgacaattctgcttaacttccatcttgatgattttatatcagtatccaaaattatatactccagcattttttccgaatatagtcttacatgattgcaattcctgaggtaaactaagtgtccactgccaacatccttggacgaaaaccaagtcccccgggagaattcagatatttatattcacacatacaatacaacggaattcatcaatgtaatcagatattgcagatttaaaaatggaaaatggactcttgcaatacttctgcatccatatataattttaccagcagggcctcccaaaatgttgtgtaagtatagtttaaatggatttcattaataagtttctgcatttagataaaaattcttggctaatctgtaagaagtgaacactgactagcattgccaaacagaaaatcaaaagtttcaacaatttgcaaagcagcacagaattgacaccctaaagaggatgccaattttgctaactacagctcttaccactcttctccatggaaaacctttaagctaaatgttgtcagtgtttaggtgtgcaggcaaaatttaattctgaatataccatcgaacttttgccaatcaggagctgtctatcatcatagtcagttgttttcaatgaaatgagcctgtggacactacattaaaaatacttctttaataaatatcgaagtagcgtattagagatagcacatactatttttctatcccaagaataaaaattgatgtttggtaagagtttcggagcccaaacaagtagggggctggccctcttctggctcatctgtgattgcacaaccgagggccacacggagattaaacaatgccatctttgaaaaatccctttctggtatttctcccaaagcctgtctcttcatgcttacttcacattctttatctaataaaataaactctttgttttatttacagcaaaattattacagcaaatttacttctcctctaccttttaattaaatcttccagtaagccaaagtctaaggaaagaaaaagtacattgttgcctattgaaaaggtaatacaaagccctttcatttccttacaaactttaagggcctttataatacttcctaaatggctgggctcagtggctcacacctgtaatcccagcgctttgggaggctggggcacacagatcacctgaggtcaggagttcaagaccagcctggccagcatggtgaaaccccatctctactaaaaatacaaaaactactccggtgtggtggcacaggcctgttttcccagctacttgggaggctgaggcaggagaatcacttgaatccgggaggcagagattgcagtgagccgagatcgtgccactgcactccagtctgggtgacagagcgagactccatctcaaaaaaacaaaaaatacttcgtaaaaacaatactttttttttcaagtcaaatccaataagctagatgacaagagttagcttttattcacaaatgtagttaaacatgaggggtgttttgtagaaactccaatttctacaaacattagtggtgcattttggtaacattgggacaataaataagttatttaattaataatacaattttaagacaaaagataccccaaacaaagcattatctgttgactgcctgagaaacatgaagatcttcaatgttagtacttttctgttcctcctttcttaggtggtcatctgaaatgcacagaaaccaatgttaatacttatcccaagtcaaaacacacagataggtagacatagctacaaatatcttaggatgttacatatttaatattctatgagtactttagatggtttaggacaatgaaaaaaacccattattttttaaacactattgaagaaatcagaggccaagcgtggtggctcacgcctgtaatcccagtactttgggaggccgaggtgggtggatcacctgaggtcaagagttatagactagtctggccaacatggtgaaaccccgtgtctcctcaaaatacaaaaattacccgggcgtggtggcaggcgcctgtaatcccagctactcgggaggctgaggcaggagaattgcttgaacctgggaggcagaagttgcagtgagccaagatcgtgccatttcactccagcctgggcaacaagagtgaaactcggtctcaaaaaaaaaaaaaaaaaaaagaaagaaatcagaaatgtctggcattagggactctaattattcaaaagagtttcttgactttttttttgagtagagtacaacctgcagtaaacccatgcataagtagttacaaacctctctcttacatgtaaggaatgaaatttgcaagaaaggacaaggtgttcaatcagcattttgagggttgccaaagctcttcaattacaacacaatgaaaaccacttcaaatagatcacctgaggtcaggagatagagaccctgtctctactaaaaatataaaaattagccaggcgtggtggcgggcacctacaatcccagctacttgggaggctgagggcaggagaatcgcttgaactcagaagtggaggttgcagtgagccgagatcgtgccactgcactccagcctgggcgacagagcaagactcttgtctcgagaagaaaaaaaaagaacctagagacttaatatcctaatgcaacaaaaatgtaatgcaaaaactagattcttgagaatatatgaaccccaaacactttctacaactgataaaacatctttcttgcaacaactttgataataggaaaaaatatatacataaatttagataagctgctagaaaatgcaattttatcactgggttttctaattctacaatgtgattatacacacgctttattagttctcagctgcttattctcagtgccaatactactttaagggtctggaaaacagatggaaatctctctccctttattttaggtaactttgctggacagaaaaaaaattaacaatttcctcagaaggtaacaattttaggtcttctagaaaagtgttataaaaaatgaagtctactatgcttgatagatgtgcaataaagttaagctgatgactgtccctattataaaaatctggtctttcatttacaataaaaatcttcgccaggaatgtagtcccagctgtagtcccagctacttgggaggctgaggtgggaggatcacctgggcctgtgaggtcaaggctgcagagagccatgattgtgtcactgcactccagcctgggagacagagtgagaccctatctcttaaaaacaaaaaaaaaaagaaaaaaaatgtgtgtgtgtgtatatatatataaagttgaatagcaaaaactactttgccttcaagattacaagcactaacagcagcagtacaaatgcactggctgtcatttcaaaggtgggtgtgcctacataaaccctcttcattttttttcagcactgaaaacttggatgagagaagcactttttcatcttggcatgctttggacttacttctttctttccttttttttttttttttttgagacagagtctcgctctgtcgcccaggctggagtgtagtggcgcaatctcggctcactgcaacctccacctcctgggttcaagcgattttcctgcctcggcctcccgagtagctgggactacaggcgtacaccaccacgtccagctaatttttgtattttcagtagagacagggtttcaccatgttggctaggctggtctcgaactcctgacctcaagtgatctgcccacctaggcctcccaaggtgctgggattacaggggtgagctgccgtggcctggcctgaacttattttcaagtaaaagccaatttagtttcagggtttgatatttctgttgaatgagcttctgtggagacaaggtgctgtgatgtagaataaggattttagtatcttcataaccttttcaatgctgtcaaataagagttacggagacagtaagctagagttgaggaagtaaatggaaagcttaagtgtgttactgaaacatgatgcagttctggctgacaactttcaaggcactacacaaagaggttgtgtcaataaaatttttgatgaccaagaaaataatttgcaaaatcactgttcttccccgattcattcagcagtcatcctcatttctgagctgtctgcagagctttccacagaacaggcacccaaggtggctttactgacttgaactcgattctgatgttcctggcactttagtggtgtacaggtcgtgtgtctaggtgtctctttccctccctccctccataaatacctttctctctatggtgtatgcgtaatctaccgctttcatctcagaagaacagaaattggttaggaaatagtgttccttataactttcttactagtcatgagccgtgagtattaacaaggctgattatgaaacttacaaaccagaaagttatttctcaagcggttatttttctttatgggactgatagtatcaatgacttggggttgctgtgttaagaagtgttaaggtgtacaatatccactggtgacaactgaactcagaaactcatattgtcatatattcttggtaagtgtatagactgataaagcctttttggaggggaattagacaatatctactacatttttaaatatgcatatcctttgaaccaacaactctactttaggcatccacacaagagaaacgtgtagacaaagatacaatgttacatcacaatactgtaatgtgtggacaaagatacaatgttacatcacaataccgtaaaagcaaaatatttaaaactaaataagagtgattataaggtgggagagtagcctgggcaacaggacaagaccctgactgcaaaaaattaaaaaataagcgaggtgcagtggtgcacccctatagtcccggctacttgggatgctgatgtggaaagactgatcccaggagtttgaggctacagtgagctatgattgtgccactgcactccaacctggatgacagagtaagacctcatctctaaaattaaaaaaaggatgattgtaataatactctggaatatgaaacaaagttaaaaacgagatctacacgtatcaacaagtaaaaaaaagcaaattgcaggataacgtgcaccataacaatgtatatatatttaaatacacagaaatgagtcccgaaggggctgggcatggccagatgcagtggctcacacctgtaatcccagcactttgggaggccaaggggggtggattgcctgaggtcatgagttggagaccagcctggccaacacagtgaacctcatctctactaaaaatacaaaaattaggcgggtgtggtagcacatgcctgcagccccagctacttgggaggcaggagaatcacttgaacctgggaggcggaggttgcagtgaggtgagattgtgccattgcactccagcctgggtgacagagtgacagtccatctaaaatttaaataataataataaaataaaataaaataaataaaataaaatagaaatgagtcccaaagaataccctgcaaactgctaacagggacaccttctataaaaagggagaagaattgaggagttagggagaggcaagaaggaagaaaggaaagttaaagggaactttttactatttaaaaaatttagagatttactcatgtacttgcactattaatgttttattttgctcgttaagtacttgccaattagtaggcagtaatgtcagttccttaccaatccctaaaaagagaatttggaaaacttctccataatctatatgtggaaaggtatacgggaacagcaatcaaatgtgctgattctgctactaattatctgctacaggtcttagttgagttacttaacctcttagtattggaaccttcttaaagttttctcaactatgaaataagtagatgggaatgacttattttccaacgttccatccagttcagcattctaatatatatagaaagatatctcctagtgcagtcagaaaccacctccaaaataggttatcctgattcactgtttactttcagacctcaagagacaccaagcatctaacacggtcactactggtcatagcagtttaggaaactacaaaggcaatccacattttaggcgtttcctaaaagtttcctaaaagttcgtgtcaacattcaagatttacatttgttctgataattggcagcctaaaccccacctttaactgtccttaaaaattgaccagctcttggttgggcgcggtggctcaagcctgtaatcccagcactttgggaggccaaggtgggcggatcatgaggtcaggagatcaagaccatcctggctaacacagggaaaccctgtctccactaaagatacaaaaaattagccgagtgtggtgatgggcgcctgtagtcccagctacttgggaggctgaggcaggggaatggcatgaacccaggaggcagagcttacagtgagacgagatcacaccactacactctagcctgggcgacagagcgagactctgtctcaaaaaaaaaaaaaaattgatcagctctctaccacaactgaaaacactgagctataacccactcaattcaaatggtgaaaatgggatcccattgctgggataatcaaaataagtcagggccaggtacaggctcgtgcctgtaacccccacactctgagaggctgaggtgggaaatcacttaagaccgagttcaagaccagcctagtgaacacggttgagacttccatgtccacaaaaattaaaaaattagctgggtgtggtgcctgaagtcctagctacttgggaagctgaggcaagaaggtgagaggattgcttgagcccggcagttcaaggttacggtgagctataatagcaccactgcactctagtcaggcgacagagtgactagaaaaaatacataaaaatttatgtatttttatgtctcaaaaaaatacataaaaatttatgtatttttatgtctcaaaaaaatacataaaaatttaaaagctaccaaaagctcatttaaaaaacaggcaatctgaaagaaatgtgggcgattctcctaacaatctgtaacttgtaggtaacttccactgtaacataaacagtatcctaaaaatgcaaatgacttctctatctgtatttagcaatcttaccttttattttgcagtcatggagaggaaaaaaaataatcacttgataaaaagctatttattcagtataccaaggatctaagctgctccaaatacttacaatttacatgaaaattggagttttcagtatttttttgtttttttttaaatttaattaatataattttttaattaaaaaaatagagatggggtttcaccatgtcacttaggctagtctcaaactcctggcctcaagcgatccacctgcctcggcctcccaaactgctgggattacaggcatgagccattgtgcctagcccagagttttaaatacttctataaagaaattacatctaagaattctgcccagttatgcctcccacccttccctgtccaagattctttacaaaaagcattctgtttcttggagtaacataggctagacatattagatataagcagaattaaactatgactcaaaagctcagtaaagactccaaaagaaaaatatataggaagaaaacatatttgctgacagctaaatgatgaatcttggaaaactcatacccattggctttcttctactaggttgtctgccaagacttgggtctgaaggctgaagtgaaggccctttcagaaatgcattctggatgccatccttagttccacgcaagaaatgggctaaaatcccatataaaagaggtctatagcaggaagaaaacaaaacaaaaccaaaagctaataaatctgcataaacgggaaaagcttaaaacatttattctttaaaaggtaacctctgacatcaaaaagaccaagtgattcactagactttaaaaagcggcatgattatccaaaatgcaaattgttcatacttttaaatttaagagtaccacttaatttcatgacaattttaaaacccagagaaaacatgttaacaacttaaacctcatctacactgaaatatcatttctatcaatccacaggaatctcttttaaactccaaagtccagtagagtatttcccaatacctaaccccatctaatacacaacaggtattcaataaacacctcttgattaataagtccttgccctgaaaaagtcttaggtcctgagagccaggtgacctgagttcaaattctggctttgccatttgctagctgtgggactctgtgtaagattcttaacctctccagcctcataaatgtttcttcctttataaattaggataagcaccgtccctcccttatagggctgttatgcactaaatgagttaataaatgtcaagtgttttttactgtgcctggcacatatgaaatggtatataaatgttagctcctgtgtagctaacatttatttagattaatatttacattacctattattttaaaatcttctttatagtttacagaacgtatacctcttctcatctaatcctcatcgtgtaatgtcaagatcatcaactgcaatttataaaggagaaaaccacagccaggagatttgctagagattcccccagatagtaaacaaagtttacacttgaaccccaaatcccatattgttttccttacagtgtgctgcctgggaatttatattagtactcttgcatcaaggaaagctgctctgctgacaatcaagagtggtacaatggaaatgttttcctttgtttccaatctcaaatttgaaaacacaattaaaaggatttaatctttatttttaatttttgtgggtacatagtaggtgtatatatttgtggggaggatttattttttgagatatgtatctatttactagctggtataatggtttacagtacgacgctcccttccaaagatggaatctcattgccctctgagtgtgagctgaactcacttctaactggcacaaagctgacttcagaggccacgtggtaatggccctgcagcttcctccttgctttctctcttggattgctgcctttgggagaagtcagatgcctcaggacacttcagcagccctggaaagttacatgcagtaaggaattgaggccgcctgtcaatatcattatgagtttggaagcagatagttcagccacattcaaggcttccgactacaaccctggctggcatcttgactccaacctcaagggggagcctgagctagacttacgtgactaagccaatcccaaatccccgaatattccacaaataatctatgttgttgttctaagctaccaaattctggaataatatcacactaatttttccatgccacagggaaaccaggaaagtaagtttctttatttaataagatgccgcaactcttatgaaagcgtcacctagtaatataaaacaggtctctttgtttactttaatcttccccaaagtgttaactggttcaagatgatttttaaatgttaaaagttttattttttaaataaatattcaaaaaaatgtacttgtgattaaaattttgggttggacatgggggctcaggcctgtaatcccaggactttggggggccagcctggcctcaaacaggagtttgagacagcctgaacaacatagcgagtcccctagctctacagcaattttattttaaattagccacagaaggtaatatgcacctgtggtcccagctacttgggaggctgaggtgagaggatcgcttgagtgcagaagggagaggcaacttgcaaattcatggattaaggtttatcttttaaaataagtttcaaaaagataaagaaaagtgcggcctcacaataacttgcctgtaattctgaaatgcaaaattctgaaaactggattctcttcatatatctggcaaaaaatcatcagatggcaagggttgacctaacaaggctattaacaaggctattacagactttatcttactttgtgtgaaaacattaatgtgctgggtgtggtggctcaagcctgtaatcccagcactttgggaggccaaggcaggaggatcacctgaggtcgggagttcaagaccagcctgaccaacatggagaaaccccgtatctactaaaaatacaaaattagccgggtgtggtggcatgctcctgtaatcccagctactcaggaggctgaggcagaagagtcacttgaacccaagaggcagaggttgcagtgagctgagatcatgtcattgcactcaaaaaaaaaaaaaaagagaaagaaaatattaatgtgattgtggaatactactttaggactccctggcacatacatgtagtatttggtagatgtaccatattactttttttttttttttaaagaattgaagtcttgggccgatggctcacacctgtaatcctagcactttgggaggccgaggcaggaggatcatgaggtcaggagatcgagaccatcctggctaacacggtgaaaccgtctctactaaaaatacaaaaaattagccaggcgtggtggcatgcgtctatagtcccagctacttgggaggctgaggcaggagaatcgcttgaacctgggaggcggcagttgccgtgagccgagatcacgccactgcactccagcctggacgacagagtgagactctgtctcgaaaaaaaaaaaaagaactctcgctgtgtggcccacactggagtgcagcagcaagatcatggctcactgcagcctcaatctcctggatttaagtaatcttcttgcctcaccctcctaagtagctaggactacaggcatgtcattttaaaacccgacagcatttggattttcaaacatgtatctggcctcagtggtttcagatgcagcactgcagatctgtaagtaaataatatgagtaatatgtgactatggcaaactctgtgaatgccaatcactgaagtgtgagaaacaagggcttaaagaagttacctaacttttaaaaaataaagccgttttagcaacttttttttttgcttcctcatcctctctcaaacttacttttttttttttttttggaaacggagtctcgcttctgtcgcccaggctgagtgcagtggcacgatctcggctcactgcaagctccacctccccgtttgacgcccattttcctgcctcggcctcccaagtagctgggactacaggcatccgccaccttgcccggctaattttttgtatgtttagcagagacggggtttcaccgtgttagccaggatggtctccatttcctaacctcgtgatctgcccgcctcggcctcccaaagtgctgagattacaggcgtgagccaatgcgcccggccttcttttttaaaaaaatatcaaacatttcacgaatttgcgtgtcatccctttgccggggccatgctaatctctgtaccgctccaattttagtttatgtgctgttaaagtgagcacaaacttcttaatactttcatctgaagtaggtatctcaaaagctaccaagaagccagtaatagtcattgcttatttccatcaactgctaaatgtaaaatgatgtcttgtattaaatgatgtaataactcactgctcatcctaagtcacgcttagattcccccaattatttttcccactgttctcaattatacaatttttatacttttcaaaacacttgttaccaggtgcagtggctcatgcctgtaatcccaacactttggaaggccaaggtaggtggataacttgagctgaggaattggagaccagcctggctaacatggtaaaacaccatttctaaaaaaaatacaaaaattggccaggcatgatggtgcatgccagcgtatgcctgtaattccagctacatgggaggctgaggtgggagaatcgcttgagcccaggagttcgaggctgcagtgagccatgatcaagccgctgcactctagagacctgggcaacagagtgaaaccctgccttgaaaaaacaaacaaaaaaacctcacagcactttgggaggtggaggtgggcagatcacttgaggccaggagttcgagaccggcctggccaacatggtgaaaccccatctctacaaaaaaatatgaaaaaaaattagctgggcatggtggtgcacacctgtaatcccagctactcaggaggctgaggcagaatcagttgaacccaggaggagattgcggtgagctgagatggggccactgcactccagcatgggcgacagagcgagaccctatctcacaaaaaggaaaaaagaaaaaaaaaagaaacaagggaagatgagaggaagagaaagaggaaaatgccataaaggagttactatctgaacagggccaacagaaaggaaagatgctccaatagaagttaagatgctccaatagaagagggagaaaggtgatgtagggcttctaggataagggaatggtttacaaggcaaagcagcataaagttgcaaagtgtcttccaggcataatcagaaatcaggtgtgagcagatagaacaacagacgggtagaaagaggtgtaaagtgctacgctaagcaacagggacttcactatacacacaatgacaaaggtagtatatgatcctggaacattaattttacacaaggatttgtgggagagttagatttaactggaatgtcatttaaaacatttatatagtaaagcaaacaactttcagaacttttttttttttttttgagacagggtctgattctgtcacctaggctagagtgcagtggtgtgatcttggctcactgcaacctccgctgcccaggttaaagcgattctcatgcctgagcctccctagcagctgggactacaggcacacgccaccatgccttgctaatctttttgttatttttagtagagatggggtttcgccatgttgaccaggctggtctcaaactcctgacctcaggtgatccacttgcctcagcctctgaagtgctgggactacaggcatgagccaccacgtctggctagagatggggtttccccatgttgtccaggctagtcttgaactcctgagctcaagtgatccttccacttcagccttccaaagtgctggcattacaggcacgagatacctcacttggccttaagaacttttaggatgagaaaacgtaaggcttcaaagaaagttctagatttaaaaaaaggctgctttaagctatgttctcaggtctcctatgtacttttttttttttttttggctatacagggactctccagaaaaagtttaagaaacactgaaatagaaaaaaactaagaaaactagaaagtggtcatcctccttttcaagagcatagttggtgagaggaggtacacagagggcaaaggacagagtaatagtaacgaaagcagtgggctgattcagtaatcttggtagaaaaaggtattcgagcagaagcttggggttggaagttcatagtttttgtttttgtttttgtttttgttttaggagaggagagatctgagtacattcctaagttggagtgaaggaagagttaaatatgaagaaaacaactgacaaggcaaagtctcagaggccaggcatggagggctcacacctgcaaccctagcactttgggaggccaaggcaggaagatcacttgaggtcaggagttcgagaccagcctgggcaaaaaagcgaggccttgcctctacaaaaataatttgaaaatacaaataaaagttgaaattataaattaaaaaacaaacaaagccttagaaggacaaaggatcaagaagtcaaaaggagctaactccagaaagaagatgctgagtcactctgaagccatgtaattgtagcttcagcaaacacagatctcatctgacttattcactgctgcacaccctggatttaggacaatgcttgacacacactagatctgaataaatacttgaattaaaatgaagtaaaaccaccatggtgcaattatgactcaatacaatatgtggaaacttctttaaaaaaatgtcttacattgtattatcctttgattcttcaaatgcatttagttcatggatgagaaactgtctgtccaacggaactacaggttgaccagattctgggagaaataaattcatgagaacactcagtctattaaactaaaaagcaaataagattttgaaaagaatcacatttaccagacatacactttttagattttggaagaatgatgacaacacacaccaagacagatcaaattgcctgtgattttatgactttcaaaatatctcttttgttaaatgcatgtcttaatacagtttaacataaattcactttttaaattccccagtgtttggttggaaaaataccatttctatatccaaattataatactaaattttggaagtctgtttatcaataacttatttttgaaaagaatatccacttggtgacaatacttataaataaaaattaaagttaacctgaagtgtggggcagctggaactttcacactttgctggtgggaaagcacaatggtacaggcactttggaaaacagttgagcagttttcttataaaggtgagcgtgcacttaaccacacaacccagcaatctcactcttagctttctacccaagattaatgaaaacttatgttctcacaaaaacctgtatgtaaatgtttatggcagcttgattcctaactgctaaaactagaaacaactcaatgcccatcaactggtcatagatgagcaaactagcacagccacacaatagaacagtgttcaaaggaaaaacaaacatggctgaatcttgaatgtattacactaagtgaaaaaaggcagactcaaaaggctacatcatgtacggttccatctacagcaagggtccccaacccccgagccacagattagaaactgggccacacagcaggaggtgaggagtgggcaagcaagtgagggaagcttgatctgtgtttacagctgctgcccatcactagcatcactgcctgagctcagcctcctgttggcagaattagattctcatagaagcgtgaaccctattgtgaactgcacatgcgagggatctgggctgtgcactccttatgagaatctaaggcctgatgatctctcactgcctcccatcacccccagatgggaccatctagttgcaggaaaacaggcttagggctcccactgattctacattatggtgagttataattatttcattatatattacaacacaatcatagaaataaaatgcacaataaatggagtatgcttgaatcatcccgaaccatcctcccaggtccatggaaaaattgtcttccatgaaaccagtccctggtgccaaaaaggctggtgatatcttgattgtgatctggtagtaattacacaactgcaggcatttgactaaagtacagaactgtacagtttaaaaggtaaattttattgtatgtaaattatatcccagttttttaaaaaaagccaaaccatttaatatgaaaacttgactactgtcactatatttcattctagtgaatcccaagtccccactattttcataatttcttcttttctgggtgtaactggtatcatacagccatctataacaaacaaaggaaagcagagatgctgatatcaaagatccttaaaccataaaaatcatgagtctttatgtagttcagacgtatgtttaatattaaataaaggatctgtaacgaaaaattctaacttcacaaagaattcattctctcttgcaaaatctacttcctggcctcgcttctttgctgaggcatgaagtagtcaaagcagagatggaacctgaaacgagggaatccgatgacacacattcagggtgcctcagaccaacccccagctgcatcccccaccccaccaagtccaggggtaaccaggattctgacttatttatatccatccagtctctcctcacttttttgaaagaagacatttaaaagtcagcagaagatattaaaaatattctcaccactcaataactgttacacttgaagagcaaatttatttctcaagaaataaaattcaacagataaagggaatttatctttatctccccacccccaacccccaatatcattctctgcctcctatcactaggatgagtttggagtttcccgctgctagagtctggatatttgtctccgcccaaatctcatgttgcaacgcactccccagtgttggaagtgggacctggcgggagttgtttgggtcatgggggtggatccctcatggcctggtgctgtccttaccacagtgagtgggttctcatgagaacaggtcatttataagtgtgtggcactaaccttccccacccttggcccctgccttcaccatgtaacgtgcttgctgcagtgagcaaaagctccctgaggcctcccagaagctaagcagatgccagtgccatgcttgtacagtctgcagaaccgtgagccaagtaaacctcttttcttcaaccgggtgcggtggctcacgcctgtaatcccaacattttgggaggccgaggagggcggatcacgaggtcaggagactgagaccatcctggctaacggtgaaaccctgtctctactaaaaatacaaaaaattagctgggcatggcctgtagtcccagctacttgggaggctgaggcaggagaatcacttgaacccaggaggtagacgttgcagtgagccgagatcaatccacactccagcctgggtgacagagcaagactctgtctcaaaacaaacaaacaaacaaacaaacatacaaaaaaacctcttctcttcataaattacccagtctcaggtgtttatttatagcaatccaaaaacaacctaatataccagcctagtcctttataaataccatgcttttagatacatacatttgtaaatgtacctaagcactacatagtagtaatatttcaaagttttatctccattatatctatctatctatctatctatctatctatctatctatctatctatctagatacacacacacacacacacaaatagacatatatctacatatctatatatagacagggacagttttttttcttttaagagacaggagttggaccagcctgtccaatatagtgaaaccccgtctctactaaaaaatacaaaaattcgccgggcctggcagcacacacctgtagttccaggtactcgggaggctgaggcaggagaactgcttgaacccaggaggcggaggatgcagtgagctgagatcacaatagagtgagactccgtctcaaaaaaaaagaaagaaaaaaaagacaggggttgggtgcagtggctcatgcctgtaatcccagcatttggggagtgtgagataggtggatcacctgagcccaggagttcaataccaggctgggcaacatagtgagagctcatctctataaataataaaaaaatttagctgggcatggaggcatgcacctgtggtcccagctactcaggagactgacgcaggaagactgcttgagcccaggaggtgaaagttgcaataagccatgatcgcaccactgcagtccagcctttgcaacagagtgagattctgtctctggaaaaagaaaaaagagacagggtctctctctgttgcccagactggagtgcagtgatgcgatcatggctcactaaagcccagagcacatgggctcacatgatcaccccctccccgacccctgctcagcctcagctaggacaacagacacgtgccaccatgcatggctaattttaaaaactcttttccagagatggggtctccctgtgttgcccaggctggtcgcgaactcctgggctcaagtaatcttgcctcggcctcccaaagcactgagattacaggtgtgagccacctacccagcctattttttaacaaataatatacttaatcagcgtatatttttaaagcttaatacacaggaaaaaactggtggcaaacaggacaaaacgtcaacaattgtttattctcggttacaggaattatagatgatttttccaagtatatgcctagtttaagtgattatttagttatgtattttctcttgtaagaatctgtttaagctacagaaagaacccatgtgatttttgtgtcccagtcacccagatggcactatctggtaagggaattagatttctaggataaacagtttctgagaattggggaaaggggagaaacagattttatgtgataaataataaccacttacctgctatgaggacagatgctgtatacttatatttgttgaattctaaatactctcgaattaattcattaattagaaggttttcatgagacaatgatggtcggggttcacggtcatcatctagggcattgaaaacttcagctcggatccttgcttttaaatgccctaataccccctttttttccaaggtgtcctttaaaactgttcgatataaaatattaaggcttcagttacagagtaaatttgtcattcttaggcatactttgaaaagaaatgttgaaaaggtaaatggtacaaaaacagctctcaagcagctcttaatctaaacattgtgacaaattattaaacaattacactaccaccagccatgtttatactaaaacatatagttctcatgttgcagtgatttagtcttaatatatttgagcaaattcaagtttattcctacatcatcagcactgtcaggggctgtagtctaatacatattcttttttattttatttattattttttttgagacacagtctcgctctttcacccaggctggagtgcagtggcacgatctcagctcactgcaacctctgcctcccaggttcaagcaattctcctgcctcagcctccagggtagttgggactacaggcacgtgccaccacgcccaactatttcttttttgtatttttagtagagacggggtttcactgtgttggccaggatggtctcaatctcctgacctcgtgatccacccacctcagcctcccaaagtgttgggattacaggtgtcagccaccgtgcccggccaatacataattctttagtgaggggaaaaggcgggggataggattatagttgcttactgagacctgaacttaagccccagtctctcatatattttcaagagtgtctgccactgcacacaggttctgcttgtcactaacaacctctggtctagaaagatgattaaagaaaacaactacattccataaaagaagtctgttgggttactgtgtaaaaaccttgatggcagggcatggtggctcatgcctgtaacccagcactttgggaggctcaggcgggcggatcacgagatcagcaaattgagaccatcttggctaacaaggtgaaatccccctctctactaaaaaaatacaaaaaattagccgggtgtggtggcacgcacctgtagtcccagcaacttgggaggctgaggcacaagaattacttgaacctgggaggtggagggtgcagtgagctgaggtggtgccactgcactctagcctgggcgaaagagtgagactctgtttaaaacaaccaaccaaccaaccaaccaaaaaaaaaaacacaaacctttgataatccacaacgctttagggagtgaaaaggtgttgggtttttcattgttgttattttgaaacaatctcgctctgtcgccaggttggagtgcagtggcacgatctcggctcactgcaatctccaggctccctggttcaagcaattctcctgcctcagcctcccaaatagctgggattacaggtgtgcgataccacgactggctaatttttgtatttttagtagagacagggtttcactatgttggccaggatggtctccatctcctgacctcgtgatccacccgcctcagcctcccaaagtactgggattacaggcatgagccactgcgcccactggcctcgttgttttaaagacaactatgagttaattccttagaacagtaggattctgaaattttaagcctagttagaaatctaccacgtgactgtatcaatgccatcttaaggagtcagggatgtgtatgcagaatggaaatctaacttactgattagccagagtcaccatgacaaagcagttatgatcatgggatttggctgtacatacttagtatagataatggggatcttaggactgaattggcaccatcccttgtagtgatctgcaacttttattttcaaacagttcctactggctaaatgacaacttcagagaatgaacacatctcatccacagagtcaagaacagagcaagagctcagtaggtgtcacctagaaggattataatacattgctgtacactactgggaaatcaatgtagtttaacactgttctgcaccctgccaaaggcaccaagtaagtacatcacaataacaaaaatccataaagagagcccaggagcttatccaagtcagtatggacataagatctttctaagcttcaataaataacgtcaacaataaccctggatcatatgactaaagagatagaatcttcactgacttttgacctttctttcccctcatttttaaagcatcccttcaaccttcttgcagataggttaagtacagttatcaccagatcagagtttgtaacaggtccataaaaggaaggtacagccttattgtactcttagaatcataactgaacccctattctctaattccatctttggaaattggatggagagattttgtcactggcaaggatcctgtcccaattactctgtattgcacacaggacagcctcaaactggacagagaaacgagaattagtgacagtggaatgaggaaagctagcatgtctcatcagcacctcagtggtggattaccaacccatgcctcagttgccttctctaaaataatgagctctacctctcagagatagaaccaagtaagaaggaaaaacgtgatcgtgcttaaaaaaggtaaatgcccataaaatgtaaggtaactggctggcaaacaagttttcaccgggtttcttttggaggtccatagcattttacctttccctctattatgcttagaacactgcgccatcaaaacttcttcggaaaggtcttaacctcgcttatatttcaagagtaccttttttattttattttttaatttgtttttttttttgagacaaggtctcattttgttgcccaggctggagtgcagtggcaccactgtagctcattgtcacctctatctcctgggctcaagctatcttcctgtttcagcctgtggggtagctggaactaccacaggccactatgcccggctcttttttttaatttttattttttaaataaagatggggtctcaccatgttggccaggctggtcttaaacttctgggctcaagcgatcctcccaaagtgttaggattacaggcatgagccactgtgcttggcccattccaagtgtacctttaaatcctctgaaaatgtatgcaatattacatgtgatgtgtatttccctgggaacagcatctgtagactcgtgaagtctgttcttgtggacagatgcatgcctgttctgttttatgattgttcaccagccctgtccccaaatacacacttttatacacgtctcctccctaaaatatctaagaattactagtttaaaccctgggttccctgcaaagtggaactggttttattttttggacagcaatcttgctcagtgattaagacctggcgctccagtgcgtcacaactaggttcccatgctgtgtctctttccagtgaaatcactttgagctatttcacttctcagtacctcgtttcccagtctatgaaatgggcatagggttgttacaatcaggtaacacacaggctgagttgagtagtgcctgacacatgaggctcaatgataactattattactattacttgtctggacatttgcttcaaagtaaacagcgtacaaatgtcattaatgactcaaacataactagcttagagtatcttttcctgaaaagacaggagaatggccaggccagcaaactttttgcctctagtttcttctgatgaaaaaggggccaggcgctcacacctgtaatcccagcactttgagggggccaaggcaggaggatagcttgagaccaggagttcgacagtaagaccccgtgtctacaaaaaatacaaaaattagccgggcgtagtgaagagcccctgtattcccacctgctctggaagctgaggtgggaggatagctggagtcccggagttcgaagctgcagtgagctgtgatcgcgctactgcactccagcctgggcgacagagagaccctctctttaaaaaaaaaaaaaaaaagcaaggaggggagggctacttaacaggttgttgtaaggacccaacgagacaaccaagcaaattgtttagggcagtgcctaacccaataggggttgtgggaattgtagtcatcagccctgagtgccaagcctggtccaagtcctccagcccccggcagggtccaagaagatgagccaggggcccaagatgcaggcctgtaggcctcttagatgcctgaagattacgcaactcctcctttagctccaaactggcttaaaactcgccagtgggcaacctcttccccataagagctccccgcgcacgggccaagacagcagccagacgctccccgcaggccctcacaccgaagaatgacgcctgtaaaagccaacccatgtgttccgcgcgctctcctcccatcccatcctttccacaagatgaaggcccgacgcttcccatgtggaggcctccctgctcgcactcaccagccttcaactctgccacagtcgccatttttcaacggccgccagggccgcaccgcggccctgcgcacgcgcagctccgccccactcaccctgcggcgtggtctgtagccaataggcgcacagctctcgccccgcccacttccgcccctctcagtttatgagctctgcggttgagtgggtagtgaatgtcgaccagagactccaccaatcagcgagcgctctcggaaggcccagttgagtgagacggcagggagggcggggactgaggcagtggagagccctgtggggtgctgctggcaccttagtgcttaactttagccagctgagtttttcattgtctctgcagcctcaagtaccaactgctagtagttaccacctattaaccctgcggttctcaaacttgagcatgaatcctcatcacctccaagacttgtttaaacggattgtttgctagtcctccccatagagtttctgattctgtaaatctggggtgaggccctaggatttgcatttctatcgagttcccaggtggtactggtactgctggtcggtctggagatcacacctcgagaaccactgtattaagcacttactgtgacgccttagcgcattatttccttatgatcacgccgtttttacaatgaaggaaacagagtcctccatcgctgaagagacttaaccaaggtcaccagcctgtcctcttccactcgcacttacacagtgcatgtaaggagtccaggagctttttatggaactaactaatgaaggaataagctccaacatcccatggaagtaaaggaaaaggaacaggggaataatgtaccctaaactgagtgtgaggttgcatgattccagttgtaatgccggtgagatccaaacacttggctaaataataaacatcgattagacgtacacctaagagtggccgggcgcggtggctcacgcctgtaatcccagcactttgggaggccgaggcgggcggatcccgaggtcaggagatcgagaccatcctggctaacacggtgaaaccctgtctctactaaaaatacaaaaaattagccgggcgtgctggcgggcgcctgtactcccagctactcgggaggctgaggcaggagaatggcgtgaacccgggaggtggagcttgcagtgagccgagatggcaccactgcactccagcctgggcgacagagtgagactccgtctcaaaaaaaaaaaaaaaaaagtacacctaagagctgccagggcacggtggtttacgcctggaatcccagcactttgggagactgaggtaaggagttcgagaacagcctggccagcctggtgaaaccccctctgtactaaaaaaaaagtacaaaaattagccgggcgtggtagcaggagcctgtaatcccagctacttgggaggctgaggcacaagaatcgcttgaacctgggaggcagaggttgcagtgagatgagatcgcgctactgcactccaacctggacgacagagcgagacaccgcctcaaaaaaaaaaaaaaaaaaaaaccacctaagagcaaggaaacctctttccgaggaacttccagcatacttttggttccatgcctattgtttttaaaactgatacattggccaggtgcggtggctcatccctgtaatcccagcactttgggaggacgaggagggaggattgcttaagctcgggagtttgagatcagcctgggcaatgcaagaccccatctctccaaaataaatacaaaaaattagccgggcatggtggtgcatgcctgtagtcccagttactccagaggccgaggatagaggattgcttgagctcaggagttctagaccaagctgggcaacatgagacgcatttctacaaaaaaaaaaaaaaattagccagatatgatggtgcatgccagctactcgagaggctgaggagagaggatcacttgagcctggacggctgattgtaccactgcactccactctgggcgacagagtgagtccctttctcaaaaaaaaaaaaaaaaaaaaaaaaaaaagaaaagaaaaagagagaaagaaaaattgatatatcacaattatggggagggacgtgatattttgatacacatatacaatgtgtaattatcaagtcaaggcaattgggataaacatcacctcaaacattctttgtgttggaagcattacaagtattctagctattttgaaatatacaatcaataattgttaactattttttttaaagggagggggaacagcctgggcagcatagggagaacctgtctttaaaaacgagcaaacaaggccgggtgcggtggttcacgcttgtaatcccagcactttgggaggcctgaggcaggcagatcacaaggtcaggaattcgagaccagcctggccaacacagtgaaaccccatctctactaaaaatacaaaaattagccgggcgtggtggcagaggcctgtaatcccagctattcgggaggctgaggcaggaaaattgcttgaacccaggaggcagaggttgcagtgagccaggggtgcagaggttgcactccagcctggggaacagagtaagactccgactcaaaacaaaacaaaacaaaacaaaagagcaaacagccaggcacggtggctcacgcttgtaatcccagcactttgggaggccgaggagggcagatcacctgaggtcaggagtttgagaccagcctggccgacatggtgaaaccccatttctaccaaaaatacaaaaattagctgggcatggtggcaggcatctgtaatcccagctactcgggaggctgaggcaggagaatcgtttgaacctgggaggtggaggttgcagtgagccgagatcacgccgctgtgctccagcctgggcgacaagagtgaaactccgtgtcaaaaaaaaccaaaacgaacaaacaaacaaaaaaaccgagcaaacaaaacaaaaaattagcctggcatgtgtccctgtagtccgagctactcgggaggctgaggcaggaggattgcttgagcctaggaggtggaggctacagtgagccatgaccataacactgcatttctagcctggtgacaaggggagatgccttttctttcccttccttccttccttccttccttctttccttccttcctttcctccctcctctctctctccttccttccttcctccccgccctttccctttccttccttccttccctccctccctccctctttctctctttctctttctttctttctttcttttctttctttctttctctctctctttcctctttctctcttactttttcttgagacttaaaaaaaaaggggggccaggcagagtatcttgacctagagtctaggataatgctctttaaactgctggttaaccaaatagtaggttttgaaatctatttattagtagatccccatgagtacattttcagtgaaatggaatgtaacaaatagaaaacatagaagtatggttttctagaactttcctttcaggtacacatgtgtgttctggtacctgttgtatttcttaaagtgatcagccatcagaaaagtttgaaagtgattgtaacctagaggaatctcttcctattccaaactggattaatttttgactggattaatttttgattatgggacacatatctgttctgtaaccttgaaaaggtcctatcttgtttctctactctgtaaaaccacagtgactgaatacctggccagcatttcaagagatttttggggattaactaaattccataggtggtatttttaagtccctcagaaaaagcactcctgtggtgttatgatataggtattgattttcatctccacgattcctggcatctaactcccattcacctcattataatgttgaggcactttaggcctcaggaaacagaatctccctctctgatcttctcctgtccacctctgacctgccccaagcaggactctaatctgactgtgggtcaaaagaccctcattccagaaagggttctgcctgctaccctcaaggaagaaatgctgcacagagagcccaagaaaagtctgagcagacaggctttgctgggtttagatcaggcactttctgtccaatcagatttctttcttttttttttttttttttgagacggagtcttgctctgtcgcccaggctggagtgcagtggtacagtctccgttcactgcaacctctccctcctgggttcaagcgattctcctgtctcaaccacccaagtagctgggattacaggtgtgcaccaccatgcctggctaatttttttttttttccagacagagttccgctcttgttgcccaggttggagtgcaatggcacgatctcggttcacctcaacctctgcttcccgggctcaagcaattctcctgcctcagcctcccaagtagctgggattacaggcatgtacaaccacacctggctaattttgtatttttagtagagatggggtttctccatgttagtcaggctggtgtcgaactcccgacctcaggtgatccgcccacctcggcctcccaaagtgctgggattacaggcgtgagccaccacgtctggcctgtccaatcacatttctacacggtgttcaatcacacctatgtaataaagtgtcccataaaaacccaagagaactgggttgggagaacttctggatagcagaacacgtggaggttgttgaagggtgttgcattcagggaaagcatggaagctccacaccccttcccctatactttgccctatgtgtcacttcatctgtataaacaaaattaagtgtttccctgaattctttgagccactccagcaaattaatggaacccaaaatgggggttgtggaagctccaacttgaaggcggtccatcagaagtttcagaggcccaaacttgcgactggtgtctgaaggaaggcagtcttggggactgagctatcaccctgtgggaaatgacactattttcaggtcgaagatgtcagatttaaactgaaggacacccagctggcgtcagctgcagaactgattgtttgctggccaggcgcaatggctgaagtctgtaatcccagcattttgggaggcagaggtgggtggatcacttgaggtcaagagttccacactagcctggtgacatggtgaaaccttgtctccactaaaaatacaaaaaatagctgggtgtggtggcatgcacctgtaatcccagctactcaagaggctgagccaggagaatcgcttgaacctgggaagcagaggttgcagtgagcagagatcatgctatgggtgacagagtgaggctaaacctaaaaaaaaagattgtatgcttgctggtggggggatttccccacacatttctggggtccacagaagtattctgtgttgattattggtgtgttgatgtgtgagcagagaaaaaacacggtttgagaaagtttatatccaaaaaactcctgaatatgttgatgaggaactcggagagagaggcaaataataatgtgattgaccgattggcagtggtaatcatacagtagctaacattcattatactctctgtatggcaaggactgctctaaaagctttacattaagtattcaccaacaaccctatgagatggatacttacatgcaattgtctcaagtaaaattgtatttaaaaacatactggccaggtgtggtggctcatggctgtcatcccagcactttgggaggctgagacaggcggattgcttgaggccaggaggagttcaagacgagcttggtcaacatagtgaaaccctgtctctactaaaaatacaaaaaattatttgggtgtggtggcacacacctgtaatcccagctacttgggaggctgtggcatgagaatcacttgaacccgggaggcagaggtttcagtgagctgagaatgcgccactgcactccaacctgggcgacagagaaagactctgtctcacaaacaaacaaaaaacatgtactaatgaccaggcacagcagttcatgcctgtaatcccagcactttgagaggctgaagcgagaggatcagttgaagccaggagtttgagaccagccaagccaacaaatcaagaacccatgtctttaaaaaaaaaaaaagtagctgggcatggtggcacatgcctgtattcctagctgctcaggaggctgaggcaggtggattgcttgagtccaggagttcaaggctgtagtgagctatgactgtaccagtggactccagcctgggcagcagagcaagaccccatctctgaaaaaataaatacctttatacatacattaaaaacatgcactgacattgagtaacactgaattgctggggatatgtcgaaacaggcactgccatacatagttggtaggtaggcaatcaacaccaccatccagaaggcagtttgtcaatatctcatcagattttcacaccctttgactcatcaaatctacttctaagaatgtatcttacagatataatcacacctacttacaaaggatataagtataagaatattcattcactgttgatagtagaaaaaactatgcacacctttcagaaaggctaaaataaagactactgacaatactgttggcaaacacacatgtactactggtgggaagacaaagtggtatagtcactttggaaagcagtttggcaattgcttattaagtcataggtacacttggcccagtaatcccaaaactaagtgtttgcccaagtgaagtaaaaacttgtaggccgggcgcggtggctcacgtctgtaatcccagcactttggggggccaaggcgcatggatcatttgaggtcaggagtttgagatcagcctgagcaacatggtgaaaccccgtctctactaaaaatataaaaattagccaggcatgatggagcatgcctataatcccagctacccaggaaaattagccaggtgtggtggagggtgcctgtaatcccagctacccaggaggctgaggcaggagaatcacttgaacccgggcagcagaggttgcagtgagccgagatcgtttcactgcactccagcctgggcaacaagagctaaagtccacctcacacacacaaaaaaaagaacttgtagccaggcacagtggcttatgcctataatccccacagtttatgaggccaaagcgggatgaacgcttgaatctagaagtttgagaccggcctgggcaacatggtgaaaccccatctctacaaaaaaaaaaaaattacaaaaattagacaggcgtgtaggagtgaacatgtagtcccagctactccagaggctaaggtgagaagacctgcagagcctgggaggtccaggttgcagtgagtcgtgatcacaccactgcactccagtctgggcaacatagtgaaactgtgtttcaaaaaaataaaaaatgttctctggtgaggactcggtgattgagggtcagtgttcgatggagacttacttttttttttctttttgagacagtctctgttgcccaggctggaatgcaatagcaccatcatagctcactacagcctcgacctccaggctcaactgatccttcagcctcccgagtagctgggaccacaggcacgtgccgccacgcccagctatttttattttttgtagagatggggtctcaccatgttgctcaagctgatctcaaattcttgggctcaagcaatcctcctgcctcgaactcccaaaggcctggggttgcaggcataaaacaccacacccagccttacttttgtccatagacttattttaatttattaattaatttatttatttgagactgagtcttgctctattgcccaggctggagtgcagtggcacgatctgggctcactgcaacctccgcctcccaggttcaagcaattctagtgcctcagcctcccgagcagctgggattacaggtgcacaccatcatgcctggctaatttttgtatttttagtagagacagggtttcaccatgttggccaggctggtttcgaactcctgacctcaagtgatcctcctgtctcggcctcccaaagtgctgggattacaggtgtgagccaccgtgcccagcctaattttaacttttaactatgtacatgcattactgtgcacaaccagctgtgggcaagtacagcccaatagcccctcctcttcactgtcttgagtatctcttgctcgttgttgagggcccgtctagcgccatgccccataggctgcctataggagtccttttgacccttcaggcacccacacaattgtggaaatgtggctggaccaacaaatagtgggagtgagtggtaatccatgtgtgacatgcgagaggtgcacatttttttctctctctcttttttttttccatagaaatataaaatgtttgtagaaatgtaaaatcttttgtttttctttttttttatttttccagacaggggttaactctgtcacccaagttgggctgcagtggtgcagtcacagctcactgcagcctcaacatcccagtctaagggatcctcccacctcagcctcctgagtagctgggactacaggtgtgtgtcatcacacctggctacttcttttattttctgtagaagcagagtctcgctatgttgcccaggctagtcttaaactcctggtctcaaacaaattctcccacctcagcctcccaaagtgctgggattacaggcatgaggcactatgcccagcctgtaatcttattagcacacagccatgccccccactttttttttttttatttttgagagaggttctcactctcacccaggctggagtgcagtggcatgataaggggtcactgcagcttcaacctcccctggctcaggcaatcctcccatctcatcctcccaagtagctgggactacttgtgcatgccaccatgcccagctaattttttgtattttttgtagagatagggtttcgccatgttgctcagactggtcttgaactcctagattcaagcattctgcccacctcagcctcccaaagtgctgggattaattacaggcgtgagccaccgcatctggccgcctgcctgtttcttaatgcattgtctatgggcgcttttacacggcaacagaggaattgagaagctgcaacagaactcacttaaaatattttacccggcacttgaagaaaacatttgtccactcttgaattctttttcatactttttctaggccacaggtatattattaacagattaaccattattttttttttcagctatagccaataataataaaaaagagcaactcacattgatggtgcccttattgtgtgtgtgtcgtttcatggcatcctgaagacagctgagagacagatgtgatcatgcctgttttacagatggaaactgaggtttggagggttgaagttgcttctgagtaaatggctgagtcagtgcaacttgaccccagttctgctccactcacccaacgttgctcagccgttttcggttgtttcagtttcactgcagacacttctctgttctccccctgccctccttctctcccccaaactctctctcttccttctcctcctttctcttcttctgctccccaatccccctcctcctctttcatcttcttcctcctcctccttcctcctcccagccctcctcctcctcctcaacctcctccccttctatctcctccccctcctcctctttcttctccctcgccctcctctcttcttttctctcccccaaccccctctctactgggcctttgcatgtgcccatcccccagcctggaaacttcctcctgttctggttaatttctgctcattctccaggtctcagtctacctttttgttgtcgttgttgttgttgttgagacggagtctcgttctgttgcccaggctggagtgcagtggtgcgatctcggctcaccgcaagccccgcctcccaggttcacgccattctcctgcctcagcctcccgagtagctgggactacaggtgtgcgccactgcacctggctaatttttcgtatttttagtagagatgcggtttcaccatgttggccaggctggtctcaaactcctgggctcaagcgatccacttgcctcagcctcccaaagtgctgggattacaggcatgagccaccgtgcctggtctccaggtctgtttaaatgtcatttcttcctaaagctttcctggctaattcgattcttcttctcaaatgtatcttggggggtgaaaggtctgagaagagggaggggcatagagataaaggaagcttccaacagaggtgcatcaccaatgcccttctcccaggtccgaggtcatacccctggctcgaggggaggcggcttccgatgcctggtccatgctggggtatcaagttccagccctctcaccccagtttgggacaattctgtaggaccgcctcactggcagagcttgctgagggagtaagctgaggcctttgtaggccacaaggttgagaccagcctgagcatcatagtagggccttgtttctatgaaaacatttttttaaaaaatgaaacttcccacatgacaatttttttttttgagacggagtctcactctgtcacccaggctggagtgcaatggtgcgatctcagctcactgccacttccgcctcccaggttcaagtgattctcatctcagcctctcaagtagctgagattacaggtgcccaccaccacacctggctaatttttatatattttagtagagatggggtctcgccatgttggccaggctggtcttgaactcctgacttcaagtgatccgctcatctctgcctcccaaagtgctgggattacagccatgagccacagcgcccggcttccccatgacaattttaaacatgagaactatgtatatgccacagtctggaacttgggatctcaaataatcttggattccttgttctcagtccccatacagaagggaggagggctggcctttggactcccccaaatctgggttcgaatcccagctccaccactgcaagtctggttgctctggaccagttacttaacgttctctaaatgtcagttacatccgtgagataagctacctcgcgggacttcattcagtccttcttcaaatatctgtagaatatttgtaggctgaggcctttgctgggaccgtggagaagcccaacttcctcctccctttcccccacttcctaggctttgatccagccctggagccttgatcgaattgatctctctttcaagtcttccagggaggctgtgactcaatcctagaaaccaggggcaggtccaggctgcctgtggtctacttgctccacttcctcaggtgctcaagggtgactcatcactcagtaagttcagagcagagggcgttctcctcaatgtgtgccaggagcacagcaggaatgtaggcaccctcagagctccccagaattccctaaccctggaccacactgtggcattgcagcctatgtggggctgaggctctgtttcacattgggtgcccaatggactgctttacaggacagatgccttgttatcctgctctgctccggtagaacaaatatttgtagaaggaccgaatgaagtcctgcaaggtagctcatctcacagacgaaactgatgtttagagaacattaaataactggcccagagcaaccagacttaaagtggtggagctgggattcaaacccagatttgggggagtccaaaggccagccctcctcccttctgtatggggactgagaacacggaatccatgaccatttgagatcccaagttccagactgtggcatgtacatagttctcatgattaaaattgtcacgtgagaagtttcattaaaattttttttttttttttttttttttgtagagacaaggtctcactatgttgtccaggctggtctcaagctcctgacctcaagcgatcctcctgcctcagcctaccaaattgttgggattgtaggtgtgaaccactgcactctgcccagaggtttcaaagtgaactttttttctttaatcaagatggggtctcactatgttgcccagactggtctcaaactcctgagctcaagcgatcctcccgccttggcatcccaaattgctgggcttacaggcatgagccactgcacctggcctcaaagtggaatgtttttagtggggggaaggtgctggatattactgtcagtcctttagaggaagtaaaataaatcctacaggtacattgacattctcaggtcactttcagagggatgagcaataaattcattcaatgccttctttactaaaagcattagagataaagaaattctggaagtaaatcttgctgaaatgcattttgtcaggggaactcagttgaacaaaaactaaaggttgagttcagaaaaggtaaatgtcttttaccaagatttagttcttttcttccaggtagatatgccttttcttaggatctggagtgagaggctgttggaaaataagggttggggaaagccacagatggaattttacaaattggagacagctacttaatagaaacggcatctcatcagacaagtcaaggcaactgttgaaaatatgacatgtctctctatcagccattcatggcccaggacactatggcaaccaaatccaaactgctggttcaaagagattagtctgaatcccaaaagaatcctaattctctcctgatttattaaggaagaaaacaacaaccgcctttatttgcaatattattgcattgcatgcaatcctaggaaaaggtgtggctgttatttttgaagaagtactcaccctatactagatacagtatgaaacattattcatgcgtcattgcatttatttctcacgtgatctcaagaggtagatgctactgtcatcctgattttaagatgaagaaagcaagccttagggagttaaagggaactgcccaaggtcaaacagctggaaagagacttggccagacgcaaaaacagtctgatgcccggttcaaggtcctttagtttcatctgtccagtaagtagacagagtatttgatacttgggctggactagacaaatctatgatgtgtaattgttctgtgaactcacagatcctagcgtgaagagttttttgttttgttttgttttggtttttttagatgcagtttcgctcttcttgcctacgctggagtgcaatggcgtgatcttggctcactgcaacctccaccttccgggtacaagtgattctcctgcctcagcctcctgagtagctgggactacaggcacccaccaccacgcccggctaattttttgtatttttagtagagatggggtttcactatgttggccaggctggtctcaaactcctgacctcaagtgatccacccgcctcagcctctcaaattgctgggattacaggcgtgagccactgtgcccggcctttttttttttttttttttagatagggtcttgctctgtcgcccaggctagagtgcagtggtacaatcatagctcactgtagccttgaattcctgggctcaagcgattctcccacctcaacctccctgagtggctgggactacaggtgcgtaccattacaacacctggctaatttttttttattttttaatattttgtagagacaaattcttgttatgttacccaaggtggtattgaactcctggcctcaagtgatcctcccaccttgtcctcccaaagttctgagattacaggtgtgagccactgtgcttaaccaagtgaagacttttttggctagctcaaccctgtaattccagcactttgggaggccgaggtgggtggatcacctgaggtcaggagttcaacaccagcacggccaacatggcaaaaccctgtctctactaaaaatacaaaaattagctgggcatggtggtgggcgcctgtagtccgagctactcaggaggctgaggcaggagaattgctggaacctgggaggcggaggctgcagtgagccgagatcacaccactgcactccagtctggacgacagagcaagactctgtctcaaaaaaaaccccaaaaacaaaaaacaaaaatcaaaacaaacaaaaagcccaaaggaggactttttcatgctgataaagaatgtaggataaacctgataccctctccaaaatctcttccaattttcctaacctctgtaccaatgaggacttcctttcctttctgactttcgatcaatgtaacaaaaataaaattgaagcagagaagggttaagtatgttgctcaaggtcttgcaggtgatttgggttagagccaatcttgaactcagccaggtgaggtggcacctggttccatgactggaccctccctgctgccctggtttgcgagaagattcttacacacatgtccctgatctccttgaagctttgattttccacctagagccccactgcagcatcctggttatctgcgcaagctctgttgttacactgaactggatggtgaatcctgggtacctgtgtggccttgggcaaaaaaaaaaaaaaaaaaaaaagcacctctctgagcttccatttctttcattctttctttccctttcccctctcctcccctcccctcccctccccttctctctctctctctctctctctctctctctctttctttgttggagtctccgtctgttgtgcaggctggagtgcagtggcgcaatcttggcttgctacaacctctgcctcctggcttcaagcaattctcctgccttggcccccctgacgagctgggattacaggcatgcaccaccatgccagctaatgtttgtatttttgtagagatggggttttgccatgttggccaggctggtctcaaacttctgacctcaagtattacgcccattttggcctcccaaagtgctgggattacaggtgtgagccaccacacacgttcttgggcctccatttctacagctattaaaaggaggccataatagtacctaactcctgggatattatcgtggctaaaatgagctaatgggccaggtgcggtggctcacatctgtaatcccagtactttcggaggccgaggcgggtggattacctgaggtcaggagttcgagatcagcctggccaacatggcgaaagcccgtctctactaaaaatacaaaaattagccaggtgtggtggcttgcacctgtagtcccagctactcgggagtctggggcaagagaatcgcttgaacccaggaggtggaggttgcagtgagctgagattgtgccactgcactccagcctgagtgacagagctagactccatctcaaaaactaataataataataataataataataataataataataataatatcataataagatgggcctggcgcggtggctcacgcctgtaatcccagcactttactctactaaatctctactaaaaatacaaaaattagccaggtgtggtggcgggtgcctgtaatcccagctacttgggaggctgaggcaggagaatcacttgaacctgggaggcggaggttgaagtgagccaagatggcgccattgcactccagcctgggaaacaggagtgaaactctgtctcaaaaaaattaaataaataaataagtaaataaataaataaaatgaactaatgcatgaagagcacttagttaaattaaataaataaataaaatttttaaaaaataaaattaattaaataataaataaataaataaaatgaactaatgcatgcaacaacttagcacagtgcctaggacataataggcactcgataagtgggctgggcgtagtggctcatgcctgtaatctgagcactctgggaggctgaggcgggcagatcacctgagctcaggagttcaagaccaccctgggcaacatggcgaaaccccatctgtacaaaaattacaaaaattagctgaccatggtgatacccacctgcagttccagctacttgggaggctgaggtgggaggatcacttgagcccgggagactaaggttgctgtgagcccagatcatgccactacactccagcctggtggacaaagctagaccctgtcacacacacacacacacacaaaagtggctatttcctcaccattccccccttggcaggtcacagcccagtccactccactcctccatggtctccattcttgtcgcctcgacaccagatggcctggattaggtgtgtaagaacatatttatgctccagttttctcttgtcaaattcctcatccttcctctccccttcccagatgttctccattctccgcaaatcctctacctcacctccatcttccacctgctctttggtcactctgtctcctactcaactaggaagaccctaggaaccctccacttggaccctaaatctctttgcattttaacctttcattcatgaattcattcattcgaaagatattattgagcatctactatgtaccaggcactaaggatactagagtaaatataataaacaggatcctggctgggtgaggtggctcatgcctgtaatctcagcactttcggaggtaaaggtgggtggatcgcttgaggtcaggagttcgagaccagcctggccaacatgacaaaacccgtctctagtaacaatacaaaaattatctgggcatggtggtggcacatgcctgtaatcctagcaacttgggaggctgaggcaggagaatcgcttgaacccaggaagtggaggttgcagtgagctgagatcacaccactgcactctagcctgtgcaacagagcaagactttgtctcaaaaaagtaaacacggtctctactcacatagagctcactggccaagagaaagggcagcaattcatcaaatatttaattacaaactcagataaatactataatgaaaaatgcagagattctgagacagtcaggggccataacctagcctaggttggtggttatggaaggcttccatatcagcatgtgtttctttctttctttttcttttttcttttcttttctttttttctttttcttttttttttttgagatggcgtcttgctctgttgcccaggttggagtgcagtggcaccgtctcatctcactgcaacttccacctcccaggttcaagcaattctcatgcctcagcctcccaagtagctggggttacaggcttgtgccaacacacctggctaatttttgtatttttagtggagtgcagtggaaccatctcggctcactgcaacttctgcctcccaggttcaagcgattctcatgcctcggcctcccaagcagctgggattacaggcgtgtgccaccacacctggctaatttttgtgtttttagtagagatgaggtttcacaaagttagccaggttggacagcacgagtttctatgcaacacactgtcctaaaacttagtggcttaaaacaacaacaatcattgatttcacccccaaatctgcaatttgggcaggatgtggcctggacagcaagtctgtgttccacatgccatgctcaacatggggcagcttgacaggggctggaggacccacttttttttggttgtctctgagatataatttacatgccataaatttcaccatgtgaaaccatacaattcaatgctttttagtatattcacaggattgtacaactattgctatctaattccacgatatttccttttccctaaaaagaaatcctatacttatctggatgtggtggcgcacacctgtggtcccagctactcgggaggctgagacagggggatcaattgagcccaagagttccaggctgcagtgagctatgatcgcaccattgcactccagcctgggtgacagaatgagaccctgtttctaaacaacaatgacaagaacaacaacaacagaatatataccattagcagtctcttctattccctcttcccctagtccctggaaacactcatctatcttctgtctttatagatctgtctgttctagacacttcaaatggaatatacactacgtggcctattgtgtctggcttctgtcactgagtacaatgttatcaagattctggaagacccactttgtggatggctcagtcacatggctggcaatttggtatttgctgtcaggtgggaactcagccagggctgtgggcagggatcccatttcttctctatgggggccccctccacgggctgcttgagcttccttatggcatggtggttgggttccaagatggagcatcctaacagagccaagtgggagcttttcatatcttttttttttttttcaattgagacaaagtctcactgtcacccaggctggtgtgcagtggcatgatcttggctcactgccacctccacttcctgggttcaagtgattcttgtgcctcagcctcctaagtagctgggactacaagtgagcgccaccacgcccagctaattattgtatttttagtagaggctaggtttgccatgttggccaggctggcatatttattaaaaaaaaaaaagagagagagagagagacagggtcttgcttgttgcccttggcaggtcacagcccagtccactccactcctccatggtcttgaactcctagtctcaaatgatcctcctgcctcatccttccaaagtgctgagattacagatgtgagccacgatgtccggccagcttttcaccttttatgaccagtttcagaagtcacaccatgtcacttccacagtagcctcaagctcgtctggattcaagggaagggaacacagaccacccttcacaacaggagtgtcaaagtcaccttgtttgcgttttaacttttcattaatgcattcattcattcaaaagatattattggccaggtgcagtggctcaaacctataatcacagcaccttgggaggctgaggcggatggatcacctgaggtctggagttagagaccagcctggccaacatggtgaaaccccgtctctactaaaaatacaaaaattagctgggtgtagtggcatgcgcctgtaatcccagctacttgggaggctgaggcaggaaaatcgcttgaacccgggaagtggaggttgcagtgagccgagattgcgtcattgcattccagcctgggtgacaagagtgaaaatccatctcaaaaaaaaaaaaaaaaaaaaaaaagtcacaccatgtcagttccacagtagcctcaagctcatctggattcaacggaagggaacacaggccacccttctcaataagagtgtaagatcactttgtttacattttaaccttttattcatgcatgcgttcattcaaaagatattattgagcatctactcatgaatgaataattgtggccacttttggaaaatacaagtgctacagcttccctgagaagatgatgttggggctgacagctgaaggataagcaggtgttacttaggcacaggtatggaagagcattcaaaaaacacagaacaacgtgttcaaaagacccgggggaacaattagcacactggaggaacttaaggcggccttgagtggcagaggcagagagaaaggcacttgtctgttgtgtgctttccatgactgctgtttccactcagccttcattgtccattttttcagaaacagtaccctaaattccctttggggaaccattgactcacccgccctcagccctctcagtggggctggctgcaggggtgggtgttaagacccaggtctagccattcaagacagttcacccagcctcgccagtctcactgattggttcgggtgtggtcatgtgacactcagaagggccaatgaggctcaaacccaagacatctgctgcagctattggacaagacagagtgtattgccttggggttgctaggtaggatagaggcaggagtggttgggtgtcacctttgcctctgccagagaataacctgttgaaatgacaccaacaaagagaaagtagaacgaagtgacacagaccattgagctcctggactatgaccaaagccagctctgccactggacattttagattcatgggccaatacatgatggtttaggctaatttgaatttctgtcacctggaatcaagagtactgtttaaaggcaccatcggtgggcgcagtggctcatgcctgtaatcccagcactttgggaggccgaggcgggtggatcacccgaggtcaggagtttgagaccaccttggccaaaatggcgaaactccatctctactaaaaatacagaaaatagccgggcatggtggcacgtgcctgtaatcccagcaactagagggtctgaggcaggaggatggcttgaacctgggaggcagaggttgcagtgagccatgattgtgccactgcactccagcctgggcaacagagtgagactccatctcaaaaaacaaacaaacaaacaaataaataaataaagacactatggttaggatttttctcttcctgtccctaactacacattctccattcctggttcttacgtaccacttcagaagcctccagcacttcatctggcctctcttccttctctctctctttcatttcttattttttttgagacagagtctcgatctgtcacccaggctggagcgcagtggcgcaatcttggctcactgcaacctccacctccaaggctcaagtgatcctccagcctcagcctcctgagtagctgggattacaggcacacaccaccactccaagctaactttttgtatttttagtagagactggtttttgccatgttgcccaggctggtcccaaacttctggccccaaacttctggcagatcaagtgatccacctacctcggcctcccaaagtgctgggattacaggtgtgagccactgcatctagccttctctcttttttttgtgatcaataaatgtttgtttattgcatcttggtctgaatgtcatattaaatttggggttccaaaaaactctagaaaacatttatgagaacttgggaggtggaggttgcagtgagccgagatcgcgccactgcactccagcctgggtgacagattgacacttcgtctcgccaaaaaaaacaaacaaacaaaaaaaaaaaacaaaaaaagaaaaaaagaactaaatgtccctgaatataaaatggtaggtaagaacagtaattggcttgtcgatcaatgatgaatcaaacagaaaatgcgtgacagattatggggaagtttaaaatgtccaaatattatgtcccagaagaatttgtctagataatagatcttcctcagtccctttcaggggatggatggatagtggacatacttgggcaggtttattcagggtaagctggaggaatgtgtcaaataggtagctacctatctgatttactttcatcctattttttctgctcttaaaacaaaataacctcctattggttaaacttttttttttttttggttgcaaatcaaactctcttactggttttaaaatatcaatttcttttctttttctgtttctttttttttttgaggcggagtctcactctgtgacccaggctggagtgcaatggcatggtcttggctcactgccacctccgcctcccgggttcaagcgattctcctgcttcaggctcctgagtagctgggactagaggcatgtgccaccacacctagctaatttttgtatttttagtagagacagggtttcatcatgttggccaggctggtctcgaacttctgatcttgtgatctgcccgccttggcctcccaaagtgctgggattacaggcgtgagccaccgtgcctatcctattttttttctttttctttttctttttttaagatgaagtcactctctgttgcacaggctggagtgcagtagcacgatcttggctcactgcatcttttgcctcctgggttcaagcgattctcagcctcctgagtagctaggactataggcgcgcgccaccacgcctggctaatttttgtatttttttacagagggggtttcactatgttggccaggctggtctcgaactcctgacctgaagtgatccacccaccttggcctcccaaagcgctgggactacaggcatgagtcaccacgcctggccaaaaaaaagattaatcttaaacataaccagaagtctagatgtttgacaggtttatttatttattgagacaaggtctagctctgttgcccaggctggagtgcagtggcgtgatctcttgggtcactgcaacctccacctgtgggttcaagacaccctcccatctcagcctcctgagtagctgggactacctgcctggctaagttttgtatttttagtagagaccaggtttcaccatgttgcccaggctggtcttgaactcctggcctcaagtgatccagcacctggcctcctaaagttctgggattacaggcgttggccaccatgcctggtcagtttggcaggtttaagggttgacttatgcctgtgactgtggctatctttctttatattctcatggcttaccccaggctggccacttgtaatatatggtcatcttaaccaaattagaaaaaggtattccagttgatgtggtggctcacgcctgtagtcccagcactttgggagaccaaggtgggtaggtctcttgagcccaggagtttgagatcagcctgggcaacataacaagacctcgtctctacaaaaaatacaaaaattagctgggcatgattgtgcatgcctgtagtcacagctactcgagaggctgaggtggagcccagaaggcagaggttgtagtgagccaagatgggaccactgcaccccagcctgggcaacagagccaacctgtcttaaaaaacaaaaaacaaaaaacctgacatgggactttgaatattctagtattgaatgaatgaggaataaagagatggatgggtggatggatggacggacagatgaatgaattgatagatggatgagttgaatgggtgatggaaggatggatggatggacaggtggatgaatggatggatgggtggtggatgaatggatggacaactgaatgaatgaatgaatgaatagattgacaagtggatgggtgatgggtggaaggatagatggtcagatggatgggccatggacggatgaacggacagatggatgagagagagagagagattcctctgggcagcagacaatttccttaaaaacaaacaaacaaaatctcctttttcgggaagatacaaccacacatacgggctgaatgtcagcccccaatcatctactcggcacttccatagcacagggcacaattttgggcaagtgctcatttcgtgaggaccacagacaggcaccatttttttaagggttggtgggatgatcaccactgtttgaggccttatattcaaggattacaatgttcagaggagaaaatagaacgacttccaggatctctgccagagcgccaggaagaacttcctcggaaacatttaacaaaactctcctcgtatctcattggcctgatttgagttacatttcctttcttttctttcttttttctttttctttctttctttctttctttctttctttctttctttctttctttctttctttctttctttccttccttccttccttccttccttccttctttctttctttctctctctctctctctttttttctttccttccttctttttttttttcttttttttgagacatggtccagctttgtcgttcaggctggagtgcagtggcacgatcttggctcactgcaacctccgcctctgggttcaagcaattctccccgcctcagcctcctaagtagctgggattacaggcacccatcaccacgcctggctgatttttgtattttttagtagagatggggttttaccattttggccaggctggtcttgaacccccgaccttaggcgatccgcctacctcggcctccgaaagtgttgggattacaggtgtgagccaccgcgcccggccttctttctttttttgaggtaagattcacaaaacatttttaaaatcaccctttggggccaggcatggtggtgtgtgcctgtagttccagccactagggaggctgaggcaggaggatcacttgggcccaggagcctgaagtgcgctatgatcactccactgtacttcagcgtgggtgacagagtgataccctgtctcaaaaaaaaaaaaaaaatcaccatttaaagtgaatagttcactgttttttgtcacattcacaatgttccacagctatcatcactatctagaacatttttaccacagcaaaacaaaagaaaaaaacaaaaagcaaaacaaaaaacaaaaaaccataaccattaagcaaacattctccattccgcccctcctcctaggccctgagaaccacaatctacttcctgtctctccggctttgcttattccgtgtgtttcatcccatataaatatattcataaaatatgtggtcttttgtgtctgtgtctgtttccttcctctccctttctttctttctttctttctttctttctttctttctttctttctttcttcctttttctttctttctttccactttctttctttcttcctttctttttctttttctttcctcttttctttcatatcatggctcactacagccttgacctcccaggttgaagagatcctgccacctcagcctcccaagtagctgggactacaggtgtgcaccagcacccctggctaatttttgtatttttttgtagaaacgtgctgttgccatggtgcctgggctggtctggaactcctgagctcaagcaatctgcccaactcggcctcccaaagtgctaggattaccggtatgagccactgcgcctgactggggttcttttttgtagcatgatgttttcaaggttcatgccagttgtagcatgcatcagtattttcttccttttcatgtctgaatgatattccactgcatagataaactaaatattatttatccagtcgttaattgatgggcatttgatttgtttccactttatggaccgttacgaatagtgctgctatgagcatttgtgtgccagttaatgtttgaacacctgtatactagtatacacccaggcattaaattgctgggtcatattgtaattctatgttcaactttttgaggaactgccaaactgttttccatagaggctgtaccattttacattcctagcagcaatgtacaaggcttccagtttctccatatccccatcaggcttgtaattttccttttttttttttttttttttttttgacacagagtctcactctgtcgcccaggctggagtgcaggggcgtgatctcggctcattgcaacctctgccccctgggttcaagcgattctcctgcctcagcctcctgagtagctgggattacaggggcctgccactgtgcctggatgatttttttgtatttgtagtagagatggggtttcaccatcttggccaggcttgtcttgaactcctgacctcgtgagccatggcgcctggctgtaattttccatttttaaaaattataaccattctattgtgtgtgaagtggcatctctttgtggtttttatttgcatttccctaataacgaatgatgttgagcatctgttcacgtgcttgttggccatttgtagatcttctttggagaaatgtcttcaaatccggggcccatttttaaaaactgggtgctttgctttttttgttgttgagttgtaaagttctttacatattccagacagtagagccttatcaaatatgtgatttgcaaatattttctctcattctgtgaactgccttttctgtccttcgatactgttctttgatgcataaaaggttttaattttgatgaagtctagtttctcaacctttgctgttgtcacttgtgtttttggtgtcatatttaagaaaccattgccaagccaaagataatgaagatttccctctgggctctcttttaagtattttatagttttaacttttataatttagatgttaatattatggcgtgagttcaaagtccaatttcattcttttgcatgtggatatctcatggtcccagggtcatttgttgaagagactgttctattaaattatgtcttttaggctgggcacggtggctcatgcctgtaatcctagcactttgggaggccaaggtgggtggatcaccagaagtcaggagttcaagaccagcctggccaacatggcgagaccctgtctctactaaaagtgtaaaaattagccaggcatggtggtgtgcacctgtagttccagctacttgggaggccgagacaggagaattgcttgaacccgggaggtggaggttgcgtgtgccgagattatgccactgcactccagcctggatgacagaacaagactccatctcaaaaaaaagaaaaaaaatatatgcctttttcagcaatttggatggagctggaggccattaatctaagtgaagtaactcaggaatggaaaaccaaatattgtatgtcctcacttataagtaggagctaagctatgagtacccaaaggcatacagagtgatataaaggactttggagtctcagaagggggaggatgagaggagggtatggatgaagactacatgttgggtacatgtgtaactacttgggtgatgatgggtgcattaaaatctcaaaatttaccactatataattcatctatgtaaccaaaacccacttgtaccccaaaatctattgaaatttttaaaaaaagagagagagggaaactgttctttcgcctattgaatggccgtggcacgcttgtcaaaagccgattcactggctgggcatggtggctcacacctgtaatcccagcactttgagaggccaaggtgggtggatcacctgaggtcaggagttcaagatcagactggccaacagggtgaaagcccgtctgtactaaaaatacaaaacttagccaggcgtggtggtgggtgcctgtagtcccagctactcgagaggctgaagcaggagaattgcttgaatccaggaagtggaggttacagtgagtcaagaattcgacactgcactccagcctgggtgacagagcaagactccatctcgaaaacaaacaaacgaacaaacaacaacaaaaagccaactgaccacactgggtgcagtgggtcacgactgtaatcccagcactttgggaggtcaaggtgagaggattgcttgagcccaggagtttgagaccagcctcagcaatatggcgagacttcatttgtactaaaaacaaaaaacattagccaggtgtggtggcacgtgcctatactcccagctactagctatgtgggaggctgaggtgggaggattgcttgagcccaggaggtagtggttacaatgaactgtgattgcgccactgcactccagccagggcaacagagaaaatgctgtctcaaaagaaaaaatcaattgactatagatgtatgggtcatttccagactttcaattctattccactaatctatatgcctatcctcataccagtatcacaccttttgattattgtggctttgtagtaaattctgaaatcaccaagtgtgagtcttccaactctgctcatttttcaagattggctcttgggtgcaataccatgtgaatattaggtttgaattttccaggtctgcaaacaaggacgttgggattttcatagggattatatcaagtccatagatcactttgggatagtattatcatcttaacaatattaagtcttctaattcataaacacgtgtattagtctgttttcatgctgctgataaagacatacccaaggctggggagtttacaaaagaaatcggtttaatggtcttacagttccatgtggctagggaggcctcacaatcatggtggaaggcgaaaggcattttctacatggcggtggcaagcgagagaatgagagccaagtgaaacgggtttctccttataaaaccatcagatcttgtcagacttattcactaccacaagaacagtacgggaaaaactgcccccatgattcaattatctccccctgggtcccttccacaacacgtgggaatcatgggagtacaattcaagatgagatttgggtggggacaaagagccaaaccatatcaacatgtgacgtcgtctttctatttatttaggtcttcgtatttgctttcagccacgttttgtagttttcagggcactagtgttactcctacttggttaaatttatttatttttattctattggaagtgaaattgttttcttaattttactttctgattgtttattgctagtttatggaaatgtggctgatgtttgtgcgttgatcttcttttttttttttttttttttgagatggagtcttgctctgtcacccaggctggagtgcagtggcatgctcttggctcacagcaacctctacctcctgggttcaagtgattctcctgcctcagcctcccaagtacctggaactacaggtgccctcaccacgcccagctaatttttgtattttttactagagacaggctttcaccatgttggccaggctggtctagaactcatgacctcaagtgatccacccacctcggcctcccaaggtgctgggattacaggcatgagcaaccacgcccagctgcaaactaccttttcaatgacagttgtctcctaatttgttggcctcagcataggtagataataataaaacctacattttaaaacattaaagggcaatgttcagccaggcacagtggctcacgcctgtaatttcagcactttgggaagctgaggtggacagatcacctgaggtgaggagttcgagaccagcctggccaaaatggtgaaaccctgtgtctactaaaaatacaaaaattacctgggcatggtggccgacacctgtagtcccagctacttgggaggctgaggcaggagaattgcttgaacccaggaggcagaggccacagtgagccgagatcgtgccactgcattctagcttgggtgacagagagagaagcggtctccaaaaataaataaataaaaatagatgagtcacttccaagatggccaaataggagcagctccggtctgtagctcccagcgagatcaacacagaagacaggtgatttctgcatttccaactgaggtacctggttcatctcactgggactggttggacagtgggtgcagcccacagaggtgagctgaagcagggcagggtgtcgcctttcccaggaagtgcaagggttcaggggatttccctttcctaggcaagggaagccgtgacagactgcacctggaggaacggtacacttccatccaaatactgtgcttttcccacggtcttagcaactggcagaccaggagattctctcccgttcctggctcggcaggtcgcacgcccacagagccttggtcactgctagcgaagcagtccaagatcaacctgtgatgctgcagcctggtcagcaactatcatcagactgaacaggcaatctacagattgggagaaaacttttgcaatctgcccatttgacaaagggctagtattcagaatctacaaagaacttaaacaaatttacaagaaaaaaacaaacaaccccatcaaaaagtgggcaaaggatatgaacagacacttctcaaaagaagacatttatgcagccaacagacacatgaaaaaatgctcatcatcactggtcatcagagaaatgcaaatcaaaaccacaatgagataccatctcacgccagttcgaacggtgatcattaaaaagtgaggaaacgacagatgctggagagggtgtggagaaataggaatgcttttacactgttggtgggagtgtaaattagttcaaccattctgcttaatagccacacactgtgtggctattcctcaaggatctagaaccagaaataccatttgacccagcaatcccttcactgggtatatacccaaaggattataaatcatgctactataaagacacatacacacatatgtttattgtgccactattcacaatagcaaagacttggagccacccaaatgtccattaatgatagactggattaagagaatgtggcacatctacaccacggaatactatgcagccataaaaaaggatgagttcatgtcctttgcaaggacatggatgcagctggaaaccgtcattcttagcaaactatcacaaggtcagaaaaccaaccaccacatgtttcactcataggtgggaattgaacaatgaaaacacatggacacagggcagggaacttcacatattggggcctgttgggggtagtgggggcggggagggagagcattaggacaaatacctaatgtaaatgtcgagttgatgggtgcagcaaaccaacatagcacatgtatacctatgttacaaacctgcacgtcgtgcaacgtcgtgcaaatgtattgtagaagttaaagtataataaaaaaagaaaaaaaatccattcatatatcaataaaaaatagatcaatcaatcaataaaacattaaagtgcaatgtcgacaagaggtggtaaaagcaggcatccttgtgttgttcctggtctttgtggggaaatctttaaatttgtaagcctttcactgttgcatatggtgtaagtctcttcctttctttctttctccttccttccttctttccttccttccttccttccttctttctctcttccttctttttctttctttctataaatagaaacagcaggccgggcacgctggctcagcctgtaatcccagcactttgggaggccgaggcaggcggatcacgaggtcaggagatagagaccatcctggttaacacagtgaaactccatctctactaaaatacaaaaaaaaaattagccgggcgtggtggtgggcgcctgtagtcccagatactcgggaggctgaggcaggagaatggcctgaacccaggaggtggagcttgcagtgagacgagatcatgccaccgcactccagcctgagcgacagagcgagactccgtctcaaaaaataaataaataaaaataaataaataaatagagccagcgtctcactatgttgcccaggctggtctcaaacttctaggctcaagcaatcttcccaaagtactggggttacaggagtgagtcaccttgcctggcctggtgtaagttttttatatatgccctttatcctgttgaagaagttctcttctggtctttattatttcagtattctttgttgttgttgttgttgttttgttttgttttgttttaaatcctgaaaaggtgttgggttttgtcaaaggctgttttctacattatcccttaattctattaatgttgtgaataacatttatttatttatttatttatttatttacttattttgagatggagactcactcagtctcccaggctggagtgcagtggcatgatctcggctcactgcaacctccatctcctgggttcaagcaattttcctacctcagcctccctaacacctggcattacaggcgtgtgtcaccacgcccagctaatttatttttattttttgtatttttagtagagacggggtttcaccgtgttggccaggctgatcttgaactctttacctcaaatggtccacctgcctcggtctgccaaaagtgctgggaatacaggcgtgcactaccgtgcctggctgagttttttcttttttgagacagggtctcactttgtcacccagggtggggtgcagtggcacaaacatggttcaccgcagcctcaacctccccagctcaagtgattctctcacctcagcatgccaagtagctgggactacagttgtgagccactgcgccctgccctgattttcttataatgaatcacccttacattcttgggataagtctcatctgttaacacatatgtataatatgtttctatgctgctggatttgatttgctagtattttctttaggatttctgcatctatatttataagggacattggtctatagtttccttttcctgtaatgtcattgtgtggctttggtatcagggtaatgctggcctcatagagtgggtcagaaatgttgcctcctcttctagttttgggaagattttaataagaattggccttaattattcaaatacctggtagaattcaccaatggagccatcgggtcctgagcttttccttacggaactttaaaaaattgttaccaattccatctctttccttgttatagatctattccgacttcctagtttttcttgggttagtcttggtaatttgtgtgtttctagaaatttgtacatttcttccaggtgtattcaattaattgacatgtcattgtttatagtattctcttataatcttttatttttgtaagggttgtagtaatctttggttcctgattttagtggtttgggccatctccattcttcttctgggggcatcagtatttccaaaagtttagcaattttgctgatttgttaaagaaccagtttttggttttgttgactctattgcttttatagaatactatattttatttatcttcactgtaatttttattgtttttttgctgctgcttgctttcggcatagtttgatctttttctaatcccataaggtggaagaatgtattatttatttgagatctgtctttctttttttgcttgagacaaggtcttgctctgttgtccaagctggagtgtagtggtgcaatcatggctcactgcagcctcaaactcctgggctcaagtgatcctcctgcctcagcctcccaagtagctgagatcacaggcatgtgccacgatgcctggctagattttttatttgtatttttcatacagatagggtctcgctatattactgaggctggtctcaaactcctggcctcaagtgttcatttttttttttttttttttgagatggagtttcactcttgttgcctaggctggagtgcaatggcacgatctcagctcaccacaaccttcgcctcatgggttcgagtgatccacctgcctcagcctcctaggtagcaaggactacaggcatgtgccaccatgcccagctaattttgtctttttagtggagatggggtttctccatgttggtcaggctggtcttgaactcctgacctcaggtgatccacccgcctcagcctcccaaagtgctgggattacaggcgtgagccactgcgcccaccctctttcatttttgatgtaggtgactacagctataaatttccctctgagcattgtctttgctgcatctcataagttttggtaagttgtactgctttttcattcatctcaaaatatttaaaaatttttttatgatgtcttattttactcattgtttatgttaatttctacataatcgtatatttgtgaatctaaaaattttctttctcttgttgatttctagttttattctgttgtggttgaagaaattactttttttttttttttttggcagggtctcactctgtcgcccaggctggagtgcaatggcctgatctcagctcactgcaacctccgcctcccgggttcaagcaattctcctgcctcagtctcccaagtagctgggattataggcacccgccaccacacccagctactttttgtatttttaatagatatgcggtttcaccatgttggccaggctggtctcaaactcctgacctcaggtgatccgcctgcctcggcctcccaaagtgctgggattacaggtgtgagccaccgcacccggccaaaagtactttgtatgatttcaacttttttttttttttttttttttttgagacagggtctctctctgtcgctcagtctggagtacagtggcgtgatctcagctcactgcaacctccacctcctgggttcaagcaatcctcctgcctcagcctcctgagtagctggaattacaggtgcccacaaccatgcccagcaaattattgtacttttagtagagatggggtttcactgtgttggccagggtggtctcgaactcccgacctcaagggacccacctgccttggcctcccaaagtgttgggattacaggcgtgagccaccgcgcccagccgataactcaaaaattttcaagaggcaaagacttattttttaacagatgtgagactcagtgttttaaacaagacccaataaagacagtatgaggctaactgaatctgtccctcctgcaaagaaacatttttttactgttttttaatattacatgaaaattttgtttaaaaaactaaattttacctttgtatgtaaaattgttcctttagtagttttaattacatatattataatgttaactcttaggcagtctccgcctctcgggttcaagcaattctcttgcctcagcctcccgagtacctcagactacaggtgtgcaccaccatgcatgcccagctaatttctgtatttttagtagagacagggtttcgccatgttggccaggctggtctcaaactgctgacatcaggtgatctgtccgccttggcctcccaaagtgctgggattacaggcgtgagccactgcatccagccattactgacttttatttttaatgaaaaactaaggaggtaggcaattttaattatgtaccaggtacagagtctaggacagtaataatatatgtcaataatatatgatgctttttaggataggcaggggacatggttaattctacacatccccaggccttatctacaatctaagggctttaaaatagacaagtccaacaattatttaaaatattatagaagggccaggcatggtgcctcatgcttataattctagcactttgggagcagaggctggtggacgccttgaacctaggagttagagaccagcctggccaacatggtaaaactcgatctccactaaaaatacacaagtgagctagacatggtggtacgtgcttatagtcccaactacttggaaggctgaggtggaaggatcacctgagcccagggaggttgaggctgcagtgagcatgccactgtactccagcctgggcaacagagtgagtcccagtctaagaaaaaaatttataaaagtagtttaggacctgaaaggtcttagtaaagacaataccagacttgtctaatttacaccaaatgttcacattctgaagatgtttttattttactaataattgaaaaactgtctttatttactaaagattattaaagtcatgtgaactaaaagatacttaaagtttttattttttgatgaaatattcaatttaagtggttaagtcaactgattagagcttttaaaaatatatttcagtagtgaaatattatatattcatggcacatataaacatagacataacagacagaagtagatcttatagacttgtaagactttctgtcaattttaaaatttttattaattaattaatttattagagacaaggtctcactctgtcacccagactggaatgcaatggtataatcatagctcactgtagcctcaaattcctgggcttaactgatcctctcgcttcagcctcctgagttgctgggactacaggcatgcaccaccatgcccagataattttaaaaattttttatagagatggtgtctcactttgttgcccaggcaggacttgaactcctggcctcaagtgatcctcatacctcagcctcccaaagtgttggaattacaggcttaagccaccacatctggctggttttaattattaaacaataacaaaaaaattcattttctaaaaaaaagagtactgtggcctctatacaaaaataaagaaaaacaatttagcatagtgaaaacaagatagagtcaataatattaaatttgtatttttgagacagagtctcactctgttgcccaggcttgagtgcagtggcttgatctcagctcactgcagcctctgcccccctggttcaagcaattctagtgcctcagcctccggagtagctgggactacaggcttgcaccaacatgcttggcttatttttctatttttagtagagacagggtttcaccatgttggccaggttggtcttgaacccctgacctcaagtgatctgcccgcctcagcctcccaaagtgttgagattacaggcgtgagccaccgcgcccagtcaattatgttaaattacccttattactatgatttttataaaagtggtttcaagcatataaagaatgtttgttattactattatgtattattttctttatcatgatacttcagtcaaaaggaactgcttaggacagcttgaatatgtcccatagttacagcctgcaagcctttttctttgctgtgccatgtgcctaagacaccatccttcgtttgtgtgtgtcaaaaccccaccagtctgtcctcttaatcccaacaccaatgtcctgggtgccaataaaggctttcctcacctccaaattgagattttattgacctctcttggggtgcttatactggctttgggttgaaatctattttttctcctctcccttgaagaagcacgtctctttgcttaagggaacgtagaagccacagcagatcctagcagatatctgttaccctgaagaagaggtcagggcccaggcacggtggctcatgcctgtaatcccagcatttggggaggtcgaggtgggcggatcgcttgagcccaggagttcgagcccagcttgggcaatatggcaagacaccgccccccgactctacaaaaaatacaaaaattagccaggcgtggtggtgagtgcctgtagtaccagctacttgaaaggctgagttgggagaatcagctgagcccaggaagttgaagctgcagtgagccgtgatcgcaccactgcactccagcctgtgcaacgtggcaaaaccagagtggggccttgtctcattttaaaaagtaataagagaccgagcacgggaactcaggcctgtaatcccagcactttgggaggctgaggcggccagatcacttgaggccagagagttggagaccagcctggccaacatgggaaaaccctgtctctactaaagatacagaaattagccgggtgtggtggcaggcacctgtaattgcagctactgggaggctgaggcaggagaatcgcttgaatctgggaggcggaggttgcaatgagcagagatcgagtcactgcactccagcctgggccgcagagcaagaccctgtctcaaaaataaataaataaataaataatttaataaataagaagaaagggtcagggccatttttaaaaggcactagataaggcctggttgcaatcagggagtgcgggcaactgatttctttgaagcctcctcttgttctgtttccgtgacattgacagggaccagctcccatggttcaggagctgctgagggttaacatcctgtcccaggagggatctgaccacaccaatggctttatcgttgcctaattggggaggccctgtgggggatgtttcaaggactgagagtgcagaggagcctcccgcatgcagttacgctgatggaaacacaatgggtggattgccacaggggcccgcaggctcgctggcaaacagagcgcacaggtggaaaccttccccgctgaccagatactttgtttcctttctggggaggcagataaaacagttaccataacccaaaccctgcccactcttcatttgcaaactgcaatgctcttagacatcttccttaggtaagcgctttgagagctcctgttcatttcaggactaaaatgaacaataatagcgaccgtccttcagagcctgctggatgccaggcacctcacaagtgtctcccagtgctgggtgcagtgattcacacctgtaatcccagcactttgggaggctgaggtgggtggatcgcttgagctcaggagatcaagaccagcctgggcaatatagtgagaactctgcctctaaaacaaagaaaaaggaaaaagtaactcctggtgaatttccaccttagaacaagagtgggaggtgtcctattcatgatctttaatgctttgctcaaatatcaccttctctgtgaggcctaccctgaccactctgcttaaaattgcaaccctccaccacctccaccccgcatcgcaagttctcgtcacagcctttctcacctgctacccactccatgatttacttattaagtatgtttgttaggccgtgtgcagtggctcatgcctataatcccagcactttgggaggctgaagcaggtggattacctgaggtcaggagttcaataccagcctggccaacgtggcgaaaccccatctttacaaaaatacaaaaaagttagccaggtgtggtggtgcgtgcctgtagcccagctactcgggaggctgaggcaggggatttgcttgaacctgggagggaaggttgtagtgagctgagattgcaccatcgtactccagcctgggcggtagagcaagactctgtttcaaaaaaaaaaaagtattgctaagtcaaaaagtataaacagtctaattttttttttttgagacaaagtctcgctctgttgcccaggctagaatgcaatggcacggtttcggctcattgcaacctctgcctcctgggttcaagcgattctcctgcctcagcctcccgagtagctgggattacaggcatataccaccatgcccagctaactttttgtatttttagtatagatagggtttcaccatattggccaggctggtctcgaacttctgacctcgtgatccgcccgccttggcctcccaaattgctgggactacaggcaagaaccaccgtgccctgcctgaagagtcgaaatttttttttttttaaacagtttcactctgtcgcccaggctggaatgcaatggcacattctcagcccactacaacctccgcctcccaggttgtagccattctcctgcctcaagcctcccaagtagctgggattataggcacccaccactatgcctggctacattttgtagtttttttttttttctttttgagacggagttttgctcttgcttcccaggctgtagtgcaatggcgccatctctgctcaccacaacctccgcttcccagattcaggtaatcctcctgcctcagcctcccgaatagctgggattacaggtatgcgccaccacgcccagctaattttgtgtttttagtagagatggggtttctccatgttggtcaggctgaacaaccgacctcaggtgatctgcccgcctcagcctcccaaagtgctggaattacaggtgtgagccaccacgcctgggtctactttttgtagtttttagtagagacagagtttcaccatgttggtcaggctggtctcgaactcctgaccttagtcgatctgcccgcctcagcctcccaaagtactgggatcacaggcgtgagccactgcgcccggcccaaatagtctaaattttaataaatactgccaaataacactttcaaaagagtatccattcatactcccaccaatggtacataaaaagtctcaataacaattggtaaaattggtttggtggggaattcaactctacactgctgagctgctgctatttgcaaccatagaatcttttttttttttttcttctgagacagagtctcgctttgtcaccgagactggagtgcaatggcgctatcaaggctcactgcaacccttgcttcccggctttaagtgatcctcctgcctcagcttcccgactagctgggattacaggagtacgccaccatgcccagctaattttgtatttttagtagagacagggtttcaccatgttggccaggatggtctcgaattcccgacctcaggtgatctgcccgccttggcttcccaaagtgctgggattacaggcgtgagccaccgtgctgggccctgcaaacatagaatcttagagttgaaagggacataaaaatccatcgaattcttgtccaactcccctcccaaggcagcaatcccctgcaatacagccttgtttacaacgctgttgtctgtgactggggtcaaactccacatctttgatcttaagaataaaccaccactgacagtgggcttatcacatccagtaagtttgttatatcactgggccaaaatctactttcctggtggggcccggtggctcacgcctgtgatcccaggactttgggaggctgagtagggtggatcacctaaggtcaggagccagagaccagcctggccaacattgcgaaaccccatctctactataaatacaaaaactagctgggtgtggtagtgcatgcctgtagtcccagctactcggaaggctgaggcaggagaatcacttgaacccaggaggcggaggttgcagtgagtggcgatcactgcactgcactccagtctgggtaacagagcgagacacacacacacgcacacgcacacgcacacgcgcgcgcgcacacacacacacacaccctacctttcctgcaacacaccccacctatcctagctcagctctgggaagtaacacaaaagagctaatccttttccacatgacagcccttaaaatatttgaagactgtatcacatttccccagagccttctttttgtggggtacaacttcccagttgtgaccaaacacgtcccttccataggaaagtgctgactggagtctcttcagctgagtggcccagcataagagctttagagtcactaggcttgggttcaaggccatgttcccaccccttccagccacctgacctgggctaaatcacttctcagactagtttcctcccttggataaactgcatagcaataatacccatgtcatagggttgctggtttggccacattatgattttttttctttttgagacagagttttgctcttattgcccaggctggagtacagtggcacagtcttggttcactacaacctccgcctcctgggttcaactgatttttcctgcttcagcctcccgagtagctgggattacaggcacctgccaccatgcccagctaattttttgtatttttagtagagtcggggtttcaccatgttggccaggctggtctcgaactcctgacctcaggtggtccacccgccttggtctcccaaagtgctgggattacaagtgtgcgccactgctggccttttttttttttttttttttttttttttttgagacagagtcttactctgtcacccaggctgaagtgcagtggcatgatctcggctcactgcaacctccgcttcccaggttcaggtgattctcttgcctcagcctcctggtagctaggactacagacacccggcaccacactcagtcacatggatttttttggtgggttccttcctccataagaaaaaaagtgttttaaatcatattttatgactgtgttagtataaggatgaatataacaaggcctggtgcagtggctcatgcctgaaatcccagcactttgggaggccaaagtgggagaattacttcatcccaagagttcaagaacagcctgggcaacatggcaagaccctttctctacaaaaaataaaaaatataaaaattagccggaagtggtggcatgtacctgtggtcccagctcctcgggaggctgaggtgggaagactgcctgagcccagggggtcaaggctgcagtgagccatgattgtgccactgcactccagcctgggcgccagagctcctgctcaaaaataccaaaaactaaaaactaaaaataatatatatatgtaataaaggcagggttatgtttattttttcttctgattttaaaagaagtaaaacattttcatggggccctaaaagtattgtgggccttaggcatcatgccttctgtaagttcataggccctggctgctggaaggagtaaaaaagaaaaaacatgccaaatatgtaaagtgcttagcgcagcactgggcctggctctttgtaacttaataaatggtgatcaaaaattaaaaagtgcaatgcaggccgggtgcagtggctcacgcttgtaatcccagcactttgggaggccaggtgtgcggatcacgaggtcaggggtttgagaccagcctggccaacatggtgaaaccctgtctgtactaaaaaacacaaaattaaccaggcatggtggcacacacctgtaatcccagctacttggaaggctgaggcaggagaattgcttgaacctgggaggtggaggttgcggtgagtcgagatcacaccattgcattccagcctgggcaacaagagtgaaactccgtctcaaaaaaaaaaaaaaaaaaagttgggggtgtagtgcagagaacagagtgtaaccctggagaactctgcagagctttccttttttttttttttttttgagacggagtctcgctctgtcgcctaggctagcacaatctcgactcactgaaacctctgcctcccgggttcaagtgattctcctgcctcaccctcctgagtagcggggattacaggtgcatgccaccatgcccggctaattttttgtatttttagtagagacatggtttcaccatattggccaggctgctcttgaactcctgacctcagttgatctgcccaccttgacctcccaaaatggtgggattacaggcatgggccaccacacctggcctgcagaactttctttattggcatgcattgggacttgcagactcagcttcagctgaatgtaaggaacagttcctgggtccatgttttctcactgtgttcacagagtcttgcaagagattctgcaaaaagacacacagtctatggcatttatcttgagacgagagaaagtatacatttaaggacatgtgcgtgaagaattctggaaggataaagaagatattaatttatagccattacctattgagaaggaaggattgggaatattgtgaataggtccaggagtgggagagagactttccactgtatgcctactgatagttttgatgtgtaaacaatgataatagagtgctgattcaaaaatgttaataattttttttttttttttttttgtgatggagtctcactctatcacccatgctggagtgcagtggcgcaatctcagctcacttcaacatctgcctcccgggttcaagcggttctcctgcctccacctcctgagtagctggaataacacttgtgcaccaccacacccagctaatttttgtatttttagtagagacagggtttcgccacgttggccaggctggtctcgaactcctgacctccggtgatctgccagcctcggcctcccaaagtgctgggattacaggcttgagccactgcacctggctcaaaaatcttagtaatttttttgactgtcctaaattgtttattaggtatgagttttacaaactttacttatattagtggtaacagtggagattgagagtattgcgccttctccaagctgcccggcaagaaccaccaatagtgtggtggaacttacggccctttccaaggccatggctcttttggcctgcacatgccagcccacgcatctccttgtgcttgtggactggtttggtgatccactgggtgtcaggatttcttccaatagctttatggaatggatcaatgaggataacctcaaaaaatttgtgtgtggaatcttcacccatccagtaagaattcaggactcttagagccccacagtggcgtccaactcactcctctgcaatcaactgtaggcttcagttaataccatgatggacaggcttgccgtaagttgcacccttaggaactgagcattttcggccatcacggagaatacgaatcccgtagataacataaccttgcttgatcttgtagcccagttggtgcactttatcgggccgggtggggcggggagccctgtggagagcagagagctggcggtactgccagcagcggaccctcagaagaaagctcatgacatcagactgcttcttcctccacagctcgtggatgtacttgtatgcacccatcttggcttacctgattgctgccgccagacagaagggccaaaaatcttaataatttttattttgaaaaatatatgcatgtggttagaaaaaacttcaaacagttcaaaagggtgaaaagcaactctccctcttgtacccagggagtacctggtaagatataacatctcatacaggacttacagaacctctataaaaactattaaaaaattttgttgagagacagtaaagaagacctaaataaatggagagatatacatgttcattgattggaagagcctagatttgaaggcgccaactcttgtattgattcatagatcaaatttaatcccaatgaaaagctcagcctttttttttttttttttttttttgcagaacttgacaatctgattccaaaactgataggggaataaaagggagtcaaactacccaagacactcttgggaggaaaaaacaaaaccaaaaatgaactgtgggctgggcgcagtggctcacgcctgtaatcccaacactttgggaggccgaggcaggtggatcatctgagatcaggagtttgagaccagcctggccaacatggtgaaaccccgtctctaataaaaatacaaaaattagctgggcatggtggtgggtgcctgtagtcccagctacttgggaggctgagggaagagaatcgcttgaacccaggaggcaatggttgcagtgagtcgagattgtgccactgcactccagcctggcaacagagcgagactccatctcaaagaaaaaaaaaagctagacatcaagttagggagaggaagacaaaccagaacccacattcctttttgacgctgttgtttacttttccattatagccattctagcacaattagagtaatatcttattgtggtctgttgaaatactttagaggaagttacacagatcatgatagattactttaaatgccatgccatatatctctaaaaatacacgtttatgtattggaagactcaatattgttaagatggcgatactactccaaagtgatctatagacttgatgtaatctctatgaaaatcccaatgtccttgtttgcagacctggaaaattcaaacctaaaattcacatggtatcgcacccaacagccaatcttgaaaaatgagcagagttggaagactcacacttggtgacttcagaatttactacaaagcaacaataatcgaaaagtttggtattggtaggaagataggcatatagattagtggaatagaatcgagagtctggaaataacccatacatctatggtcaattgttttgttttgttttgtttttttgacagagtctcaccctgtcacccaggctggagtgcaaaattatcacacctgtaagttccgaaattttttctcttattatttcatctacagctttttttcctgtgttttgtcagttttatttttctgaaatgcttattatttagatgtgggatctttttgtgtgaccttctaatgttctccattttctctgatctctgcaagatttcagcaatttctttcttcttcccttttctttttttacttcttgctttcttaatttctgagagctcctttttgttccctgaatgtttcttttaaaagatatactggtcgggtgcagtggcttacacccgtaataccagcactttgggaagccaataggaggatcgtttgaagccaggaatttcagagaagaattctgcaatctcctcattgaaggttgtggtagtcatacctgaccctgtgaataattctaaccaaggctgggcatggtagcttatgcctgtaaccccagcactttgggatgctgaggcaggtggatcacctgaagtcaggagtttgagaccagcctggccaacatggcgaaaccccatttctactaaaaatacaaaaattagctgggcatggcagtgcatgcctgtaatcccagctacttgggaggctgagggaggagaatcgcttgaacccggagctgagatcatgccattgcaccccagactgggcaacaaaagtgaaattccatctcaaaaagaaaataaaataaaaataaaaaaattctaaccaatgaggtatgattgaaaatgacacacgtctttgccaatcatacttcattggttagaattattattattatttgagacagagtctcactctgttgcccaggctggagtgcagtgttatgatctcggctcactgcagcctctgcctccctggatcaagagattcttctgtctcagcctcccaagtagctgggattacaggcatgcaccatcatgcccagttaattttttatacttttagtagaaatggggcttcactatgttggccaggcttgtcttggactcctcacctcaggttatccacctgccttggcctcccaaagtgctgggattacaggcgtgagccaacatgcctggcctggttagaattattcagagaataattgaacaattattctgtgaacaacctgtaaacgaacaacctgaaaattaaactaaggaaagaaaattaagacaatccacttgcaatagcaccaaaaacaataaaaatacttggtaataaatttaacaaaagatgttcaaaatttgtacactgaaagccatgaaacattgctgaaagacattaaggaagacctaaacaaatagaaaaacatcccatgtgcatggattagaagactcaatattgttaagatgtcaatactacccaaagcaatcaacagatttaatgcaatttcattggtcttttctgcagaagtggaaaggctgattctcaaattcacatggaattgtaaaagactccaaacagccacaacattcttgaaaaaaagaagaacaaagttggagggctcatatttcttgattttaaagcttactacaaagctacagtaatcaaaacagtgtggtattagcttaagaacagacatataaaccaatgaaatagaattgagagtccacaaataaacctatacaattatggtcaattgatttttgacaggtgtgctaagacaattcaatgggagaaagaatagccttttaaaaaaattgtcctaggaccactggataaacatgtacaaaaggatgaagttggaccctaaccttgcaattaccttaaaaattattataaatataagaactaaaactataaaactctcagaagaaaacacaaggatgaattttcatgatcttggacttggcaattaattcttagatatgacaccaaaagtacaagccaaaaaagaaaaatagacaaattagacttcatcaaattaaaaacttttgtgcattgaaggatattattaagaaagtaaaaagacaatgtacagaatgggagaaaatatgtgcacaccatgtatctgataaaagtctatgttttaatgtaattaaaacatgaacaaagttaatttgtgcggcagcaataaaaaagggaaacaaatatgaacaaaggacttgaatagacattcctagaagatacgtaaatcaccaacaggcacataaaaagatgttcaacatcattagtctttagagaaacacagacaaaaaccacagtgaggtctcaattcacacacactaggacagctacaatttttttttaaagtgtgtgtattggggggtgcagctgggaacagtgactcatgccagcactctgggatgccaaggcaggaggatcacttaagtccgggagtttgagaccagcctgggcgacatagcaagactgccatctctccaaaaaattaaaaaattagctgggagtggtggcacacccctgtggttctagctacttgggaaactgagtcgggaggattgaacccaggagtttgaggttgtagtgagctatgatcatgccactgcattctagccagagcaatagggtgagatcctatctctaaattacataaataaataaataagtaaatatgcagaaaataacaaatgctgacaggaatgtggagatattggaacactcatgcattgctggtggaaatgcaaaatggttcagctgctgagaaaaactgtttaatgattcgtcaaaaagttaaacacagaattaccatatatctcagcaattctactcctagaatattcacaaaataaatgaaaacatgcactcacatagatgcacatacacacatgtcgacagaggcactattcaccgcgccggacccaaaacatgtattttcttaggaacaccagatagcacttcagtgctatgcttgggggccatttcaaacagcaaaatcaataataaataccacagaaatgtgaaacctatggcacacaaatgctgcaaaaaggacatttgtggcctggcgcagtggctcacgcctgtaatctcagcacattgggaggccgaggtgggtggatcacctgaggtcaagagttcaagaccagcctgaccaatatggtgaaaccccgtcgctacaaaaaatacaaaaaatagctgggcgtggtggtgggcacgtgtaatcccagccactcgggaggctgagacaggaggattgctcaaacccaggaggcagaggttgcagtgagctgagatcgagccactgcactccaacctggaagacagagtgagactccatctcaaaaaaagaaaaaaaaaaaaaggacatttacaataggacagctgaaacaagaagtcagggtgtggcctcattcaacctcagataggaacatgtgtgttgagcaactcaaattttcttcttttttatttgagacgcagccttgctttgtcacccaggcccaggctgtcccaggcccaggcagtgacgtgatctcggctcactgcaacctctgcctcctgggttcaagtgattctcctgcttcggcctcttgagtagctgggattacaggcacccaccactatgcccaactaatttttgtatttttagtagagactgggtttcgccatgttggccaggctggtctcgaactcctgatctcaagtgatccgccagcctcagcctcccaaagtgctggggttacaggcgtgagccaccgcacccaacccttttttatttttattttcatttttttgagacagggttttgctctgtcacccagactggagtgcagtgatgccattgtggctcactgcagcgtcaacttcccaggctcaagtgatcctcccagcttccaaagtagctgggaccaaaggtgtgcaccaccacagctggctaattttttttgtctatttttggtagagacggggttttgccatgttgctcaggctggtctccaactgctgagctcaagtaatccacccacctcagcctctcaaagtgctggcattccaggtgtgagccatcacgaccagccagggatctcaccattcttaagtgcctctcattgaattctcctgttgatagttgcattgatttctcactccttcttctactctgtctcttgctacatctggaccctctctcattcattttctcaaagacattcatctagaatgtctaatttttgtggttgggatcaatacagttcacttgctttatggggtgggaggagtgtaacttttctttaaactgaattctaagcagttttcagttttaactcactacagtctccatgctatattctgaatgtttatatcccccaaaattcatatgttgaaatcctaacccctaaggtgatggtattaggaggtgagcctttgagagatgattaggtcttgacagtggagttctcatgactgggattagtgcccttataaaagggaccccaggctggatgtggtggctcacgcttgtaatggttcagctaccaaggcccccaaagtgttgagatcgcttgagcccagtggtttgagaccagcctgggcaacatagtgagacgacatctccacttaaaattgaaataataataaataaataaaaaggaccccagagagatcccctgccacttatcataggaaggcacagtgaaaagacagctatctagaaaagcaggtcctctccagacacttgaatctaccagcattttgatcttggacttcggtaccatgttacaacagccatacattgtgctactgatattccatatataattgacattttcagggttttttgttttgttttttgtttttttgttttttttttttttgagacaaaggctcgctctgtcgcccaggctggagtgcagtggcacgatcttggctcactgcaacctccgcctcccgggttcaagtgattatcctgcctcagcctgttgagtagctgggactacaggcatgcaccaccacgcgcagctaatttttgtatttttagtagagatggggttttgccattttggccaggctggtctcgaatgcctgacctcaagtgatctgcccaccttggcctcccaaagtgttgggattacaagagtgagccaccactgcacctggtctcttttctattcgttttgttttttgtttaaataaagacaggggtctccttatgttgcccaggctggtctggaactcctgacctcaagtgatctgcctccctcaccctcccaacgtgctgggattacaggcatgaggcactgaaactggcagaatttgaaggtgaggatttgggcttggcagggaaagtccacgcagagcagagctatgaggaagactgaagcccaagcccaaggtctctcatgacagttaggccatttttggtaaaagatctgaaagtctgaatttggggatcctgtaaataaaacgttcatgggtagggctgaatccaggatgcaaatgaagccatcatgagtctgtttttctccctttcttgacttctgcttgccgtttgttggccccagcctcaggcttcatgtagcagggacacgatggatgtcattcaggtacctgggtcccctcagacttccagtgagaggagtcagaagcaagactctctttccccatattctttttttttttttaaagacgaagtctcactctgttgccccaggctggagtgcattgacaccatctgggctcgctgcaacctctgcctcctgggttcaagcgattctcatgcctcagcctcccgagtagctgggattacaggcatgcgctagcacgtccggctaatttttgtatttttaatagagacggggtttcatcatgttggccaggctggtctggagctcctgacctcaggtgatctgctcgccttggcctcccaaagtgctgggattacaggcgtgagccaccgcacctggcttctttccccagattcttagcccaaattacattgtgactcttgggctgtgactaggtcacatgatctctttgaaccaatcactgtgtccagatgaatgcaatgcactcattgtctaaggctgggaacacattttgggcacagggaatggcctttcaaaactgtacatcaaatcatgtccctttccagtctgaggtcctatccagcaatgattctcaaccaggtcgagtttgccctcccaggggacatttggcaacgtagggaggcatttttggttgtcacaacgtcagggtgtgtgtgcaggtacattcctggcatttggtgggtaggggccaggaatgaggctaaaacatcctgcaatgggtcaggtatgttggctcaaacctgtaattccggagctttgggaagccgcggcaggaggattgcttgagcccaggagtttgacaccagcctgggcaaaatgacaaaacaccatatctacaaagaaaaatacaaaaattagctaggcatggtggcacgtgcctgtggtcccagctactaggaaggttgaggcaagaagatcccttgatcccaggagtatgaggctgtcgtgagctctgatcatgccatgccactccagcctgggtgacagagggaaaccctgtctcaaagaaacaaacaaacaaacaggccaagcatggtggctcacacctgtaatcgcagcactttgggagcctgaggcaggcagatcgcttgagccaggaggattgcttgagcccaggagttcgaggctgcagtgagctatgatcacaccactgcactctgcactccagcatgaacaacagagcaagaccttctccagaaaaaaataaaacccctcaaaaccagacaaagatatctgcaaagataacaggaaataatatttctcccaaggacactgcagctgtcaagtgccatggtgacttcctactgtgaaccactgctttctgacttgctgagaaactttgttccaggaaatcatagataatttgcagtttgaaaatatatcagtgcaggccgggtgcagtggctcacgcctgtaatcccagcactttgggaggccaaggcaggtggatcacctgaggtcaggagttcgagaccagcctgaccaacatggtgaaacccccgtctctactaaaaacacttaagttagccaggcatggtggcgggtgcctgtaattgcagctacttgggaggctgaggcagaactgcttgaccctgggaggtagaggttgcagtgaactgagatcgtgccattgtacttcagtctgggcgacaagaccaaaactctgtctcaaaaaaaaaaaaaaaaaaaaaaaagaaaagaaaaaagaaaagaaaagaaaatatgtcagtacaaatgaaattttttcttcttgcttggaggatctgggcagttggatacccaggcacagcaattcagataagggttccctgaacaaagtggtccacatttactaaactttagaagttaatttttgcctttgtttggtgaagcaacccacagctgctcagttgctctggtgtccctctccctccttttttttttttttttttttttgagacagggtctcactctgttgcccaggctgcagtgcagtggtgcaatcacagctcagtagaacctctacctcctgggctcaagcaatcctcccacctcagcctcccgagtagctgggaatacaggcatgtaccaccatgcttggctaatttttgtattgtttgtggagatggggttttgccatgttgccccagctggtcttgaactcctagcttcaagtgatcccccagcctcggcctcccaaagtgctgggattataggcgtgagccaccatccagcctttccttgttttcaataaatgaataaacctgactttctcactaaaggttagtccctggtggccaggctggtctcgaactcctgggctcaagcaatcctcccacctcggcctctcaaagtgctgggattatatgtgtgagccatcacgctcagcctcatttatgtatttgttatggctgcctttgcactcccatgatagatgtgagaaatggtggcagagactgcagggcctgcaaagcctaaaaaatttacaatctggctctttacagaaaaactttgctgacccctggtctaaatgttctgagtacataagtgagcaaaacatagctaaatccctccatcatggagctgaaattctagtgggaaaaagaaaaggatttacatacttacaagacaccataaatacatctagtatatgacttgtatataacttagggtaattaaatggtaagaaaagaagtggccgggcatggtggctcacacctgtaatcccagcactttggggggccgaggtgggcgggtcacctgaggccaggagttcaagaccagcctggccaacatggcaaaaccctatctctactaaaaatacaaaaattagctgggcgtggtggtgccaacccgtaatcccagctgctcgggaagctaaggtgggaggaagcaccatgcccggcctgcttccactttttggctactgtgaataatgctgttgtgaacatgggtgtacaaatatctgttcaaacccctgctttcactacttctttttttttttttttgagacggagtttcactcttgatgcccaggctggagtgcaatggtgcaatcttggctcaccacaacctctgcctcctgggttcaagcgattctcctgcctcagcctcctgagtatctgggattacaggcacgcgccactgtgcccggctaattttatatttttagtagagagaggatttctccttgttggtcaggttggtctcgaactcatgacttcaggtaatgcacctgcttcgggatcccaaagtgctgggattacagacgtgagccactgcgcccggcctctcttattttggttatatacctagaagtagaattgttgtatttttttccagcaggattttataccaaggacaaagggaggccatgggaagctgcatgcagggtgctttactaggtcccctggggctgctgtgaggcattctgattgtagtggggaaagaaaggaagtggggagaccaaggaggaggtaggtacagaagttcaggtcacaggtagcagcagcttcaaggtcccaatctgggccaggcgctcacgcctgtaatcctagcactttgggaggccaaggcgggcggatcacttgaggtcaggagttcaagaccagcctggccaacatggtgaaaccccgtctctaccaaaaatacaaaaattggctgggcgtggtggtgtgtgcctgtagtcccagctacttaagagactgaggcaggagaatcgcttgaacctgggagatgcaggttgcggcgagccaagatcctgccactgcactccagcctgggcgacagagcgagactctatcttaaaaaaaaataaaaataaaattaaaaaaatgctctcagtctggcaggggaggccatatggagcaaataaataaatgaatgattacaaatagtgaaaagtactcctaaataaatgaacaagaacagagtgctgtgattacaggaaataaaaagaggaactctggcattctctgtgctacctatcagtttagtgatgcttgaaatccaaaattcaaatcttgcattttaatcatgaatcactttgctgccagttgagtgggtttgatgcagggccgagtctgttggtctaagggtttgttacattgtgagagcccctaatggggaggaaggggcttagaaataaggcaaagggggtggtttgagcctgtggctgaaagagttgcacagagaggcttggtggttaggagcagagctgagccttatctctgccacatcccagctgctggatctgcaacaaattacttcttccctctaaacccagtttccgcttttggaaaatggtagactaattggtttggtctataattacttccttctttgttttggtcactcctgtgtctacagcacctaatacagtatccggcacacaggagactcgcaataaatttctttcttgcttttctttctttccttgtctttccctccttccctccctcccttctttctttctcgctgtctgtctttctcgctctttctctttctttctttctctctctctcttttctttctttctctctctctctttctttcctttcttgatggagtctcactctgtctctgagactggagtgcagtggcgccatctcggctcacctcaacctctgcctcctgggttcaagtgattctcctgcctccacctcctgagtagcttggattacaggcatgcgccaccatgcctggctaatttttgtatttttagtagagacggtgtttcaccatattggtcaggctggtcttgaactcctgacctcaggtgatccacccgcttcggcctcccagagtgttgggattacaggcgtgagccaccgtgcccgactctcgtttatttattttctattttaaaaattttaattgaggctgcgcacagtggctcatgcctgtaatcccagcgctttgggaggctaaggcaggagggtcgcctgcggccaggagttcaagaccaacttgggtaacgtagtgagatcccattttacataaatattgcaaaaaatgttagtcaggcgtggtggtgtcccccatagtcacagctacttggggggctaaggcaggaagattgcttgagtccaagagtttgaggctacagtgagcacccactgctctctagcctgaagaacagagcaagagcaagatcatagctcaaaaaaatttttttaattgagtttaactttcatagagcaaagtacagcaactttaaatgtcctcttgatgaagttttttttttttttttgagacggagtctcactctgttgcccaggctggagtgccgtggcacgatctcggctcactgcaatctctgcctcctgggttcaagtgattctcctgctgcagcctccagagtagctggcattacaggcatgcaccaggacacctaatttatgtatttttagtagagatgcgggtctgccatgttggccaggctggtcttgaactcctgacctcaagtgatccacccaccttggcttcccaaagtgatgggtgggattacaggcatgagccactgcacctagccaagctcaatgaattttaaaatataaatgtgtgtgtacgtgtgtgtgtgtgtgtgtgtgtgtgtgtatatatatatatatatatatatatgtttaaaaccacataactaccaccaaatcaagttatagaacatttacatctccctaggacatttcttcctatcttgactttgatcaacatatgttgttgttattattattattattattattattattattattattattcagagacagggtctacctctgttgcccaggctggagtgcagtgttgcaatcgtacacaattcaccgcagtctggaactctggggctcaagcaattctcctatctcagtttcctgagtagctaggaccacaggtgtgtgccaatatgcccagctaatctttaaaattgttttgttgaggcaggcatggtggctcacgcctgtaaccccagcactttgggaggccgaggcaggtggatcacaaggtcaggagtttgagaccagcctggccaacatggtgaaacgccgtctctactaaagatacaaaaaaattagccaggcaccgtggcacgcacctgtaatcccagctacttgggaaactggggcaggagaatcacttgaacccggaaggcagaggttgcagtgagctgagatcatgcctccgcactccaacctgggccaaagggagagagtctgtctcaaaaaataaaaaaaaaaaagaaatttgttttgtagaaatgaggtctcactatgttgcccaggctggtctcaaacttctggcctgatgagcaatccgcctgcctgggcctcccagattgctggtattacagacatgagccacagtgcctggctcttgaataatgtatattagttttgcctattgttgaacatcgtgtaaatgagatcatggcaaatatgctcttttgtgtctgccttgttttgctccttgttgtgttttgtgggattcatacatattgttgctattatgaacattttttgtagatgtgttttggtggatgtaagctcacctttcttttggaggcgagtggaatttctgtgtcactatgtaattgtatgtttcactttagcacgaattattagttttctttcttttttggagatggagtctcactctgtcacctaggctggagtgaagtggtgcgatcttggctcagagcaacctgtgcctcctgggttcaagtgagtgttgtgcctcagctccccaagtagctgagactataggcatgtgccacaacgcccagctaattttattttattttattttacttttgagacagagtctcactctgtcgcccaggctggagcgcggtggcgcgatcttagctcactgcaacctgcgcctcccaggttcaagcagttctcctgccttagcctcccgagtagctcggattacaggcatgtgccaccatgcctggctaatttttttgtattgttaatagagatggggtttcctcatgtcagccaggctggtcttgaactcctgagctcaggcaatccacccaccttggcccacctttttgtattttttgtagagatggggtttcaccatgttgctcaggctggtctcaatctcctgagctcaagagatccacctgcctcggccacccaaagtgctgggattacaggcatgagccactgcacccagccaaattgttagttttccaaagtagttaagccaatttatatacctcccaacagagcgtgccttttccagttaatccacgtctttgtctgcactcgtaattttcagtctttgtttccagtcactctggtgggtgtatgatggtatttcactggggttttatttgcatttccctgatgactaatgaagttgagcatgttttcatgtgcttgctcaataaatatttgttgaaaggatgaataaagagtgaatgaataaaacatggaaagaaatccaactctgtcttgtgccctgcctaaaacccaccagtggttcccactgcccctcctttggccgacgggtacctgcctgccctggctccttctgaccccacctgctccggatggatttcttttgcttcttctctgggttcctgccatccaggctgtcttcagtttcctccaaggaccctccctgcttcataactttgctataaactgttttcttctgcccagaacacaacccaggcccaaggaacccagacgcgttccttgtatctcagtttgaaagcctcttcctccaggaagccttctctgacttccaccccccagcaagggtggtataaattgctaacttaggcccacttttgcccactttttttgtttgtgtttttgagatggagtcacactttgtcgtccaggctggagtgcagtggggccatctcagctcactgcaacctccatctcctgggttcaagtgattctcctgccttagcttcctgaatagctgggattacaggcacccaccaccatgtccagctaatttttgtatttttacatttatttatttatttatttgagatagagtattgctttgtcgcccaggctggagtgcagtggcatgatcttggcttactgcaacctccgcctcccaggttcaagtgattctcctgcctcagcctcccgagtagctgagcctgcaggtgcctgccaccacacccagctaatttttgtatttttagtagagatggggttttaccatcggtcagactggtctcgaactcctgaccttaagtgatctgcctgccttggcctcccaaagtgctgggattacaggcgtgagccaccatgcccggccaccactttttttttctagctgtgaccatagttgtacatatctccccttccctggcttttttttttgttttttttttcctgagacaggatctcgctgtgttacccaggctgcagtgcagcggtgcaatcatagctcactgtagccttgaactcctgggccaaatgagcctcccacctcggcctcccaaagcactgagattacatgcgtgagtcactacttctggcctgtaaataccctttcaaaaatataatatttgattaacatctgccatcttaccataagaaacacttaaaaaaatcccaatccaaaaaaattccaatcctttaagctatataagagtagcaattttatcttgttcctagcaagacatctggcatatagtaaatgctcaataaatatttgttgacagtataaaggtcaagcaacagcataactggcattattacatgaaagtaattatcccttagaaactcattcacccttgggggacccgggccaataaaaaaatcacagaaaacaatcctatctaccttcctccttcctccttccctcgctaggtcctttgattggggggaggtctcaaatgcacacactgtttctgttttatttggtgcagctgttgtgtgcatgtgttatggaaacccacatcaggcaggagattaaggaggagaggagaaaagaaaggcatcgctggtatcacagtgaaatttacactctgcggcctcgccctagctcctctgtctctacctgtctgcctatgaaacagttcaaaactaatatggcgcaatggatggtattatagacttcccacctccctggccagacttcttgggttcaaagtttggcttaatcacttaccatctaaataatccctgacaatgtactctgtctttctgggccttagtggcctcatctgcaaaatggggataatactacttcttacctcatggggttgtgaggattgcacaagttaatttgtgtaaattgctaagaacacagccttaggaagccttgtcactgtgaatgcatattaattttttttattattattttttgagacagagtcttgctctgttgcccaggctggagtgcagtggtgtgatctaagctcatttcaacctccgcctcccaggttcaagtgattctcctgtttcagcttctcaagtagctgggactacaggtgcccgccaccatgcccggctaatttttgtgtttttagtagagacagggttttgctatgttggctaggctggtcttgaactcctgaccttatgtgatcggcccgcctcggcttcccaaagtgcttgattacaagcacgagccaccatgcctggcctacgattatcatgtctccaggcttcagtttccttacctctgaggtgaggatcaataacctggttatttctaagtgatgcttaaagaggttgagaagaagcaaaggcgctctgcacacaggtgaggtcaacagctgttagtgatggagactggcgccgtctgggtcatcagtgctccggaatcaggctgctcacgggtttgaatctcacttccactttcactccttattaactgtgtgacctcgggcaagtcacttcgcctttctgaacctcagtttccccatctgtaaaaggtaggtgaataacagtattcacctccttctgtgtgactcagctttggagtcagcggaccgggttcaaatcccagccctgcaagtgattagccaggtgaccctgggcagagggaatcactcaacctctctgcacctgggtttcttccttcatgaacgtggagactttacaggatgaaatgagggcacagttaaggcgcccggtacactccaggcaggtagggggctccgttcacgttattttcccctggtgacggatactgtccttaaacagcatttgaaaagtggtcgcagggtgtgtggccccaaagatcccaggcgcttccggaaggcgagccaacgctccccaggcccgtccgcgagcgggtgggcctaagccttggaggatctggggtgggggtggcgcggggtccaggcccggggcgccgagaggtggctggtccggctgcccacgccgagacgcgcgaggtgagcgggcgccggggcggggcggggtggggcggggccgccgcatccccgtgacgcgcgggccaaccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggtacgtgccgggggccgcgtgaggccggcgggacggagggaggccggcggggagggaaagcaccgggcccgcagccgcccggggcaccccgctccccgctctgctgccggcctcgggggcccgggaccctcacgtcgcccgcggcccagcccctttcgggggtgcaaggcatgggggaaacttgggtgactcagttcctgcggagcagagcgtggggggccgcgtgcccagccctggggttttggagggtcgggtcgggtcagagccgccgtgaggaggccttcctgttttggggttcccgtctgtaaaaacaaccttccagggaaggggacgctagagatggggggcgggaagaggggtgtctctctgcttctgttttcccatcttttttgtggttagggtccccccttttcacgaaaaatactccgtgaccaacggggtgagctggggaggggcttagattgtagaaagggactttcattgtctccccaaagttgtcgtacaagccacattactcttctgtggttacctagctttgttttttttgttctttctacttagatactgcgggggaagtttgggggaaccagggaagaagggggatgtccacccttgatgtgccctacctgaccctcggctcggggcagacttggggtgcagctgaggacgcccaggaccctggtagctgtggtcctgccctcccttccctgcaacacgtggagctcctctctggggatgccccttagatttaaccccggcaagttttcttctgtaacgtggcctgcggagcctgactgggtgtctggagtccacttgctgtggtttaagccccagtcttttgggcttcagcttctccgtaatgcgatttgcctctttgttccaggaaggcaggcacttctgtctcgtgctgtcttgattgttggtgaacgcagtaggcaaatctggacacgactgtttctctctcctcttttgtttaggaatcaggagaaacagccttggttcttaggagctggtgatcagcttccaaaaatactttcttgtcctgttttgccggcctttcctcgagggttgcatttggagtgttgaaaagtcatcctccagggccccattggagggtttggttttgtttgtttgttttttttagtagggtatcattgtgtttaataacctaccacactttgatatatctcccattttaagccagtggggttggagagtaaccccaggggtggaaatagaacacagactttgccttgagggtctgggggtgattggagcctctttgcagatggactttctttagcaggggaaaacctgtggcttccttgttgccaggtgtagtaacagcaagattattttttgcaaagattcacatggtgatctgggtttgtgttgctgtgaattccagaatattctcttgtttattttcttctgaattgaggagggggcaaaacagggtgaacatccatgaggttttgtatcaggacgtattttattgatggcaattggtagttgatggctaatgagtatgtttggggtgcgctttgtttatcttaagaaactcattcacgaagtccagttgtaatattttttaaaatttttattttcttttttctttttattttttccttcgttaaggactttctgccacagaaattgccaggtggttgggttttgcttgggggtaattgtagctgatctctgcctctggtaggtaccccatccccgtgtttgaccttgcgtatttctgctgtctggattccaagacttgttggaggtgccttggaaccagaatttgagaggaggcaactggggcctgagtgggaaaattgaaatataattaactgaaagctagaaagtaggtagttgttgcttttttcttttcttttttttttctttttcttttttgagacagagtcttgctctgtcacccaggctggagtgcagtggcacgatctcagcttactgcaatctctgcctccccggctcaagtggtcctcctaactcagcctcccaagtacctgggactataggcgtgtgccaccacgcccagctaatttttgtattttttatagagacagattcgcactatattgcccaggctggtctcctactcctgggctcaagcgatcctcctgccttggcctccaaaagtgttgagattacaggcatgggcctctgtgcccggctgtttttgtgtttttcaaggtagcgtgtccgaggccaggagcgactggcctcccaggcagtcagataactgtgtgaccttgagcaagccactttccctctgtgtgcctcactttcctcatctctaaaattggacaggagccaaaaatgtggcagccttcttgggttgttgcgaagggtcaatgagttaatcttgtaagtggctcagcttgtgccctgcacggagataaacaatggttagtattaaatattattttttccaaagatgaagttgtgtgttttaagctccttgttcttcctttggattccccttttcttcagctggtggagatgggattgggctgtgaaaaggcagtgaggcacccgtgcctggctcctgttgtgaccaaggtcatgtgcttagaagtcaaggtcagtgggcctcgggtgactctgtcagagctttgtttctgggctactgtctgcctctgagccgcaggaaatgtccagaaaacccagaagatggaaatggcccatgataagtgttctgttgacctttactcagacagatgctctgggaagagaaaaggagaactttgctatcaaaacggaaaatagggcctgaggacaggtcacagcagcccttggctttcttttctcatgggggtgggactggtaggaggcgctgctttgtggttgatattggcatgatggttggaaaaatgggcctgggactttttgtgagttcattaaaaaaaaaaaaaaaaaaaaaaaaaaaagcaggccgggtgcagtggctcacgcctgtaatcccagcactttgggaggctgaggcaggcggattgcttgaggtcaggagttcgagaccagcctaggcaacatggattgacccccgtctctactaataataccaaaaaaaaaaaaaaagcctggcatggtggtgtggcacctgtggtcccggctactagggaggctgaggcactagaatcacttgaaggctgtgggggtggaggttgcaatgagctgagatcacggtcactgcactccagtctgggccacagactgagaccctgtctcaaaaaaaagagggccgggtgtagtagatcatgcctgtaatcccagcactttgggaggccaaggcaggcggatcacctgaggtcaggggttcaagaccagcctgaccaacatggcaaaaccccatccctactaaaaatacaaaaattagctgggcctggtgattcacgcctgtaattccagctacttgggaggctgaggcaggagaattgcttgaacctgggaagaggttgcagtgagctgagatcacatcactgcactccaacctgggcgacagagagactgtctcaaaagaaaaaaaaaattgtgcttcaggccctgtgtagaaaaattggaaattatggaaaagcagaggaaacaacttggtattaagcagtatagtgtggtggctcagagcaaattcgcctctgctgctgaggcaggttacgtcatctctccgtgcctcagtttccctatgtgggataacgtagtacctagtgaatagcggtgacttgaggaataagtgagttaatccttagcaaggacttaaaatgttgctgcttggcacacagcgctcagtaaagatcagtggtcgttgccacctggaattctccagttaatttttgctgttgcaccaactgccactggagaagaccagaaggaagctgcaggtgtgtgtcaccgtcgatggagtgagctggtcccagggttgatgtgcacctctgagatgctctgtggcatccaccaactcagtaaccccctgaatatctgacttagccgccaaggaagaatatcttagaagctattaggaattcctcttggggctaggtctgggccttggagtcagtctgatccctggtttaattcttccccttggctcaacagcagtgtacgacgagccaatttttcccctcctccaagtgtggctttggttttcaaatccatcccttagccttctcctacttcctctgttttcccctccccaccctttttttttttttttttttgagatggtgtcttgctgtgtcgcccaggctagggtgcagtggtgtgatctcggttcactacaacctctgcctgctgcgttcacatgattcccctgcctcaggctcccgagtagctgggattacaggcgcacagccaccatgcctggctaagttttgtatttttacaaaactttacaaaacccccatagagacggggtttcatcatgttggccaggctggtcttgaactcctgacctcaagtggtcaacctgcctcagcctcccaaagtgttggggattgcaagcgtgagccaccgcgctcagcctgttttccccctttttggctgcccctccttccagacccttcctctctcccttccttatggagtgttagagtggaaagggatgtcagatcttggggggccctcctctccacccaccccatttcgtggatgtggacactgaggtccaggatggtgacatgacagggtgcaaggtggcaaggtgaatggctttgggaggagatgagggtgacccgggagaggcctgggcaggagtggactcaggggttcctggtccaaatgggttcgtgattcaggccaatcaggagcggattcagggttccttggccaaatggagccactgcagccacaggggccctgcagaaggcagctgcagccggtccctttggccaagactctcctgaagggtcgtgttctctttctccgaggacaagttccatttgtgatagcctggagggggtgcctcgcctttgggacctggtggtagatgggggggaagaaaaccttttctgtttgtggacacaacttttaggaactgatctctctatgtgggtgtctcccactgaccatgttcctaaagaacgtgagcttcctcttcccatgtcagtctccagctttgacttctctttttctcctcccattcctatcacatctgtcagcaaatcgtgttgcccgttgcctcaaacgggctgcttttcatggcttccccgacttccactctggctcgagtcatcgttggccagtttctggatttgaacagtcacctcagtccaggcgccgtggctcatgcctgtaatcctggcacttcgggaggccaaggcagacggatcatttgaggccaggagtttgagaccagtctgggcagaatggtgaaaacctgtctcaactaaaaatacaaaaattagccgagcctggtggtgggcgcctgtaatcccagctacttgggaggctgaggcaggagaatcgcttgagcccagtggggttggaggttgcagtgagccgagagttcgccactgcgctccagcctgggtgacagtgagactctgtctcaaaaaaaaagaaaacagccacctgttcgctgctgtgcctactctgcccttgacccctacagtctagtcttggcccagctgtccctcttctactaaaaccctgcagtagttccttgagggtacaagccaaagggcttacagtggcctcgaaggctgggcagcatctgtccccttggcctccctgacctcttctctggctgctttctgtctcactctcctccagccacacttgtggccaggcctgtccctgcctcagggcctttgcacttgctgtttctcctacctactatgtccctcaccttcaaactttgttcaggtgtcacctcaggcatcccgttctttccctccactagcaaatctctgtcccccatctacacccccagtagcacttactgccttctaatacacgtaatattttgcttaagtattgtgcctactctgtaaactcctaccaaaagatcggctccataggggcagggattttggcctgtgtttgtttacggctgtaatcccagcacctagaactgtgcctggggcttagtaaataacagttgaccttggaacaattcaggggttaggagtgctgatgccccatgtagttgaaaatttaggatgcagcgcggtggcttacacctgtaatctcagcactttgggaggccgaggcaggtggattacctgaggtcaggagttccagactagtctggccaacatggtgaaagcccatctctacaaaaattagccaggtgtggtggctcatgcctgtaatctcagcactttgggaggccaaggcaggcagatcacttgaggtcaggagtttgagaccagcctggccaacatggtaaaaccctgtctctacaaaaattagctgggtgtggtggcgggtgcctgtaatcccagctacttgagaagctgaggcatgagcattgcttgaacctggtaggcggacactgcagtgagccgagatcgcgccattgcactccagcttgggtgacagagtaagactctgtctaaaaaaaaaaaaacacaataaaggaaagaaaattcaggtctaactttcaactccctaaaagtttaactactaacagcttactgttgactggaagccttaccgagaacataagcagttgataacactaattctgttgttgttggttgttttttgatagagatggggagcttgctgtgttgccgaggctggtctcaaactcctggcctcaagctattcacctgcctcggcctcctaaagtgctgggattataggcgtgagccactgcacttggcctaactcataccttgtatatatattatatactgtatttttacagtgaagcaaggtagagaaaagaaaatgttaagattaattcataagagagatttttactatttattaagtggaagtggatcatcataaaggtcttcatcttcattgtcttcacgttgaggaggctaaggaggaggaggaaggggaggggttggtcttgctatctcagggatggcagaggcagaagcataatctgagtataagtggacccgtgcagtttaaatgtgtgttgttcaagggtcagctgtttgttgaataaatgaatgacatgaagtattacagtggcttttgggcggtgtcgaaacttctttgtaaggattttaaggatgaaataatcacttaactgtctggaatgaacactcagataaactgagtcctccagctttctcatcagatggcttgtttttttattttatttttttgagacagggtcttgctctgtcacccaggctggagtgcagtggcgcgacctcagctcactgcagcctcaacctcctgagctcaagcaattctcccacttcagctccccaggtagctgggactacaggcacacaccaccatgcccagctaattttttttttttttttttttgtagagatagggttttgccatgttgctcaggttggtggtgaactcctgaactcaggcgatctgcctgccttggcctcccaaagtgctgggattataggtgtgagccaccgtgcttggcagaacagcttctatttcatcttggaaaggtcagaacagggttttgtccacccctcttttcccaggactcagtgtctcacacacagtgggggctcaatcaacattagaatttgagtgtttgaggtatgagttccaagctaggggttagatatagctcaccactgtgctggtttggcttgattttaattataggaatgactgtgatttccaattttatttatttatttatttgagacggagtcttgctctgttgccaggctggagtgcagtggcacgatcttggctcactgcaacctctgcctcctgggttcaagcaattctgcctcagcctccccagtagctgggactacaggggcacgccaccacatccagctaatttttgtgtttttgatagaaacggggtttccagtatgttggccagcatggcctcgatctcttgacctcgtgatccgcccgcctcggcctcctaaagtgctgggattacaggcatgagccactgtggcccgccctacaatgtttattcattggcagatttcacagaaacatctggatttctggcttcccttgaaaaatcagaagttctgctagccccaggcccacatttatacatggtagcggtccgctgaggctgtccgtttctgagttgctccagtttgccgcagtccccacccctccctgttgttgctttaattttaaggccaaatgtttgttgcctttgttttattttatattatttttttgagacgaagtctcgctctgtcacccaggctggagtgcagtagtggaatctcggctcactgcaacctctgcctcccgggttccagtgattctgctgcctcagcttcccgagtagctgggattacaggcccgcaccaccacactcggcttatttttgtatttttagtagagatggggtttctccatattggccaggctggtcttgaattcctgaactcaagtggatcacttgagttcctcagcctcccaaagtgctgggattacaggcatgagccaccgtgcctggcctgttgcctttttaaaattgtgcttcctcacacctggtctgcttcttgcatggatggaacccactttggcacctgttggtatctgagttggcatctcctgctttgcaggccaaccttgaagttagcatctgattggtatgttggcttcagattttcatggcgaagtaaggcctagctttgatgatcagctcttagtgtggtcagtacaactctagctcgtgaaaacttgcccaaacattttgccaaaattaattaatggccagacatcctgaggcaagcttccccccgcttagcaagaaaactgggatagggcagcatccctgtgggtggagtggtgctggggacctgcacttacctcttagaggctgaatggttgaacggggcctttgaggaagctgtattttgcgggtggggacatggagcacagttgctcagtgtcggccccgttgacatgtaggccacatcattctttgtggcctggttgctgttctgtgcagcgtagtcttagccccaaacctggcctctaccccctagtagatgctggtagcacctcctcttgttgtgacaaccgaaaatgcctctagatgtttccatatgttccctggggtgtgaaatcacacagccactggtgtggaggaatatgggggagaaacatggagcaagaccttcctcctcatcctgcatttccctaggaggttgtgggctgtcgaaattctagtgtaattggcttactggggttgccttggagaagcttaatgagacgttaaggaggttaaactccaattagctagagaagaaacttgcggcagtttcttttttactgagggctgtgtctttttacctttttccattttcccagttggagttgtgacagttcattctcccctgggaaaacaaaaatggctttctttttctttttctttcttttttcttttgagacagggtctccctctgtcacccaggctggagtgcagtggcacaatcatagctcactgcagcctcgacctcctgggctgaagctatcttcccaccttagcctcccaggtagctgggaccagaggtgcacaccaccatacccggctaatttttgtattttttgtagagtcagggtctcaccatgttgcccaggcttgtctcaaactcctgggctcaagcgatcctcctgcctcggcctcccaaagtgctgggattacaggcgtgagccaccatgcccagccgaaaatggctttcttgagagatcagctttgaagctctactccttcattttaaagtgccccaggagaagtggacgattacaaagttgagattccacttaagtgtccccttagtttaactgtgggattcatctcctggggaggttgccaggttctggaaagtgggtgttaatgaccagggagggtgcccctaggctagcatcctgtaaccctcaggaattgagatttttatggaggttttctcttcctctctgtgagttttctctctgagaaacctgtctagggagggaggctctaggctagcatcctgtaaccctcaagtagtaattgagatttttatggagcttttatcttcctctctgtgagttttctctctgaggaacctcagtgtaccttttactggcctcctaggtaatacttgtttggagaatatgtgtgatgtctaagtcttcccagtacaagaaatttgtgtggtgtttgactgattgatggatggagtcttgttctgtcgccctagctgattgtaccactgcactgcagtctcgacctcccaggccaagtgaccctcccaactcaccctcccaagtagctgggactacaggcatgcaccagcacacccggctaatttttgtatttttttttgtagagatggggtttcactatgttgcccagtttggtcttgaactcttgagctcaagcagtctcccagagtgctgggattacaggtgtgagccaccacgcccagcctcgtgtggtctttgatacccctgggttcattgtattgttcttcccacactgcttttcattcattcatttattcagtcattattaattgagcagctactatgtgctgctgctgctctaggcactgaggatacaacagtgaacaggacagaccaggcccatgttctcatggggtttacactgagggtgacggaaatgatttcagatgctggcaagtgctgcaaagacttgaaccgggaaaaactgggtgaggtgcaaactactacggagggatgtccacagaaggcctttcggaggcggtgaggtttgaccccagagctcagtggcaaagctggccatgcaaggatgtgggggaagggagtcccagagtgggaagagaatgtgcataggccttgaggaagatcatggtgtggttaaagtattgaggagtttaactcaaaggaactgcagagcccatctcataaaaatctagcctggagcattcggcaaaatgcataaagcactaacacaatggcttgtggtcctggaatttccagggaaggcgcttaccagctcagcaaggaagtagaacaatgcatggtccctggcagaagcaagaaccttctgatctgtttatgtttgaatgaaacgcaggttttttttttttttttttttttttaaaatagatgggggtcttgctatgctgctcaggctggtctcgaactcctgggctcaagcaatccacccaccttggcccttccatgtgctgggattacaggcatgaggcactacgccctgctgaatctcaggtcttaaaaattcagtttattttgttttatgagtctcttctctttctcagaaccttaactgaaacgtttgtgatcaagaccaacttgggtttccccactccccagttgcctttgattctccgccaaaggcttgttcgtaagatgatgaggtacttttttcctgtggttaagaggactttctataggttgctagaaaactcttgttttaaaacaagatgttgttgaattgatctggctgattgcaggaggaagatcttgtactgcaactttgttgatgatgctaatactttaaggtgaatattctagaagaatataaagggaaaaataaaagttttagtatgttcccaccctgccctttgttcccagaagtagccgttattgatgatggttgttgatgatagtttcttgggtgtttttcgagaaaagtttcaagtatatgcaaatgtatgtgcaagaacgtgttcgtttgtgtgtatatgtttacatattcattttttccctccctagttgggtattttaaatactgttttgtctcttgttctcttcacttaaccagtgttgattttcttgccattttaagcccatgcaaattgaaagtaaaagccaatcaaatcaacttttttttttttttttttttaaacaagccacgcatttgcctgttaaatggctgagccatgtattcacccattcccctcttggtgtctatcaaggtcattcccagttcctggtttcttgctgtgataagcagtgctgcactgaaggcacatgtatgcaaatatatgtaaatgattcagcagaataaattttcccacaggaaattgctaggttgacagtatgtgcattttgaaatttgatagttaattgtcaggttactgcagcagtttatactcccactaatgggcccaccagcacttattaagcacctgttgttttcctgccatatcagaaaaattgagcaagctgggaagtgatcaggcccatgttgcttggctgtgtgtgagagggctttgcccagttaagttaaaccttactttccagaggtcaggagatcaaagcagaagtgtgctttggttttgttcagttttttaaaagatgtgtttaaattttaaacatctttggacttattttaaaaattgcttttaaatcaataatttaacaatgtgtaaaaacattactgatagtctcaccatgctaatgtcactctgatttttacacctaaactaatttaattgcagagttttctgatcacaagtgacatgtgttccatatgacagaacaaacaatacaaagatatttaaataaagcctgaacatggtactgatattagtttgttcatgctgctatgaaaaaatacctgagactgcgtagtttataaaggaaagaggtttaattgactcacagttctgcatggctggggaggcctcaggaaacttaaaatgatggtggaaaggaaagcaaacatgtccttcttcacatggtggcaggagacagaagtgcagagtaaagaggagaaaagccggtataaaaccatcagatcttctgaggactcactatcaggagaacagcatgggggaaccgctcccatgatctaatcacctccagtgaggtccctccaccaacacgtggggattacaattaagattacaattcaagatgagatttgtgcggggacacagagccgtgccatatcattctgcccctggcccctcccaaatctcatctttctcatatttcaaaacacaattatgccttcccaacagttccccaaagtcttaactcatttcagcattaactcaaaagtctatgtccaaaatctcatctgagacaaaatctagtctctttcacctatcagcctgtaaaatcaaaagaagttagttagttcctagatacaatgggggtacaggcattggataaatacacccgtttgaaatgggagaaattggccaaaacaaaggggctgcaggccccatgcaagtctgaaatccaataggccagtcataaaactttcaagttccatagttatctcctttgactccgtgtctcacatccaggtcacactgttgcaagaggtgggcttccacggccttgggcagctctgcccctgtggctttgcagggtatagccccgctcctggctgctttcacaggttggcgttgagtgtctccgtcttttccaggcacacgatgtagctgcaggtggatctaccattctgggttctggatggtggcccttttctcacagctccattaggcagtaccccagtggggactctgtgtgggggctctgaccccatatttcccttctttactgcattggtagaggttctccataaaggctccacccctgcagcaaacttctggctggacatccaggcatttgcatacatcctctgaaatctaggtggaggtttccaaacctcagttctttagttctatgtacccacaggctcaataccacatggaagctgccgaggcttggggcttgcaccctctgaaggcacagcctgagctgtgtaccttggctcctcttagccatgactggagtggctgggcaccaagtcctaaggctgcacacatcaggggggccctggacccagcccaggaaaccgtttttccctcctaggcctgtgatgggaggggctgctgtgaaggtttgtgatatgccctggagacattttccccattgtcttggaattgggctccttgttacttttgcaagtttctgcagccggcttgaatttctcttcagaaaatgggtttttctttttacattgtcagactgcaaatttccacactttttttttttttgagatggagtctctctctgttgcccaggctagagtgcaatggcatgatctcggctcattgcaacctctgcctcctgggttcaagcaattctcctgcctcagcatcccgagtagctgggattacaggcacccgccatcatgcctggctaatgtttgtatttttgtagagacaggatttcaccatgctggctagactggtctcgaattcctgacctcaagtgatctgcccaccttggcctcccaaagtgctgggattacaggcgtgagccactgcgcccggccaatttccacccttttatgctctgcttcctcttgaatgctttgctgcttagtaatttcttcccctagatgccctaaatcttctctctcaagttcaaagttccacagatctctagggcagggtcaaaatgctgccagtctctttgctaaagcatagcaaggatcaggagaacagcatgggggaaccgtccccatgatctaatcacctcccatgatgtcccttccctaatatgtggggattccaattcagattacaattcaagatgggatttaggtggggacacagagccagaccatatcagtaatctcttgggctaaccaataaccaatgtattcttgtattttttctttgaaattttataaatatttataaatttaaataacatttaaatcaaaatggattatgttgtaatcattactctgccagttttttttttttaatttttaaatttattttttgtagagacaggatctccctatgttacccaggctggttttgaacccctggactgaatcgatcctccggctttggcctcccaaagtgctgggatcaaagtttgttaatttgatagctaaaatatattttcatctgcatttcaattacaattagaagctatgtatcctgcaacatattttccagcaatttgtgtattttcagtgtgtctttctgagtcctttttgggtatgcctggactagtttgtctttttcctgttagtttgtaagggctcttgttattgtgggacctttcctctttgtccatcacctgtattgtataaatattttgttacaggctattgttttcctattggcatattaacatttgagtcttgttcttactagtatgtagttttgcaaggttgcatttgtagcttgcatactgtctcctatgtttttatttactgtaataagtattttcccatgtacccacgtaacctttttaattaaacctataaatgtccaatcgatagttccctgtgttggtgggctataatcacataattattatctgtggtttgacatttgggttgctgtgttttctttctccttttttttttttattattatttttgagacggagtcttgttctgtcgcccaggctgaagtgcagtggtgcgaccttggctcactgcaagctccgcctcccaggttcacgccattctcctgcctcagcctcccaagtagctgggactacaggcacctgccaccacgcctggctaatttttttgtgtttttagtagagacggagtttcaccgtgttagccaggatggtcttgatctcctgaccttgtgatctgcccacttcggcctcccaaagtgctgggattacaggcatgagccactgtgcccagcccctttctccctttttaacttttttgagacagcatcttataccatcacccaggctggagtgcattgcgcaatcttggctccctgtgacctctgcctcctgggttcaggtgattctcctgcctcagccgctggagtagctgggattacacatgtgtaccatgatgcctgattaatttttgtattttcagtagagatggggtttcaccatgttggccaggctggtctcgaactcctgacctcaggtgatctgcctcccaacgtgctgggattacaggcgagagccaccatacccagtcatttttatttttcttttaaagaaaacactgtcctgaataccacatgggtagagtgcgtattggcttatttccttagatgatgttctcaggagtggaatgaataacatctgaaaaggcttcactctagccattgtcttattttctaaaagtgagctggcccagctcaccgttctagcagggtctaaggttacttactgctgtggttattattcagagtggacgatggtgcatgttaatgtcaggcacagcagggcgcggtggctcacgactgtaatcctagcactttgggaggccgaggtgggcggatcacgaggtcaggagttggagaccagcatgaccaacatggtgaaaccccatctctactaaaaatacaaaaattagctggcgtggtggcaggcacctgtaatctcagttactcgggaggctgaggcgggagaattgcttgaacccaggaggcggaggttgcagtgaactgagattgtgccactgcactccagcctgggtgacagagagactttatcttaaaaaaaaaaaaaaaagtcaggcttttctagggttcctccatcagccttgtaaggctggagacccgtggccaggaagaaaattggagctgtctggcactgggaagggtaacccagtagttataattaggttggcttatctgcgagccctttgataaggcttcactaatttactaacccaggatcgcatgttagatcaggatctctctgagtgctgcaattgtagtttgcttttctctctctcttttttttttttttttagagacagagactcactctgttgcccaggctggagtgcagtggtatgatcatggctcactgcagccttgaactcctggcctcaagcgatcttcctgccttaccctcccgagtgtcttggattatagatgcttgtcaacatgcccagctaatttttaattttttttagagatgaggtcttgccctgtcacccaggctggagtgcagtggcatgaacatagctcactgcagccttaaacttctggcctcaagcagttctcctgcctcagccttccaaagtgctgggattacaggtgggcaccactgtgcctggcctgcagtggtttaatagggctctttcatctttaactttggtcccctgccccctgagatccgtggagtgagccgtttgacgcttggtacttgggacaaagctggcctatgtccagttctctgcatacttggtaggggagtgtttggagaaaaggctcacctctgagtcacaccctctatattctccaaagggccatggggatggggtggaggaggctggggtgaagagatgttgtagctccagagaaagccagggaggtgtatgctgggtgaagaggccaagttcaggagcctaggtttgaaaatcagtatagacgattcaggttaattcaccctgttgttatagagcatctgtctgtagggtggccaggtctgggtgagtctcttggacaagatgggtatcaggtttcagctctgaaattggactgatatgtggggagattcattctgcagttttatttgtagtttaggtttaagaaaacttggactgggcactgttgctgtcgtctgatcccagcacttagtgatgctgaagtgggaggatcacttgagcccaggagtttgagaccagcctgggcaacagaaagaccccatctctacaaaataataataataataattattattattattattagctgggcatgatgggacatgcctgtagtcccagctactcaggaggctgaggcgggaggtttgcttggtcctgggaggttgagctgcagtgagctatgattgcaccactgcactccagcctggacaacagcatggcactgtctccaaaaaaaaaaaaaacaacaaaaaaaaaacttgtttaactacctaaatcatagcatttgtgtgaagccagactatcacaactctgagaactgctgacatatacatattttggaagttccaggttttctgttactataaacatggtagagattgaattacttaaagggacgtcttttctcctactctttgtcttgtctgatgttataaggggtacagtatagaatgaaaacagtgcagaaatgagtgaaacatgaaaatcccttctagagataattttcttttattatttttttgagacggagtcttgctccattgcccagtctggagtacagtgatctcggctcacggcaacctccacctcccaagttcaagtgattctcctgcctcagcctcccgagtagctggggttataggtgtgtaccatgcaccaccatgcccggctaatttttgtatttttagtagagacagggtttgctgtgttagccaggctggtctcgaattcctgacctcaggtgatccgcctacctcggcctcccaaagtcctgggattaccggggtgagccaccatggccagcctcttctagagacaatcttattggcaggttgatgtttttaattttcagcctctcttctccacagatcctaaagatatagtaatttttttttttgagacagagtcttgctctattacccaggctggagtgcaggtggcgtgatctctgctcactgcagccttcacctgccgagtagctaggactgcaggcatgcaccactatgtctagctaatttttgtatttttagtagagatggggttttaccattttggccaggctggtctcaaactcatgacctcaagtgatccacctgccgcagcctcccaaagtgctgggattacaggtctaagccaccgtgcccagccataaatacatggtattttttaagaacaagaacgggattctacaaaaacatatatatgtgtattttgagacaggatctcctctgttgctcagggtggagtgcaggggcacgatcatggcccactgcagccatgacctctcaggctcaagcaatcctcccaccttagcctctggagtagctgggaccacaggtgcccaccaccatgcccagctaatattttttcttttttttttttgtattgaaaacagtcagccaggtgtggtggctcacacctgtaatctcagtacgttgagaggccgaggtgggcagatcacttgaggtcagtagttcaaggccaggctgtccaacatggtgaaactccatctctactaaaaatacaaaaattaactgtggtggcgcttgcctataatcccagctactgggaagggggaggcataaggatcacttgaacctgggaggaggaggttgtagagagccaagatgatggcactgcactccagcctgggcaacagagcaagactctgtctcagaaaaacaaaacaaaacatatagtctttatttttttgtttgcgtgggctggtgcatcttgattatgatgcatttttgttaattgatatttaattgcagatgaaatgtaacatggatctgagtaattgctgataattgtttcctctttaggcagctggtcagtcttttttttttttttttttctttttaagagagtttctgtcttgttgcccagactggagtgcagtagcgtgatctcggctcactgcaacctcctttgccagggttcgagtgattctcctgcctcagccccccgagtagctgggattacaggcatgtgccaccacgcccggctactttttgtatttttagtagagacgggttttgccatgttggccaggctggtctcaaactcctgacctcaggtgatcccccctgcctctgcctcccaaagtgctgagattacaggcttgagccactgctcccagcccatagtcttttttttttttaaacctctgtgtacaggtaggtcctggggaaattcgaggcaagacttgggtgagtgggtatcttagaccctctcaggagctctttgcaggaggtagaatctccgagggtcagtgcccatgaatgggtcccatggcctgactggtcccattcaggtgacagtctctgagggtcctgcatagcccttacctgggctccatgctgggaatcgagcggtatacagagcatggttccctgccttccttgagccccagtcttgttggggaaatggccaaataaatgaataatcatcaggaagtgctatgaaggggagctgcgtggtgcccggtgagtgcaatagcggggtttcatctggttggagagaaaaaaggagactccttaagtggggaacccgtttgatgatacaggtttggctatgtgtgtcaaagaccccaaatatagtgggttaagatacaagctcatttctctctcatgtaaaaatcccagctggtgtggcagctctgtccccaaaataatcagggtcccaggcccctcccatcttgttgctctgctgtcctcatctgcatggatcaagatgatgcatctccatgtccacatggcagccagtaggaaagcagagtaagggcacaacctggaggttgcctacgtctctcctcgtcacatcccattggcttgtacctagtcatgtggtgcctctagctgcaaaggaggctgggaaatgtagtttcctttctaagcaggatgtacccagctgaagatgttactcagggatgagggagagttgatactggagcgcagctagcagtttctgctgtataggcaaaagcagaaggtaagaatgttctgggcagtgggaaatgcatgtgcagaagcactggcttaatgaggaaggccactgtggctggagtcaaagagtagggaagagaaaaagaaccagaaggaggctgagaattgggcctgtaggacttggatcctgtgggaagccttggcagctttctttcccccctccttgcttaggcattagctctaagacagggatatttacaacacaattatttctttaaaattatatatatattttaatttgtacagatgaggtctccctgtgttgtccaggttggtttcaaacccctgagctcaagccatcttcttgcctcggcctccgaaagtgttgggattacaggtgtgagccattatacctggccttcaactcagtccctaaagacaactccttctcaagtgttggaaagaaccaatgactaatcacttctagtctgccttatccccatcttgcttgtgtgactttggtaagagtttgtttgtttatttaaaggagcagagagtttaataggcaagaaggggcaagaaagaagggagaataagatcccctgtatagagacggaggagggctccaaagctgagagagggaaccccagctgccacagatagcagctaggtatatgtacagaggctggaagaggcagtgtctgatttgcataggcctcaggggattggtttgactaggcatgtctttcacgtagcgcatgaaaaagctggccctcccacctagccttttaatatgcaaatgcagggtaccatgatctgcacacttggggaggtgtggtggcggccatgttgctaggaacatgtggggaaagggcaagaaggctgtgggaatcgccatgtttgggtggacccagtttctaatggcttgcatttgcatatcaaaggttgctggcctggctctaagagccggggctttacaagaaacttttccggagttgctttaaaaaccaaacatttcccaaggaccccttttcctctctatttgcctaaaataattgcttaactcctacattaccccctgtggagatgccacattaactgctgttagggggttttgggcgacgacttcttctggctacttcctggtgaaaaggggcgttgaatggggaacagcagctagggctcctcctggggtggatctaagggtcctcggaagaatggcgtgtccatgtgtgcttcaggttacagcaccattttgagtttgattgcttcagtctgatgaaataatttcctttcctggccaacacaccaaaatgatacggctccgatgagtgggggaacaccagggttcttggtcctcatgccggtttagataaaatgacacagacacacgtggagtggttttaaggagtggagagtttaataggcaagaaggaagggagaaggaagaaggtcccctgtacagagacagagggtggggggctccaaagctgagagacggaacctccaggagttgattttataaataaaataacatgcgttgaggtcactctgtgttgtgtggtatgcccagccctctctgcacataacttgtttcaggcccacagtcatgctgggtggttgctgtaatgactttttattttaaatggggaatctgtgacacagttaaacatgcgcaggatcatgtcactagcaaggagtggacacggtattcaaacccagcaggttgactcaaagcctgccctttccccagctgttttgcccctcagtcatttgagtctagtcttcaggattttgacatctatctcttaccttgtatctgttaggattgcatctggcttcaagaaacagccctacttcagcagcctaagcagaaaggtattcatttgtttattttttacatgtcaggaattccagtacctcttggagttgctggcattggattagtgatgcagggttgttaggactgacatctctgctgttttcttgtcttttcctcaaggcccctaaatggctgctacagccctaggcaatatatctgggttcaaggtaggaagagggagggattgcaccagcctcatgggttcctttctattcaggaaagtccaagccttcttcaaaggctcttctgtccacattgcagacttctggtcatgtctccttggctgaaactggattacatgaccacctctagctgcaagggaggcaggaaaaatgagcatttggttttatgcttctctaggaggaaacagcaagggagaaacttttgagtaagccagccaatattgtccaacatgtacttattttttaactttttttttttttttttttttttttgaggcaaggtctggctggctctgttgccgaggctagagtgtggtggcacaatctcagctcgctgcaacctctacctcctaggctgaagctatcctcccaccttagcctccagagtagctgggactaccacatgcaccaccatacctggctaatttttatatttgtagagatggggtctcaccatgttgcccaggctgctcttgaacttgtgagttcaagtcgtctgcccacctcagcctcccaaagtgctgggatgacaggcatgagccatcacactcagctaatgtttttctttcaatcaattcactttttaagccttaacaaagttatcgcaaaaggaagtttcatatcactttagaatgtctttgaagtcacaggttggttatatttatgtgcttactttaatagctattaaagtaaatatagcactactaagaaaaaaagatattctttaaatcgcctattatcagtggttcttaactctggatgattttgtctccaggggacatttggcaatgtctggaaacatttttggctgtcacgatggggcagggagcgcacgcctagagtctagtgggtagaggccagggggtgtgctaaatatcctacaatacaggatgggctccataatgaaaaatcctctggtcccaaatgtcagtagtactgcagttgagaaaccctggcatggacgcaatccacctgctgccaggagttatatacaagccatgttagggtaatgctgcaatatgtccatcgtgattgtgttttctcctgggtgactatcagcaatggtgtagcctgcttgttggttttcaaggtccattctcaagatactatcagatctccagcaatcgtgtgatgcagtttaaaatgttcatgtgagctgggcgtggtgactcatgcctataatcccagcactttgggaggccaaggctggagaatggcttgagcccaggagtttgaaaccagcctgggcaacatagcgagacccagtctctacacaaaattaaaaaaaaaaaaaaattagcccggtatgatggtgcatggccatggtcacagctactcaggaggcagaggtgggatgatcacctgggcctgggaggttgaggctgcggtgagccacgattgcaccaccgtattccagcttgggtgacagagtgagaccctgtctcaaaaaaaagaatgtgcatatgaattcaagatatgtcccttatagagactggtgaggacacagcttattgaccctgaagctgaagtggttgaaatgatagccctcttgccaggcaaatcctatgtgagtgcttctaaaagaacactgtaccttgcagagagtattcctgggacctggcaggaatcagggcctcttggtgaccacatgctttggaaagggctgtgctttggcaagtgggagattttattatttattttctcctgtctgcctcggtttggcaaaaacaaacctggcctgggcatgggccttgtggagacaagaaggcagcttgagattatcagagatcaggctgctggtgggtttgcctgagctggcctggtcaggtagcttgacaatgatgctcagacccccattaaagttaattgagcggttacagagtgggagtggggagtggggggtgtggtgactgcctgtctccttgagttggcgtggctaagaagtaagggaattttttaacttttccttcttaattctggaaacttagaaaaaagcctctcaccatcccttaatcattcagttagagagaccaggctgttgatatggacatgctgcgtttcatggaatcctagaggccagtatttatgacatacttcccagtttcagagatgttaggatataaaaatgtagccagcagtgtttacaggatgggctaatcgagagacacagacaaatatcaaagatagcaaaataggaagaaacagagtcttagaatcaatgcagtataataatagcttctagtttctttctgtttttctttttatgatacagagtctcactctgtcgcccaggctggactgcggtggcatgatctcggctcactgtagcctccgtctcctgggttcaagtgatcctcccatctcagcctccaagtcactgggattacaagttgtttgccaccatgcccagctaatttttgtatttttaatagagacagggtttcaccatgttggccaggttggtcttgaatgcctgacctcaagtgatcccccccagccttggcttcccaaagtactgggatgacaggtgtgagccaccatgcccagcctccccctcactcttaagcacagctcttcggcagtcagagatgttgcctgctgtatttctcgttctgcttttacacatggtttaaaaatcctcgcccaagaatgtaagccccatggctagtgctacctgctacctttaggggtggcctctcctggggtgcaggaggttgcacagttcgttttgtgacagcagggtcattttttaatcggatcatctgccccagtttgcttggctcttaggtgcttgggagttctcctggttttttgctgttgtgaaatggcccagcttgtacacgttgttccttttcttgctggagttatttcctttagactcctgtccctaaagtaggattgttgggtgaaaatggggtatgcgtggttaggcttttctctgcctgctttctggattgctcttcagatagatttaatcaccttttatttatgttttgtggtggttttttttgttttttttgtttttttttgttttgagactgagttttggtcttgttgcgcaggctggagtgcaatggtggggtctcggctcacagcaacctctgcctcctgggttcaaacgattctccttcctcagcttcctgagtagctgggattacaggcatgcgccaccatctctggctaattttgaatttttattacagacggggtttctccatgttggtaaagctggtctggaactcccaacctcaggtgatctgcccgcctcagcctcccaaggtgctgggattacaggcgtgagccgccacacctggccaccttttatttgttgaatgagtgtttaataagcatgtcctatatgcatcaggagaattaaatggacatggtcttgctttggggggaaatgacaggtaggagagaaagagacacttagaactcaacagaggccagacgcggtggcttacgcctgttatcccagcactttgggaggctgaggtgggcggatcacctgagatcaggagttcgagaccagcctggccaaaatggtgaaatcccgtctctactaaaatataaaatcaatcaggcgtggtgatggcacatgcctgtgatcccagctactcgggaggctgaggcaggagaattgcttgaacctgggaggcagacattgcagtgagccgagattgcactactgcactccagcctgggcagcaagagcaaaactctgtctcaaaaaagaaaaaactcaacagagaaaaggcggatcgttaaggcttctttggcacttcctaagtgccagggactgttgttaatgcctttgaagtgctaataatgacttaatggtgacaagttccctgtgaagcagggactgtgattgtttctaccttatgggtggggaaaggaggcagagagaggtgaagtcacccagctagtaaatgacaggactagactgaaacccaggcagtctgtctccagggcctggccggtaccccatgctccatcttgccccataaacaccctggggtgggccagagaggagtcttttccaacaggctgtgccagatgactttggctaatcttggaggctggaggattagtcagtctactaagggggcttcagcattttggcacgtggctttatgagctgtttactccaacagtgatgatgacaatagccatagtagtgataatactatggtagaagtaactgcagcaaactcaacccctaacgagtattctatcttcccaacattgtgtgcaatagccatgagagatgggtgttattcttttaatttgacacacgggaactgaaagccagagagattgggtggcttcccccaggccacacagcctggaagtagtaggacagggactcgagcccagatctgctgccccagagcctgtgcccttgaccaccaagtcatggtcactcctttcaaccctgcctgcccctgggccatctgtgttgtgatgccggctggccaggatggggagtgaggatttcagtttgtcatagggcagggagatgggtgaggcaggacactccttgagatggaaggctctggggtcgggggagagggagtggtggagactggggtgtctccgaaggagtgtttgaagatgacggtggtttttccagtttcctgttcttagctatattcaagaaaagggtaagccagaaaatttccctctgagtttcacaacttctgggagcttttgcaaagtctgggtgatgcagcattttcctggtttgaatcctaagtgaagtttcattttccttcacttaactcattctggctctggcctgtcttcccagctgtattggccatctggtcctcttctggctctttgtcccatttattattatttatttttatttttaacagagatggggtctcactgtgttgccgtctgttctggaactcctggacccaagtgatcctcctgcctcggtctcccaaaatactgggattataggcatgagcctctgtggccagcttataccccctaagcttgtgactatcttctatgtgtgtccctcttggagtgaggttccctcctgtctccatgttggcaaatcttagcaccttggcccttcgagatggaggtctgtgttgcctaggctggtcctgaactcctggtctcaagtgatcctcccatcttggccttccagagtgctgggattacaggtgtgagccactgtgtccagccaacccttcttagattttacttacttcaagaagcctgctttgacctctcaagtggaaataacaacttccaggaatagagtgatcactgggcatccatctgttgtcacatgaatgattttatccatattaaggaggcattacatgcagcagtgagctaacctgcctgtgttgaagttttcttctttttacaggctgtacaaccttgggcaagttgctttacttctctgtgccttagtctcttcctcagcaaaatggaaaaaatactacccatttcaaatggggtgaaaatgaaataatatataagtctcgtcttcacaatgtctctgatgaaaagcaggtattggttgcacatggtgctcatgcctgtaatcccagcactttgggaggccgagcagggaggattgcttgaggccaggagcttgagaccagcctggggaacatggccagaccacatctcttaaaaaaaatttagctaggtttggtggcatgcacttgtggttctaactagtttggagcaggtgaggagggaggatctcctgagctcaggaggttgaggctgcagtgagctgtgattgcacacgactgctttccagcctgggcaacagagtgaaaccccatctcaaacaaacaaacaaacaaacaaacaaataaacaaaaaacaggtattgtccttgctgtatgaatgaggaaagtgagttttcctttttgctttgtgaaactcttttctggatatttcttgccttttatgtgtatctctttggtggtactctgtgcttttaaaatcttttgtaatggccatttatggacaaatcgtatcttatattcaagattctaagctttctgagggcaggatataaatgtggttgtttctggttcaagtcctgatacaagcaaagctcagtaatttttttaaatgaatgggtgggccggtggttgggtcttcagagtcactaaatactggtggcaggagtgggaccacatagaaaaaaatattaaggcagtggatctcaatggggagtgatctgcctctcagaggacgttcattgatgtctagagacatttttgttgtcacagtttgggatgggggtgcagttggtgtctgttgggttaggatcaggaatgctataaacatcctgtgatacacgggacagacgtatccagcctaaaacgtcagtagtgttgagggtgagaaaccctgggcttattaaggcaacaagcaacatattaatagcaacaggagaaaacatgcatttaaattttttttggccaggcgtggtggctcacacccgtagtcccagcacttcggggggcccaggtgggcggatcatgaggtcaagacatcgagaccatcctggtgaacatggtgaaaccccatctctactaaaaatacaaaaattagttgggtgtggtggtgtgtgcctgtagtcccagctacttgggaggctgaggcaggaaaatcactttaacctgggaggcggaggttgcagtgagctgagattgcactactgcactccagcctggagacagagcaagactctgtctcaaacaaacaaacaaacaaacaaaaaaaaaacaaaattttttttccacaaatgtgaagtagtctagatgagatacgctcttcctgagatgataaagtgaggtctaagtgtatttattaattcttttgaggagggtgttaggtgctaaaggcagcacgtgtaaggtgaaaattgcgtatagccaaaatgaccctggggcttattctctctctctctctcttttttaataaacagcttttttgttgagatataattcacataccatatgatgcacctataaagtgtgcaactcagtttagtacattcagaattgtgcatgtctcctgtctccaggtaggcaaatcttagcacctcggcccttcttagattttattttttagagatgggggtctcactatgttgcccaggctggtcttgaacttcttggccttcctcccatcttggccttccagagtgactatattcaatattcaaagtgactgtagtcaacattagatatttttatcaccctgcttacttgtttttatttaagacctggtgtggtgtgtgcctggccttgtgatcacaaatgctagttacactgaattgacattttgctgagactcgttctgaggtccattcatagatgccctaggtacttcctgattacttgccacaccccaggaattctgcacagtgagtggggagtgacattttgagggacagcatcagtacattcactgcgctaaagaaacagtctggggagagtgagacatcgaaaaaataacatataaaataaacatctgatggagacataggaagatgccaaccttcaacaatgtttgacttggagcaggggttggcatgctttttctgtgaagggttaggtagtacatattttaggtctctcaggcccaggggcaaatagtctttcttataatatgtatttaaaaattggccaggcatggtggcttctgcctgtaatctcagcactttgagaggccaaggtgggaagattgcttgagcccaggagttcgagaccagcctcagcaacaaagtgagactctgtttgtattagtctgttctcacgctgctataaagaactgcccaacactaggtagtttataagggaaagaggtttaattgactcacaattccacagggctggggagacctcaggaaacttatactcacagcagaaagggaagcaaacatgtcctccttcacatggtggcaggaaggagaagtgctgagcaaaaggggaaaagccgtttatcaaaccatcagatcttgtgagaactcactataatgagaacagcatggaggtaactgcccccatgattgaattgtctctcactgggttcctcccacaacacatggggattatgagaactacaattcaagataagatttgggtggggatacagctgaaccatataattccatggccaaatgatatcgttctgcccctcccaaatctcatgtcctcacatttcaaaacacaatcatgcctttccaagtgtcacccagagtcttagctcattccagcattaacccaaaagtccaattccaaagtctcatctgagacaaggcaagtcccttctgcctattagcctgtaaaactgaaagcaagttagttacttcctagatacaataggagtacaagcattgggtaaatacacccattccaaatgggaaaatttggccaaaatgaaggggctgcaggccccatgcaagtctgaaatccagtggggcagtcatttcttaaagctctgaaatgatctcctttgactccatgtctcacatccaggtcatgcttatgcgagaggtgggctctagctatggccttgggcagctctgcccctgtggctttgcagggtacagcccccatcaaggggctttcacgggtttgtgttgtgagtctgcggcttttccaggtgcacggtgcaagctgtccatggatctaccattctgcagtctggaggatggtggccctcttctcacagctccactaggcagtgtcccaatggggactgtatggggcctctggccccacatttgccttctgcactgccctagcagaggttctccatgagggctccactgctgcagcaaacttctgcctggacacccaggcatttccatgcatcctctgaaatctaggtggaggttcccaaaccttgattcttgacttttgtccacaggctcaataccacatggaatctcctaaggcttttgaggcttgcaccctctgatggcacagcccgagcagcattttggccccttttagccacagttgaagcaactggaacaaagtgtaccaactccctaggcagcacacagcaggggggccctgggcccggcctatggaatcattttttcctcctagacctctaggcctgtgatgggaggggctactgcaaaggtctctgacatgccctggagacattttccccattgtcttggtgattaacatttggttccgttttacttatgcaaatttctgcagcaggcttgaatttttccccagaaaatgggtttttcttttccgtcacatcatcacccttccaatgtttcaaacttttatgctctgcttcctcttaaacactttgttgcttagaaatttcttctgacaatcatctaaatcatctctctcaagttctaagttccacagctctttagggcaaaggcaaaatgctgccactctttttgcttaagcatagcaagagtcaccttggctccatttcccaagaagttcctcatctccatctgagaccacctcagcctggacttcattgtccatatcactatcagcgttttggtccaagtcattcaataagtccctaggaagttccaaactttcttacatcttgctatactcttctgagccctccaaactgttccagcctctgcctgatactcagttccaaagttgcttccacatttttgggtatctttacagtagcaccccactcccagtaccaatttactgtattagtttgttctcacgctgctataaagaactgcccaagactgggtagtttataaagggaagagatttagttggcccacagttctgcagggctggggaggcctcaggaagcttgtaatcatggtagaaggggaagcaaacacgtccttcttcacatggcggcaggaaggagaagtgctgagcaaaagtgcttcttttgctgagaagtgttgagcaaaatcagatcttgtgagaattcactgtcacaagaacagcatggaggtaaccacccccatgattcagttacctcccactgggtttcttccatgacatgtgaggattatgggaactgcagttcaaaatgagatttgggtggggacacagccaagccatatcactgtctctaccaaaaaaaaaaaaaaagccaggtgtggtggctcatgcctgtatcccagctactcatgaggctgagatgggaggattgcttaagtccaggaggttgagactgcagtcagctatgaccacaccactgcactccagtctgggcaacagagtgagacgctgtcaaaaaaaaaaaaaaaaaaaaaggaaatccattcttagcctgtgtgctgtacaaaagcaggcagcaggctgaatttggcccacaggctgtggttcgccaacttatgacctatacaaatggcaattcatatggttcatcctagcgataactgtacatggtgtattagatactatatagcatgttcatatcaaatgtcatataatgtataaggtaacatatacagtataaaatagtgcctgagaaatatttgatgaaaaaatctgataagtacttagcaggcacagtacaaagtaccatgaagttgttaaatgggggatcagggtgtttgagaaaggggtggggagataggtgggcctccctcaagaaggaatgtttcaactgtgagctgaaggatgcccctgcattgcatgtcagggcagtgatggggagaaagactccaggtagagggaacccactctgcaaaggccctgagtcatgaaggggtccctggaacagtgagttggggctgaacccacaagctgcagttgtggggattgtgatccatcctgagagctctgagaacctggaatagttttcagcgcagtgtgaagggactggggctgtgttttgaagatatcccctgtctgcggttgggaggggagtcaggaaacctatttggaggctggggttttcacccaggtcatgcagataagatttattaggtgtggaatgaactgagcaaatcacatgtcttctaatggtacaccacactttttttttttttttttggttttgagacagtcttgctctgtctcccaggctggagagcaatggcatgatcacggctcactgtagccttgacttcccaggttcaagcaatcctcctacctcagcttccggagtagctgggactacaggtgcccactaccatgcctggctaattttggtatttttattggagacggggtttcatcatgttggccaggctcctctctaacttctgacctcaagtgattcgcctgcctcagcctcccaaagtactgggattacaggtacaagccaccgcgcctggcctttagtgatattttaaagactaaattcccttagagatgcctgggtctgcatttattgctactgttctgtttctcactgtgtgtcttgaggtcatcaaaagtaacctgggccttttcccttgttttctgcctcctctaggcttatgagccattaagcaaagccggattggtgtgtgggtcaggctcttcatgttttctttagcttaataagcagtttctaagggaactcattgtgtcattgtttagaatagcaaaagatgagcagcctcccaagtggcaatcagtaggggctgggtgaatacagtgggttccaccccttccgtggtagggtgggatgcttgcagaaggacataagacgaggaagccctttgtgcacagatgtgcggcagcctccaaggtccagtttttaagtgaaaacgtggagatccacttggtatatttggtatgttacctctgtgtaaaaaagcagacaagtaagaattacgtagttgtatttgctgtatttgtaagaaattccagagggataaatgagaaactaaaagaggcaattgcatttgggcagagtaactttttattgtttaccttgatatatactttttttttttttgagatagagtctcgccctgtcaacaggctggagtgcagtggcgtgatcgtggctcactgcatcctccgcttcccagtttcaagcgattctcctgcctcagccttctgagtagctgagattacaggtgtgtgcgccaccaagctcagctaatttttggtatctttagtagagattgggtttcaccacgttggctgggctggtctcgaacccctgacctcgtgatctgcccaccttggcctcccaaagtgctgagattacaggcttgagccaccgcgcccggcctatatatgtattatataaacatatgcacacgcatgcatacgtacacacatatatattttttaaaaattgagtcatggccaggtgcagtgtgggtcacacctgtaatcccagcactttggcaggtgaaggtgggaggattgcctgagctcaggagtttgagaccagcctgggcaacatggagaaaccccttctctacaaaaatcacaaaaattggctgggcgtggtggcatacacctgtggtcccagctgcctggaaggctgaggtgggaggattgcttgagcctggtaggtagaggccgcagtgagccatgatcacgccactgcactccagcctgggtgagagagtgagactctgtcttaaagcaaaaacagagtcatatatttcctattaaggtgaaatttaaaaaataaattcctatattccatcatccccagcttctgccattctaaagcattttcctaagcagctccactgtggatgtagcgggtatttcagaaaggcattagaaatgccctgggagggcagaacccggggcttcactggaggtgctgttgggctcagtctgatgtcaaggcagggacatggcaagggtattgagatgtgaacaagcattactcagcaaggtgacatgtgttcatgccttgatacacttgtttccccaccagctctatttttgttgcctgctctattggtttctttttcttttttttttcttttgagactgagttttgcttttgttgcccaggctggagtgcaatggcaccatctcggctcactgcatcttccgcctcctgggttcaagtgattctcctgccccagcctcctgagtagctgggactacaggtgtgcaccaccatgcccagctaatttttatatttttagtagagacggggtttcttcatgttggtcgggctggtctcgaactcctgacctcaggtgatcctcctgctttgggctcccaaagtgctgggattacaggtgtgagccactgtgcccagtctctattggtttcttattgctggtattgccatcaacttggtgactgagaacaacacacatcactctagttctcgggagtcagaggtccaaaatgtacggctggtgttctttccggaagcttgcagggagaatccatggcctggccctgtccagcatcaagaggccacctgtcttcctcaattcgtggtttcatgtccctccacccctgcttgtgttgtcaaatctcctttactttttttttatttttgagacggaatctcagctcactgtagtctctgcctcccaggttcaagtgattctcctgcctcagcttcctgagtagctgggattacaggtgcatgtcaccatgcctggctaatttttgtatttttagtagagacggggtttcaccatgttggacaggctggtcttgaactcctgaccccgggtgatctacctgcctcagcctcccaaagtggtgggattataggcatgagccaccacgccctgcctcaaatctccttttctgactcagatattcccaccgtcctcttgtcccttataattccctgtgattacattgggcccacctggatcatctaggacaggggtccccaactcctgggccatgaaccagtagcgagcagtctgtggcctgttaggaactgagtcatgcaacaggagctgagtggcgggcaagccagcattaccacctgaattccacctcctgtcagatcagtggctgcattggattctcacaggagcgtgaaccctaacgtgaaccgtgcatgcgagggacctaggctgtgtgctccttatgagaatctaatgcctgatgatctgagggggaacagtttcatcctgaaagccaccccccgccatccctggcaaaactgtcttccatgaaatccatccctggtgccaaaaagcgtggggacctctgatctgggacattctccccattccaaagtccttaatgatacctgcagagtcccttttgccatgaaaggtaagagactcaggttctggggacggggatgtaggcatctttacgggctattctgtgtactgcacctgttcagcttagttccaggcacatagtaggggctcagtacatctttgttgaatgacacaatcaatcatttggttaggctagagaatgtggaaggaggccgggtgcagtggctcacgcctgtaatcctaaggctgaggcaggtggatcacttgagctcaggagtttgagaccagcctggacaatgtggcgaaaccccatctctcctaaaaatagaaaaattacctgggtgtgatagtgtgtgtctgtagtcccagctactcaggaggctgaggcgggaggatcacttgagcccagaaggtggaggtttcagtgagctgagatcatggcactgcagtccagtctgggcaacaaaacgagaccctgtgtcagaaaaagagagaatgtggagggatattatagcaagaagtggatctggaagttttactagtagtggtatttattgagcacctactgtgtgctctggctcatgtttaacaaagtgcttatttgcataatgttagtattcccattttacagatgcggaaactgaggtttagttgctggcctagtattacagggtgaggagctgaagccccatctgcctgacgaggggtgtgttggggatgtggactagaagcttggtcagggagggattctgttcaaacagggctgcttagctttggcactgttgacatttggggccagatatttcccgtcgtgggggctgtcctatgtattgtggccattaagcagtatccctggcctctgtccacagagtgccaatagcactaccctcttcctaagttgtgaaaacccaggatgtttccaaatgttgtcacatgtcccctgagtgacaaacttgcccccacttgagaaccatggtgttgaaacatagatcacggcacatcaactccatgctcctcaggtcaccctgcgtgaaagtcagaatccctgcggtggcctgtgcgtcccgcactgactgtctcctccctgccttcttccttcctcgctgtcttcactgcttgttattcttcagacctgttggcctctctgcggtttctcagaaatgccaggcctggtctgacttcaggacctttgcactggctgttttctctgcttggtgtgcccttcctccagatggccatttggtttactcctctgtttccttccatcctgtatttgtttatttatttttaattgagatggagtctcgctctgtcacccaggctggagtgcagtggtgtgatcgcagatcactgcaacctccaccacccaggttcaagggattctcgtgcctcagcctcctgagtagctgggattacaggcatgcactaccacgctatgttggccaggctggtcttgaactcctggcctcaagtgacccacttgtcttggcctcccaaagtgctgggattataggtgtgagccactgtgcctggctcaatcctgtatttaaatacccgtcctcagcaaggcttgccctcttctctgagtgcttttcatcacacatgtcttcatatcctctcctttctaaaccatctgtctcttctctttaggctgtcagctccaggagggccggcccttggtccctattgttcactgctgggccctcagccctaggaaccgtgctctgtaaatggatgaatgctgtctgtcctgttactgcagtgtccccagacatatccctatgcccagcacatgcctgacccctcacaagaccctggaacatgactaagggatttatttggtgaaacatgagagtctgataagaggagaggaagtggctggggagcaaccttgcaaagatagccagggttggatggagaaaacgagggtgagtgtcagcttcataggacgggccttccacgagaggcctcatggtgcttgggagagttggggtgaaagcaggttggaacaagatgcttgctgctgacatttgggcactgatgggcagcctgacctctgctttctttttagtgcttaacaacactgaagccctgttaagacaggattcttaggactgggcacagtggctcatccagcactttgggagccctgggtgggaggatcatttgagccccaggagtttgaggccagacagggcaacatagcaaggccccatctctggaaagaaatacaaaaattaaccaggcttggtggtgtgcacctctagtcccagctacttgagaggctgaggtgggaggatcacttgagcctgggagttcaaagctgtaatgagctataatcatgacattacactccagccgaggagacagagcaagactctgtctcaaaaaaaaaaaaaaaaaaaaaaaattagttttgcatgtaactgtgttcagttctgtgtcttggacgtgaggatttgtggtacccgcctggatagagcaaggatggccgtgcccctgccttcctgggtgatggggataagtctggaaattgcccctgtgatgttactgggctttattcttagctctgctgagttagggggcagggtggggtgcagcccagccaacagcatgccagggcgcgtcactgcccacgcgatgctggcttcagccgccttcctctcacctcatggccctgccagccgtgcttgcctcctgctgtgtcggggctgggagactttagcctttctccagatgttttcaggagtgcggtggggaaatgaaggccacatgctgtctctctaaacaggattaatgttcagaagcccagcgggtgccctgacctaaccacgggcctcttgcactccttttctcagcttcccttggcttctgagctacccctctgcagcgttgtttctgagtgtggcatttaggagcaccctgtcgtcttgcctttcgtccctccaagccccgtctgttccttggttggttgtgcagaagagttgctagggtttgaatccaggacggtcctgcccctgtgactcgcgggccatcttctcacctgtttgtctctgtgttcctctctgtaaaagtgggaatcattacagtaccttcctcatagactgctagggtgataaaatggagcgatgtacatgaaacctgaacgcagtgcctggtatgcagtccgtgcttagacagggctctggttttatttttatttctttttctttgagacttggtctcactctgtcacccaggctggagttcattagcataatcacgtctcactgcagcttcccactcctgggctcaagcgatcttaccacctcagcctcccaagtaggtgggattacaggtgtgagccactgtgcctggcaccattcagcaatttttttttgttttgtttttgagacagagcctggctctgtcacccaggctggagtacagtggtgcgatctcagctcactgcagtctctgtctttcaggttcaagtgattctcctgcctcagcctcccaagcagctgggattacaggcgtctgccaccacacccagctaatttttagtagagacagggtttcaccatagtggccaggctggtcttgaactcctgacttcaagtgatccaccctcctcggcctcccaaagtgctgggattacaggcatgagccatcacacccggccatcagcaaatttttaagtatacaatatagtattgtgagctatagacactattctgtacagtagaccgtaggactgactgactcatcttgtatgaccaaaactttatacgctttgaccaacacctccctgtttcccccaccaccagctccttgcaactaccattctgttctctgcttctatgagtttgtcttttttagatgtcacatgtgagtgagatcttgcagtgttcgtcttcctgtgcctggcttatttcatttagcataatgttctccaggcgcatccatgttgttgcaaatggcaggatttctttccttttttttttagacagagtcttgctctgtctcccaggctggagtgcagtggcacgatctcggctcactgcaagctccgcctcctgggttcacgccatcctcctgcctcagcctcccgagtagctggaaccacaggtgcctgccgccacgcccggctaattttttttttttttttttttgcatttttagtagagatggggtttcaccgtgttagccaggttggtctcgacctcctgaccttgtgatccgcctgccttgacctcccaaagcggtgggattacaggtgtgagcgactgcgcccggccaggatttctttcctttttaaggctgagcgatagtccatggcatgtatagatcatgttttctttgtccacttgaccacggatagacatttagttgtctccatcttggttgctgtgagtgacgctccagtgaacacgggagtgcagatatctcttcagggcccatgtgtggctgagattaggagatcactgctgtcgtctctagttcagcagtgctagtgcctcctggcgtttagcgtccagctcaagggagtggaatttgggtgtctcagggtctagggccacctgtgcctctaaatcgcagggaagctttgtgtgtgtgtgtggtggggtgcggggggctatgggtatgtggtggggtgaatcttatttctcttctttcccttttcttaattttccgttggcaaaacagagcgccactccagacccctttcattcttgcaatatacatgaaaagtacagggcttgttctgcaaaagaagagtagccccagcgagctcagggttgagtgaagttccgcaaggatggcacctctcggctcttctgggggcttcaggacagagctcagtgtcgccaagcaggacccccactgcgggcggagctgcagggccatcaacattcattaggtggatcagtgaatgtagactctgcggtgtcacaaagcagcacctgtactcactgtgcctgtctcgggatggaatctaagtcagacatccttgcatccccacttatgggctgttccttcaccttgctggtcctcacctttctcctagagttacggggaggagtaaatgtgctaaggccatacacgccgactctgcagtggccttgaaccatgcttctctgtcacccctttcgttgccttgacaatggctgcagcctcctttcccatctcccctaggatcttctcctagggtctcttaatacaggggtccccaatccccagagcacggactggcaccagttcatgcatgccctgttaggaaccaggccacaggccacacagcaggaggtgagtggcaggcgagcgtgtgagacttcatctgtatttacagccgctccccatcttttgcatcaccgcctgagctctgcctcctgtcagatcacctgtggcattagattctcataggagcgcgaaccctgctgtgaaccgtgtgcgcgagggatccaggctgtgtgcttcttttgagaatgcaatgcctgatgatctatcactgtctcccatcacagctgagatgggaccatctagttgcaggaaaacaaactcagggctcccaccgattctacataatggtgagttgtataattatttcattatatatgacaatgtaatcatagaaataaagtgcacaataaatgtaatgcactcgaatcatcccctaccctgtctgtgaaaaatcgtcttccacaaaacctatccttgctgccaaaaaggggatggctgtctttttttcttttgagatggattcttgctctgttgcccaggctggagtgcagtggcacaatctcggctcactgcagcctctgcctcccaggttccagcgattctcctgcctcagcctcctgggtagctgggattataggcacaatggcaccgtgcctggctaatttttgtatttttagtagagacggggttttaccatgttggccaggctgctctcaaactcctaaccttgggtgatcctcccgcctcggcctcccaaagtgctgggattacaggcgtgagccactgtgcctggccagggaccactgtcttaatatgtgaattaggcgatgccatgaccctgcttaatgcactcccagggcctcctgtgagaattagaacaaaaaatccatgctctgtaccatgcctccaagattggctatgtggtggcctttggtgacttctcccgcccaatcttgggtcctagctcattggtgcagccatatcctccccccaccccaccccactgtggcctttgcctgtgccatctttctgcctggtatgtgcttcccgagatctttgcacagccagctcttcctgacccttccagtctgctaggatgtcatctgcccagaccgccactctggtgcttcctgtcctgacacccctgctctttccttcacagcaggtactgctctttgtcattatgttcttatctgtgagctttcatctttgatggactatgagtcttaagaggacagagatatcgtttctgattttcccccatgcctgtgactagcccaggtctaggcatatagtaggtgctcaataaacagtcatcgaatgatagattgaatgaatgaatgcatgacaggaaccctgcacttatctgtgttaatccgtctcttggctgccgggaacaccagctcctgcaacctggcacttgggtcacctgattgaaccctcctgataactctctaaactctgtaataggtgggttctagaattagtcccatttcacagatgaagaaatcaaggcctggtgaggtgaactgacttgctttagggcagcagggatgatttttgcctctctggagatatttggcaatgtctagagacagttttgattgtcataacttgaggaggtggggagtgctactatcatctagtggcagaggccagcgacgccactcagtatcttacaatgcacaggatggcccccgacaaccaagaattatttgggctcaaataccagcggttctgaggttgaagaagccctgcttgagggcacacatctgtaagtggtggagacgggaacctagacctggaaccttgttttgttaaccactaccctgcactgctcacatgcgggggtgggtgggtgggaagagttgtagaatgtttccatgtctgagtcaaaatcttgcttctctgctctagggagatgaatttggaatctgtgaggcctgaggccattcacttgatctccggccctggagatcttgcctccaagcgacctcaggctccatctgtctgccatgtaccttgcaaacaccttagaattctggctgggcatggtggctcacacctctaatcccggcactctgggaggccgaggcgggcagactgagttcaagaccagcctgggcaacatggtaaaaccctgaatctacaaaagatacaaaaattagccaggcatggtgatgcgtgccaggtagtcccagctacttgggaggctgaggcaggaggattgctggagcccaggagatcgaggctgcagtgagctgtgatggtgccagtgtactcaagcctgggcaacagagtgagaccctgtctcaaaaaacaaaaccagctgaccaaacaaaccaaaaggccttagagttcaagcacgtggtttagaggtggtggatctcagtgtcagactctcagtgggttcaaatcctggccctgtttcttctaggttgacgagcccaagcaatttacataaactctctggacctcagagcccttgccaggaaaggggagagttttaatagtcctgactttgtagggctgttggaaagcttaaatggactgtgcttgggaagcacttaatcactgtgcctggcgtgatcactctggctgttattattggcacccaataaatacatgctttctctttgtttccaactcagcatttagaaatgtcctacccttcaattcctgctgctatttatttatttgaagtgcgaactagctttcttattattattttagaaatcatgcagaggagaaaattcaaacagtacgaaagataatacaacaaaaaatagtagttgccttcctctccctggtttcaggcctaccccctgcagattaattagctttttttctttctttttttcttttcttttttttgcaatatgaagtcttgctctgttgcccaggctggagtgcagtggtgtgattttgactcactgcaacctccgcctcctgggttcaagcaattctcctgcctcagcctccctagtagctgggattagggcagatcatgaggtcagaaatgtgacaacagcctggccaacatggtgaaactccatctgtactaaaaatgcaaaaattagccaggcgtggtagcaggcgtctgtaatcccaggtacttgcgaggctgaggcaggagaattgcttgaactcgggaggtggaggttgcagtgagccgagaccacaccattgcactccagcctgggcaacaagagcgaaactccgtctcaaaaaacaaacgaaacatcaaattcctgactgtgtatgctgcttgcaggttatatatgaccaggcctggttctgtatctgtaaaatgggttacgttatagtacctgagtcctagagttgtgtgtgaggatgaaatgtaatgtgaaacacttagagtggtgcttggctgatgcaactaatgaatcttccctcttactctttctatagacagaagaaggcggcacaggtttcttcattgcttttcgccctttgctgaaatgtcatcttggcccagaggccctttctgtctacctgataaagaactagcacctgcccacccaccattatgcttcacccactttcttcttcttcaagccatttgctcccattgggcatacatagagttgttttttttagctgttggtagttttggccgctttgcataaagtgaaattgtgtgagagtggagactttattttacttccacatgaccttggcccatggtagtagtcgctgataaatgtccactgagcaataagaacccgactgttgcaagttacttatttatttatttttgagacagggtctcagtctttcacctaggctggagttcggtggtgcagtcatagctcactgcagcctcgaactcctgggctcaagggatcctccttcgtcagcctctggagtagctgggactaaaggcaaacgtcatcacatctggctacttttaaatttttttatttgtagaaggtggggagtctcactccattgccacctctggtctcgaactcctgggctcaagtgatcctcctgcctcggtcccccaaagtgttgggattacaggtgtgtaccaccacgcccagctaagtttttttttttttttttttttttttgagatgcagtctcactcttttgtccaggctggagtgcagtggcctgatctcggctcaccacaacctccacctcctgggttcaagcgattctcctgtctcagtctcctgagtagctgggactacaggcgcacgccaccatgcccggctaatttttgtacatttagtagagagagggtttcactatgttggccaggctggtctcgaactcctgacctcatgatccgcccgcctcagcctcccaaagtgctgggattacaggcgtgaacccctccacccggccagctaagtttttaaatttttttgtagagatacagtctcactgtgttgcccaagctgatctgaaattcctggcctcaaactatcctcctgcctctgcctcttcaagtgctgggaaatataggcatgagccactgcacccagctggttgtgagttattgagatggttgaattgggagtggatgctcaggcctcagtggaacttgtggtacacagtatgtcctcattacctcccatcagtggcagttgagattcataatcactttttctgcctgttgtctgccccatcctctctgtggccttccctcctgtcctggagttggctggctgggtccctggcagggctgcatgcgttatccctgcaggcctgcttgccttatccctgcaggccctggtggagcatctgtgcagaacctgtgccatccagatgggagcagtaagggtgtagggcaaagttagtgagctgcccggtgcacgaggacttccatgataatcagggctgaaccaggaaggcaggtcaaggccagggtcatgtacagaaaggaggtcagcaccaggatcttgtatgggaagacttagatcaatgcctagtgccttagtcatcatcattcagcccagaaaacatgacgctatgcaacaggaattttatgaacacacaaaggtcaggggccactcggacttggacggggtccccaactctttgagtgtcagggctgagggcatggagacacaacttgatcaagctggtgaagtgtccagcaaggagaagcctctgttggagggagccgggagctggggaggacatgcgctttctcttttttttttttttttgagacggagtctcgctctatcgcccaggctggagtgcagtggtgcaatctcggctcactgcaacctctgcctcctgggttcaagcgattctcctgtctcagcctctcacgtagccgggactcaggcctgtgccaccacgcctggtgaatttttttgtatttttagtagagacggggtttcaccatgttagccaggatggtcttgatctcctgacctcgtgatccacctgccttggcctctgaaagtgctaggattataggcgtgagccaccgcgcccagccgacttgcgctttctctgtaaagatttctgtgggccaggttccccaaagggcaggccctgggccagtgcagtgaccggtgaccgtgttcaggactcatctcttgtggctgaattgtgtgtctggagagttgggtccttctgattctgctcagagcgtggtgggcctggctggatttccctagattaggaagcagcctcgggtagctgtgattctttgagttgggaacagcaagtggcctgcagactgccagggaatcgtcccttccttgagcctttaggtattgcccattattcaccgtttttcccagaagcctccagtagtgagagtcgcacttcttacctcctggagttgttaaagtaaagaaggacacattagggtccctgccggtaaggaacatccaggaggcctcgataccttttttttttttttttttttttccctgagacagagtctcgctctgtcacccaggctggaggacaatgacctgatctctgctcactgcaacctccacctcctgggtttaagcgattcttgtgcctcagctgcccgactagctgggattacaggcatttgccaccatggctggctaatgtattttttttttctttttcagtagagatggggtttcactatgttggccaggctggtcttgaactcctggcctcaagtgatctgccctcctcagcctcccaaagtgctgggatttcaggtgtgacccactgcgcccagtcccgatactttgtttctttgagacagtctcttactctgtcacccaggctggagtgcctgggtgggacgatcaaagctcactgcagcctcaagcccctaggctcaaaagatcctcccacttcagccttctgagtaggtgggactacaggcctgcactaccacgcctggataatttttaaatttttttggtgaagacagggtcttactttgttgcccaggcttttcttgaactcctgagctcaagcaatcctcccgcctcagcctcccaaagtgctgggtttacaggcgtgagccactgtgcccggtcctcagatgatcttagctttgtgacctatgctgttggccgctgtaggggctgtgatggaggtgatgtgggggtggatggcaggggtgacccgtgttggctgctttctgtaacagtcatagttcatggtcagagtcagatttcctctcgtcatgccttccttcccttccttctgctccctcccacagccgccctttgggtctgggctggccatctggctctgagcaggaagctagcctgtgctcttcaatttgctttctgcaggggaaacaccttcctttgctcagcgtttcctgacctctccttccctggagttccggtgtccttaaatgctctctggtttcttctgtagcttactttcttgcttgaaaggacaacttttctttgtcctttagacttcttatctctgggcaatacagtggtggtggcagtggtgattattatcaactattagtatctgctactacggtttattgtctctagactgtatcagcacctgtcacacattgtcccattgaatcctctccagaactcttccaaatgatgtgttttcctgacttttaaaaaaattaaaaaaaaatttttatatttttttgagacggagtctcgctctgtctcccaggctggagtgcagtgctgcgatctcggctcactgcaagctctgccttctgggttcatgccattctcctgcctcaacctcctgagtagctgggactacaggtgcccgccaccacacctggctaatttgttttttaatatttttagtagagacagggtttcaccgtgttagccaggatggtctccatctcctaacctcatgattctcccaccttggcctcccgaagtgctgggtttacaggcgtgagccactgtgcccagccaaaaaaatttttttaaagaaatggggtctcgctgggtgcgatggctcacgcctgtagtcccagcactttgggaggctgaggtgggcggatcacctgaggttgggagttccaggacagcctgaccaacatggagaaaccccatctctactaaaaatacgagattagccaggcgtggtggcaggcgcctatagtcccagctactcgggaagctgaggcaggagactcgtttgaacccgggaggcagagattgcggtgagctgaaatctctccattgcactccagcctgggcaacaagagtgaaactccgtctcaaaagaaaaaaaaaatagaaaaagaaaaataaaagaaatggggtctcactgtgttgcccaggctggtctagaattcctgggctccagctgtcctcccatttcggtctcccaaattgctgggattaaatgtgtgagcctctgtgcccggcctctttctctctctctctctctctctctctctctctctctctctcctctctctctctctctctctctctgtctctttctttctttctttctttctttctttctttctttcagcctgagtctcgctttgtcgccaggctggagtgcagtggcacgatctgggctcactgcaacctctgcttcccaggttcaagtgattcttctgcctcagcctcccgagtagctgggactacaggtgcatgccaccatgcctggctaatttttgtatttttagtacagacggagtttcaccatattagccaggatggtcttgaactcctgatctcatgatctgcccgcctcggtctcccaaagtgttgggattacaggcgtgagccaccgctcctggccttccttttttttgaagcaggttctcactctgttgcccaggttggagtgcaatggtgtgattatgtctcactgcagtgtctaccttccaaggctcaggtgatctcctgcttcagcccactgagtagctgggattataggcgagttcaccatgcctggctaatttttgtgtttctagtagagacgggtttcaccatgttgtccaggctggttttgaactcctgggctcaagtgatccacccgtgtcggcctcccaaagtgccgggattacaggcatgagccaccgtgtccagcttttctgactctttttacttatcaggagactgaagcttggagaaattaagtgacttgcccaagttcacatggggttaaggcctgaatttgaatctacatctgctcaattaggaagtgagtggtcatagctagtctctacctggatggattgttgtttaattgttaaattttttcaaaataattttaaattattttattaaaaaagagggtatcattatgtttcccaggctggtcttgaactcctgggctcaagtgatcctcctgccttggcctcccaaaatgctgaggttacaagtgcaaactactgtgcctagccagattattacttaacaaccaaaacaaaggaggaaattgacggtggacaagtaagaagatcattgcaaaggttgggggcaggttgtttggggagtgtggaggaagctttttaaatgaggtacctgagttggattttgaaggatgaataggagtttgttaggacagaaagacattgcagagagaggatctagcaagaggtgactgaagaaaccatttatttgaccagcagttggggaatgccttgaaggcaggaaccacagcctttcagaatctccagtgcctgcaacagtgtctagaacattatctgacaacaagcttggtaaatacttctttaagtaaatgcctgagtaaggcacatttggggaacagggtgggagaaattgtaggagaagtagatgggacttgaatgtagaaggaaggcctcatggatcactgcaagggttggttatttttttttattttttatgttttgagatggagtctcgctttgtcgcccaggctggagtgcagtggcgcgatctcggctcactgcaagctctgcctcccgggtgcacgccattctcctgcctcagcctctccaagtagctgggactacaggcgcccgccaccacgcccggctaattttttgtatttttagtagagacggggtttcactgtggtctcgatctgctgacctcgtgatccacccacctcggcctcccaaagtgctgggattacaagcgtgagccaccgcgcccagccagggttggttcttaaaagccaatagggagccatgggaagttgtttcccagcagaagagagaaggccattagatctgccctatttattaatgcaaatatctaagtctatgaatcttcctctgagcaggaaaacgtgattgcttttaaatccatatggaaagaccctcagttttactcatgataaagagaaaaggaacttaaactacacagagatatttttcacttcagattggcagaggtcggaaacttgttatctgctgtgctttgtgaagtaattgcctttgtaccttatcagctggagtatgaattgatgttccctatttggagggcagtgtctgtctaaatgttactgtaggcaccctttgacctggcaggttccttttttgaaagtttatatatatgtgagacagagtctcattatgttgcccagggtggtttcaaactcctgggctcatgggatcctcccacctgggcctcccaaaatgctggagttacagatgggagccaccacacctggcagagaaagtgatcttatcaacactcttgcttgagtgtgaaattcaattgtttattcaatgctgcattgtttgtaagaggaacaccaatgccaagtccccaggagaccgatggaagtcaagttcatccctacaatagaatacaaagcagccgtaacaaagagtgaggaaactgttcatgtatactgcgggatgatctttaaaatctgtggttaagagaaaaaagcaaagtacggaacattatgtaacgtatgcttccttcgatttgataacagaagatgtatatttactttatttttgtataaaatattttctgaaagaagacataagcaacccatgatcattgcctctagagagaggaactgaggggagggccatagggaatggaatgagaagacttgtcccttgtacctctttgttcaaaagaaatatcaagaataaaacacatctatgttactgataaagatagtttccaaaggctgtgtgcggtggttcacacctgtgatcccagcactttgggtggccaaggcgagtggatcgcttgagctcaggactttgagaccagcctgagcaacatggcaaaaccccatttctactaaaaatacaaaattagctgggcatggtggtgtgtgcctgtggtcctagctgctcaggaggctgaggtgggaggattgctggagcctgagaggttgaggctgcagtgagctatgattgcaccactgcattccagcctgggcaacagagtgagaccttgtctcaaaaaaaaaaaaaaaagttcagtttttaatattagctaagtaaaaaaaagcaaggtatagaatggagtatcgtagtgccttttgtggcaacaaaataggtcgtatttggaatatatctggaagaatgtaagatgttagcaatggtagcttgcctgtagggtagcaatggggggctgttaatttggggagaaagacatatttttcactgtatacctttttgagtaatttgaaagagttttagcacacaaatatattacctattaaaaataattacaaagagagggagacatgggtggatgcatggatggatagttggttgggtagatggatacatagacaggtggatggattggttggtggatggatggatgaactgttgggtgggtagatggattgatgggtgaatgaattggtaggtgggtagggtggatggatgaattggtggatgggtaggtggatggatgaatgaactggtgggttgctggatgggtggatgaattggtaggtgggtggatggatggattgatgggtgaatgaattggtaggtgggtagggtggatggatgaattggtggatgggtaggtggatggatgaatgaactggtgggttgctggatgggtggatgaattggtaggtgggtggatggatggatggatgggtgaatgaattggtaggtgggtagggtggatgggtgaattagtggatgggtaggtgcatggatgaatgaattggtgggttggtggatgggtggatgaattggtaggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatgggtgaatgaattggtaggtgggtagggtggatgggtgaattggtgaatgggtaggtggatggatgaatgaattggtgggtgggtggatgggtggatgaattggtaggtgggtagctgaatggatgaattggttggggggggtggatggatgaattggtgagtgggtagttgggtggatggatgcattggtgggtgggtggatggatgaattggtggatggatggatggatgggttcatggttgggtgataaatatatccatgggtatacatatggatgtgtacatagataattctctggctatgatagggaggactggctgtggtggggaacactgactgtggtggggagcactggctgtagcggggaggactcagtaggacaaggagaggctggaggcagtgaagacttaggaagcagttgcatagtcctggcaaggaataatttggggctaggatcaggtcaattaaatgtttaacattggaactatgtctcttgtatacataactgcatatgtcaagtcttggtatcgttttctttctagcagggcacattcctttggaatgagcttttactggcaactgctcagaagctgttctgtatataatgaccaccaacagtttaatccttttttcagccatcacctcaggaattaacagtagtatgaaatcaattaaaataatcagtctttgagatgtcatgccttctccacgatcaacttcttctttacaaggctgtgttccaaatacgccaggccaaaaagacgtgaactttgtcctttttagggtttgtgtcttgatgtttcctggctaaatctctttgtatgtgttggccttgtaaggtttactttttttttttttttttttgagatggagactgtgttgcccaggctggagtgcagtggtgcagtctcagctcactgcaacctttgcctcccgggttcaggtgattctcctgcctgagcctccctactagctgggattacagacgtgcactaccctgcccggctaatttttatgtttttagtaaaatataaaaattatgtttttatggggggttcttgccatgttggccgggcttgtctcagactcctgactgcctgcctaggcctcccaaagtgctgggattacaggcatgagccaccgcgcccaacctaataactagatctctttaattattggaacatgtatattttgatcagattgacacttttttttttaagtgaagtgatcttatttccctcatttctcatttttaacttttttttttttttgatatggctttaaagctctgtggagctgtaagggtctgggttccttgacactccatgggggtctcaggtgatcgtgggagggctgttggaatcagagctatttggagggtgcataggccagtaggatgggaaggctgtgggagaagtgggctttttggggaccgcagccaaatggacaactgggcctaatctaaagattggcccctcccagctcctactgatggtcatgtaacaggaatggggcccagcaccaccagattttctgatttttttttttttttttgagacacagtcttgctctgttgccaggctggagtgcagtggcatgatattggctcactgcaacctccgcctcctgggttcaagtgattcccctgcctcagcctcccaagtagctgagactacaggcatgcgccaccatgcctggctagttttttgtactttagtagagatgaggttttaccatgttggccaggatggtcttgatctcctgacctcgtgatcctcctgcctcggcctcccaaagtgctgggatgacaggcgtgagccactgcgcccagaagattttctgatttttaaagttatgccagagaccgggcgtggtggctcacgcctgtcattccaacactttgggagactgaggttggcagatcacctgaggtttaggacttcgagactagactggccaatatggtaaaaccttgtctttactaaaaattcaaaaaaaattagccaagcggggtgaccgcagtcccagctatttaggaggttgaggcaggagaatcacttgaacccgggaagcagagattgcagtgagccgagatcgcttgaacccgagaagcagagattgcagtgagctgagatcatgccactgcattccagtctgggtgacaaagcaagactctgtcaagaaaaaaaaaaataaaaataaaaagccggaaatcaaattttaaatgttgggatctaatctaatttttttaaaaacaaaaagtatgcctaaaacaacagcaataacaacaagccatctatgggccaaactgtgggtggggaaacctattttgtacttcttattttatccgattgaattgtggtggagataggaaattgagaccccaaaaagggtagtaagttttcccaaagttatttagtcagttgccagattatggcttgaattaaatttaaattcttcagctgggcatggtggtgcacacctgtagtatagctgcttgggaggcagaggtgggaggactgcttgagcccaaaagttcaaggcacaggaagctgtgatcttaccaccacacttcagcctgggcaacagagcaagacctcatttcaaaaaaagaaaaaaaaaagaaaaatttaaattcttcattacagaacagctgatggtggaggtttattcttgggcaggtacatctgatctatttatgtatgtatctatgaatttgtctatttggcatggctctttagcaaaatacaggctttttttttttaagtaaaagtaattgaaacaaaatttgtttccaaggctggacagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggtacttagaataaagcctggcatacagaactgcagtttggttgttatccgtggtggtggcggtggcggtggcggtggcggtggcggtgatggtggtggtgatggtggcgatggtgatgatgatggtggtgatggtggtgatggtgttggcagtgatattggtggtggtgatggtcatagtggggaaggtgatgatgatgaatgaagatgattagaaagtcctcagttcacaaggtcagagtgatctagatgacacagggctcttcggttataagagaatatccttcagggttcctttaaatggctctctccatctttcgtactacagtgggacttgccacaggttctggggactgttaatgtgagatgagatgctacatacctttttgttgttggtgggtttttttgtgtgtatgcactgttgtgtgtgtgtgtgtgtgtgtgtgtgtgtgagagacagggtctcgctctgttgcccagggtgtagtacagtggcatgatctcagctcgttgcaacttccgccttccaggctcaggcactcctcccacttcagccgcctgagtggctgggaatacaggcacgctccatgctcagccactttttgtgtttttcatagaggcagcatctcactatcttgcctaggctggtctcgaactcccagcctaaagtggtctgcccacttggcctcccaaagtgctgggattacaggcatgagccactgcacctgacctgtatgctcctgttaagagagctttatttttatttatttattttgagacagggtctctgttgctcaggtgggagtgcagaagacaccacatacctttatcccttgttcctcatttcttagtctttctggctactgatctttttagtttgcgtgttcatcctgaaaggtccttggatatataggagccttgtctgtttcttcaaaccccgtggcagctggtttcatgctccaggcgagctcctgtcctctggggtgtgtcctgctgacccctcgcctgtgtttgtgttcgcaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgtaagtcactggggggtttcgttgtggggggtgggaaggtgcacctggacggggagtggtggttggtgataactgacatttctcttctacttagttgaccctaagttccttcttctagaaggcagaagaataatgtgggaggtgaaaactggagctctggagacaaacatgggtacaaatctttgctctgccgcttagtatttggcctcgagcaaattttttaacctccccaagcctcagtttccctgtttatgcaataggaatgataggcttgttctcaaggcattcctgggagattatcagctcttcccctcttactgagccgatctcctttttatttaattaaatatatttatatagattttttctggccaatttttaatttattttttgtagagaggggggacttgctgtgttgcccgggctggtcttgaacacctggcctcaagcagtcctcctgccttggtctcccaaagtactgggatgctcagtgtgaaccaccacgcctggcccctaattttttttttaagttggcttttattttgaaataatttaaagctacaggaaaattgcaataatgggccaggcgtggtggctcacgcctgtaatcccagcactttgggaggccaaggcgggcaggtcaggagtttgagaccagcctgaccaacatggtgaacctgtctctactaaaaatacaaaaatgagctgggtgtggtggcatgtgcctgtaatcttagcaacttgggaggctgaggtgggaggatcccttgaacccaggaggcagaggttgcagtgaactgagatagtgccactgcactctagcctgtgcaacagagcgagactccttctcaaaaaaaaaaaaaaaaaaaaaaagttgcgatgataccaggaactgctgcctgattttctctatccatcactcatagtcactgtttcctgttttttttttttttgttgttgttttttgtttttttttgacacaaggtgttgctcttttgcccaggctggagtgcaatggtatgatcacagcatactgcaaccttgaactcctggctcaagccatcctcctgcctcagctttttgagtagctggtagctgggactgcaggcatacaccaccatgcctggctaatttaaaacaattttttgtagagacagggtctcgccttgttgcccaggctgttgtcaaactcctggcttccagtgatcctcctgcctcggcctcccaaagtgctggtattacaggcatgaatctggcctgtattcactgattttttaatcttttgctacatttgttttatcatgagcttttgttctctctctctgtatgcatgctataatttattttttctgaatcatttgagaatggatgcaccttgaaacatatcccacccgtagagggctctcagtaaatactggttgaatgaatggttgtcgtggagggctttcttgtgcagtgcgccggagttgcagctagagatgagctgtgagctgagctcttgagtgttcaggcaccggggagcatggtgaccagacaaacagtcctgttggaggtagtggggcgtagcaggctgattacagaccatcacgtgccggcctggatgccagctcaccataccgaggacttgtccttattccagtggatatgtgccatgtcctaggactgtggctgatcatttgaaggctggctggttctcctatccctggggctgagctgttcgtgcaggccctgggggaggttccagggcggtctgttgtaggatatgtatgtgcttctcttccaggccttgggatttttgctgtggatcgtctgctgggcagacctcttctactctttctgggaaagaagtcggggcatattcctggccccagtgtttctggtcagcccaactctcttgggcatcaccatggtaagtaggagctggctgtgacccctgggccatctgctgggctcagtggagaccaaaagtaataactcgtaagactagaatcatagttttttaaggcaatgatcagctggagctgggatataaattaaatgtagcctttttttttttttttttttttttaaagacatgagatctcgctttcatccaggctggagtgctatggtaccatcatagttcactgcagcctcaaacttctggcctcaagcaatcctcctacctcagacttctgagtagttgggactacaggtgtgtgtcaccacgcccagcttatttttggctaattttaaatttttctgtagaaatgggatctcactgtgttgtctaggctggtcttagactcctggcctcaagtgatccttccagagcactggcattataagcatgagccactgttcccagccccagctgcagtctttggatggggcatgtgttgtccagtttgccacagtccccaccatgccctattgtcttccctgccactgattgagtggcagatgcccccttttgttgcgtttgccacactttgctcttgcattggctactttggtcacttatatactaactgcctggggtctaatggccttgagttttcactatctggcatagggggtgggttgctaagctaaataggaaactgctctgtcccgggggatacacaacttagtgagtgacagagacaaggaaacaactttattaattacagctggtgtgtattgagcacttactatgtatgtacctggcagtattcttggtgtttcacgtgtcttgaaattcattgaattttcacaacaaccctgtgagatgggtcctgctttgttcccatcttacaggtgaggaaaccaggcaagagaggttaagtgtcctgctcaagatcacaccactaatgtgcagccgagtcaggggtgggaccccagatgccatgcttttagcccctgcaacctgcagcttctgagccctgaacagagagttctcggagagtgtagcccttgagtattgtaaaaagaggagggaggctgggcatcgtggctcatgcctgtaatcccagcactttgggaggctgaggcgggagaatcacttgaggtcgggaatttgagaccagtatagccaacatggcaaaaccccgtctctactaaaaataaaaaaattagccggcgtggtggcacacgcctgtagtcctagctactcaagaggctgaggcaggagaattgcttgaacccgggaagtggaggctgcagtaagccgagatcgcaccactgtgctccagtctgggggacagagcgagacctcatctcaaaaaagaaaaagaaaaaaaaaaggagagaacaagtttaaggcaggacattctgagcagggtgaacagtgtgtccagggaggggtggaaggttaaggggaggatgcaggcagggaggacaaggtgttcggtgaaggaacacggtgtgaaggttggggggatagagtggatgtgacagaggggtcaggaaagacaacgtggagccaggttgccaaggaccatgaatctttatttttctaaattaatttttcattttttaaattttagagtcagagtcatactctgttgcccaggctggacttcactggcgtgagatcacagctcactgcaggcttgaactcctgggctcaaatgatccttctgcctcagcctcccaagtagctgggagtgtaggcatgcaccaacatgcccatctacatttattttttatttatttatttttttatttttccccccgagatggagtttcgctttgttgcccaggctgaaatgtaatggtgtgatcttgagttgccgcaacctctgcctcctggattcaagcgattctcctgcctcagcctcccgagaggctgggattacaggcatgcgccaccacgcccggctgattttgtatttttagtagagatgggatttcaccatgttggccaggctggtctcgaactccggacctcaggtgatccacccacctaggccccccaaagtgctgggattacaggcatgagccaccacccccggccagtttgttatttttgtagagacagggtctccctatgttgcccaggctggcctcaaactccttgtctcaagtgatcctcctgtctgggcctcctaaagtgctaggattataggtgtgagccaccatgccctgcccagaccatgattctatatagcacacatatgtgctgtccactctctgccaagaactgtcctaatccctttattaacccttttacgttgtaaataaggtaagcaaagtgtggtacagagaggagaaggactggcccaaggtcacctggtcagtaagtggtagagccagcttccagtctaggccccagcgtgtagcctggcacctgctttacgcctggctctcctgctgggtttgattcccctttgtgtcctcagagcctggccctgtgcctggcatgcagtaagcgttccataaatgcatggagggaatgagagagtaaagggctttgctttgtcctgaattcgggtcttgggctctgtgttctggcagtggggtattagagtggatttttttttttttttttcaatttcactataatagagacagggtctttccatgttgcccaggctagtcttaaactcccgagcccaagtgatccctctgccttggcctcctaaagtggtgggattacaggcatgagccaccatacgtggtcagctgtttttgacttgagtaggtcatcctcccttaacattccttgttcctggtcttttttttttttcctttgaggcagagtttcgctcttttttcccaggcgcaatggcatgatcttggctcactgcaacctctgcctcccgggttcaagtgattctcctgcctcagcttccccaataactgggattacaggcacgcgccaccacacctggctaatttttgtatttttagtagagatggggtttcaccatgttggccaggctggtctcaaactcctggcctcaggtgatccacgtgccttggcctcccaaagtgctggtattacaggcgtgagcaactgtgcctggccgttcctggtcttttgatcgttcatttatgcctctgtcaccctgggggaaacaggggtgatagtctgagggttggggcttttgactcctcaggggactctgagctgggctggccaagaggtgaactggcctgtgagatcctcagcctctctttatctacctgagatctctgggatggaatggaggaccaccagctcagctgtgaatgtgtcagaaacattctgactatatcccagggaaccaggatatgcaggcactggtaatatgggacaggatgcagccagcacatgttttttttttttttctttgagatagcgtctcactctgtcgcccaggctggaatgcagtggcatgatctcagctcagtgtagcctccgcctcccaggttcaagtgattctcctgcctcagcttcccagctagctgtgactaaaggcgtatgccaccacgcctggctaatttttgtatttttagtagagatagggtttcaccatgttggccaggctggtctcaaactcctgacctgcccgccttggcctcccaaagtgctgggattacaggcatgagccactgcacctggctgatttttttttttttatccctactctgtatcaagcgttggagacacaaccatatagtctagctgtgcaaacagacattaaacaaatgattcctcaaaaggcacaaagtgtttgaacgtctgcagagtgctgtgtgagggtgaaggcaggggagcttggtttggtctggggcatagccaggcttctctgagggagggatggtggaggtgaagcctgagaatgagcaagttgttaaaaagcttaaggggctgagggcagaggaccagctgcggagaaaagcacatgtaaagtcctgagggtcacagggaaaacttgagagttgtgtgtggctggagcagagatggccgaggcagagagcaggggcgatggggcagaggctgaccccgggaacgttgagcatcagggcaagtgggttttgttttctgtactgggttctctgcctgttcttttaaataaagttttattggcatgaaggcatgtccattcattaacatcttgtctatggccactttcacactgcagtggcaaagctgagtagttttgatgtagtctatggcccatgaagtccaaaatatttattacgtggtccattaagaaatagtgtggctgggagcagtggctcacacctgtaatcccagcaccttgggaggccaaggcaagtggatcacctgaggtcaggagtttgagaccagcctggccaacgtggtgaaaccccgtctttactaaaaatacaaaaattagctaggcatggtggcgggcacctgtagtcccagctacttgggaagctgaggcaggagaatcacttgaacctgggaggcggaggttgcaagtgagctgagattgcaccactgcgctccagcctgggtgacaagagtgaaactctgtctcaaaaaaaaacccaacaactcctgtcttgtgcttctctcctcagctgcttgctacctttttaattcagctggagaggaggaagggagttcagtcttcagggatcatgctcactttctggctggtagccctagtgtgtgccctagccatcctgagatccaaaattatgacagccttaaaagaggtaagtggcagtctccttcctcatcttccttcagtggacccggagggagagatgctgggtccctctggcttgtgtagaagtcatgcgttgccatgggaaccaggggctgggtaccacatgcacctagcttctcccttggtgactttcctaccccaccaaatcctcactaaatcagccccagccttttttctagcacctcctttccccagggcctgatttgtctgtgttgctccaaggggctcccatgggacctccaagggcaggagctgtgggccgatgccaggctggccccatcagcaggaaacagcaagacaggcggctccaaattttgccaggctgggatggagccgagccgggaacggtgtttgcagagtgactgttcccctgggggaccctaggcttgtcctcgcgttacctttgtcccatcagttgctgctctggctggggaagttgtttacattggctgctgtgtgctgctgctaggaattttgaggagtgtgcacttttttttttttttttttgctgttgttgaggcggagtctcgctctgtcaccaggctggagtgcagtggcacgatctaggctcactgtaacttctacctcctatgttcaagcgattctcctgcctcagcctccccagtagctgggaccacaggcacgcgccaccatgcccagctaatttttgtatttttagtagagacggggtttcaccacgttggccaggatggtgtcgatcacttgacttcgtgatccacccgcctcggcctcccaaagtgttgggattacaggcgtgagccaccacgcctgacctggagtgtgtgcttttggaataacctgctgttcctgccatcttggagctaattagagactggcatgaggcaaaggaaggaaaagaagctgaacatttgactattgattgcctacatattattatgagtgatagcagctgatgctgattgagttcatgttttcaaagtgcctcgcaggggactgtgtatgtgtcacgaataatcttcctgacctcttgcagtgacttggacagaatttctcagcctcagcactaatcgacattttggattggagactcgttggttgtaggggctgtcctgtgctttgtagacatttaggggtgtccctggcttcccctgactgggtgccataacactcccaagttaccacaaagaagatatccccagacactgccagatgtttcctgggaggcagaatcacccctggttaagaaccaccggtggtttataggtggggaatctgaggcacagaaaggttaaataagttgacaagatcccacagccagtgtgagagagccaggccttgatacagctctgtttcactcccaagccctgtcttcctcccatcaggcagcggtgagcagtgagactacccgtgatggagccggctttctgccattacatcccggggggagctgggagcccctggggagcctgcagtgtccctgtggctgagtgggtttctgccacctgctctcagaatgtgatcttggttttttttttttttttttttttgagatggagttttgctctgtcacacaggctggaatgcagtggcgtgatctcggctcactgcagcctccgcctcctgggttcaagtgattctcctgtctcagcctcccgagtagctgggattacagttgcccaccaccacgtctggccaatttttgtatttttagtagagacggggtttcaccatgttgaccaggatggtctccaactcttgacctcaggtgttctgcctgtctcggcctccaaaagtgctaggattacaggcgtgagccaccacacccagccccagaatgtgatctttttcttccttccttccccaccatgtaggatgcccaggtggacctgtttcgtgacatcactttctacgtctacttttccctcttactcattcagctcgtcttgtcctgtttctcagatcgctcacccctgttctcggaaaccatccacgaccctgtaagtgtgaccacagatgagtgtgtgtgcgtgtgtgtgtgagagagatgcgtgacacagtaccagctaacatttcttagatccatccaggatctcgttccagcctccctcaacccctgatacagggaatatcatcccacctactttacagatggaaaaactgaggcttagatgtggctgggggagctgaaggagagaatctgctttgtcattgatgaactgctgtcttgcaggcctgtaggtttctcacttggcatggtgattttggaaaatgtgagcagataattacaaatcaggtattttttatgaattctagctgtccagatgttctggaaaagtaaagttctgacagattaggcctataatcctacagggcagagctgaggagttgctggagtccccggcactccctgttgtattatactggcatgctttcctcacttgtggcaaatgcctggcccctgagggatttgagtgtgagatccttggtctattttgtcagtttcagagaaattctgtaaatatggaaacttatcagtgaggagtgtagagatggccaccgtttctgctagtagaacaaaagggaacactttattaatttcccttaattcttttcttcttttttttgagacagggttttgctctgttgcctaggctggagtgcagtggtgtgatctcggctcactgtagtcttgacctcctgggctcaagcaatcttcctacctcagctttctgagtagctggaattacaggcacacaccaccatgcctggctaattttttttctttcttcaacttttattttaagttccagggtataggtacaggatgtgcaagttcgttacataggtagatgtgtgccatggtgatttgctgcacagatcaacccatcatctaggaatcaagcccaggatccattagctattcctcctgatgttctccctacacctgctccccaacttggcttacttttaattaattaataattaaagatggggagatggtctcaaacccctgggctcaagcgatcctcttgccttggcctctcaaagtgctgggattacaggtgtgagtcaccacgcctcgcctattctttatttttttaaatagagatgggatcttgctgtgttgcccaggctcatgtgcagcttttgataagagagatctgggaaggcctgcccagaaaactgcatgtgagcggagacctagaggggtgaggtagtgggtggagcaaacacctagaggaagagtgttccaggcagaggggaataagtacaagggccctggggtggggaggtgtggagagaacagcaagaaaagccagcacagcaggagaaggctaagagacagtgggtgcctgagaggtgggacagcccccttgtgagccagatgagctgtttgggttttattgtgagtatggggcagggaggccttggagcacctatttgatgctgattcatggctagtcagctggtaatgggcggattgcagtgggagaacttttcacctctgtggttctgttgggtttggcctaaacctctgtgaggggcagaggctcaccttgtgggtgacgaaagggcttggtgggcatcagtatggaggaggaggttgatgataactaagagattttagaaacctatgtctcaggccaggtgtggtggctcacacctgtaatcgcagcactttgggaagctgaggcaggcagatcagttgagttcaggagttcgagaccagcccagccaacatggtgaaatgccatctctgctaaaaatacaaaaattagccaggcatggtggtgcatgcttgtaatcccagctagtcgggaggctgaggcaggagaatctcttgaccctgggaggcggaggttgcagtgagcagagatcacaccactgcgctccaacctgggtgacagaatgagactctgtctcaaaaaaagaaaaaagaaatgcatgtcccagtgtatgttctgaggagtcccgtgttggtatttccttgcccaaagaggagctgggttggagaaatgagcaagtgcacacatctgtgtatgtattcctgtgcatctgtgtgtacgtgtgcatgtgcctgcttgtgtgtctcggtagtcataggcatgtatatgcgtgtatgtgcttatatgtgaatgtgtgcttgtgagtgtgtttatgttcatgtatgtgtgtgtttgtgtgtgtgtgtgtctttgtgttgtgtgtgcttgcatatgtataaagttcacaaaggcaatggtgactcatgcctgtaatcccagcactttgaaaggccaaggctagaggatcgcttgagcccaggggtcaccccattttggatccctggctggtgcctgacacagaagagaggggctcatgagtcagtggctgttatatgtattgtgtatcagtgtgtgtaagtgtgtggcagccgagtgtccctgtttgtcaaatgttgggctattcttttttgtcttttgtttgttgtttttttctgttgttttgttttgtttttagacggattcttgctcttgttgcccaggctagagtgcagtggcatgatctcggcccactgcaaccccgcctcctgggttcaagcgattcttctgcttcagcctcctgagtagctgggattacaggcgcccatcaccatgctcgactaatttttgcatttttagtagagatggggcttcaccatcttggcccggctggtctcgaactcctgacctcaagtgatccacccgcctcggcctcccaaaatgttgggattacaggtgtgagccaccgtgtctggccgagccattctttagaactgggatttatacaaaacaagtcacacctcaactgggtggctgcagaccttggattgctcagggtaaacagagtctggttggggctgcctggctggcgtggggatcacccaacccatcaagcttcctctgggagcctgggaagagctctcttgccatggatggttctggaagctttttgaaggagggactttcttaatttctgatctcccttgggaatctggataaattccctttcacttctcccctgggcgtgtgtgtaccagggtgactcacagatctgacttggacctttttttgtgctttctgcattcctggcagcctgggcctgggatttgctctgccaccctgggtgacatgaagctctcagctctggcggctaaaaggctacactgttgtggggctgggacaccctgactcttctccccagtcattgttttctgtttctgtgtcatctcccccagctcggctcctcctgtgtcactgctggtcttccaagatggtggaagacactgtggtttgtctctttgcagtctcgctctgtcgccaaggctgtagtgcagtggcatgatcttggctctgcagcctctgcctcccaggttcaagcaattctcctgcctcagcctcctgagtaactgggactacaggcgcacaccaccatgcctggctagtttttgtatttttagtagagatggggtttcaccgtgttggccaggatggtctcgatctcctgacttcaagtgatccgcccactttggcctcccaaagtgctgggattacaggcttgagccaccgtgcccggctgtggtctgcctcttgtgcagtgagatccagcagggtgtcaaatgtgggtgtgcaggctgctgcatttctgacatttgtgcacctgtccaggagagaacactttgattggctgacactctctgtccaggaagcctgaacttccctctgggttcctgttcaggaaccccatggggttgccatttacctttttgcagattagagtttagaccaggagttagccagtagcccatgggccgaatctggcctgctgcctgtttttgtaaataaagttttattggaacacagccactcgcgttcatcacatagtgtctacaggtgtctggagctgcagcagtggagttgtgtagttgctacagagactgtagcacccacaaagtctaagatacctaccatctgaccctttacagaagaagtttgtccacccctggtctaagcatttctttagctctgatgactttttagcttccttttttgtcccctttccatttgcaggcattctttcttcctatgcaaggcaaggacgggaatcgacatttattagatgcttgcggtgtactggctagcactatgctaagttctttatatgcatgtctcacttgactctcacagcagtcctggtgaacttggtactatttttctcattttacagacaaacaatcgcagacataagtgccttgctcgacctgagtagtagagcagagattcgaactcacgactggctgttgtgcacaatcatgtcacttcgcttggttgtaactgctgaatgggagggtcttggctaaataatggctttgtgttaggctagaggcttcacgtggcagtatccaccttgtaacctcagtgcctaagacacagccaggcacacggtgggcctgtagtggtaatttattgttgtgttatatggggaggtgctcagtacatgtggcacgtatattatgtcttgcataagggtgaagtgtgcatgaggcctcacaggacatcagattaagctgcttctctgccttcatcctgttcaagtattaccagcaagaaagaggaaggggactgatgtatgcacagatgttctgaaggcttggcatggtgtcaagagccttatttttttttttaatgttgcattttggggggttaaatatatgtaacctaagatttgccattttaaccattttaagtatgcaattcagtgatgctaagtgcttttaaaaatcttgttcaaggccaggtgtggtggcttacacctataaacccagcactttgggaggccgaggcaggtagatcacctgagatcaggagtttgagaccagcctgaccaacatggtgaaatcccatctctactaaaaatacaaaaattagctgggcatggtgttgagcacctgtgatccctgctatttaggaggcagaggcaggagaattgcttgtgcccgggaggcggaggttgcagtgagctgagatcgctccagtctgggcaacagactgagaccctgtctcaaacaaacaacgaacaaatgaacaaacaaacaaacaaaataaccacataactacctagcaacgtagcctagcaattgagatgggggcaaggaagggtaggaaccaggtcctgtgagaatcagctagacttgtggctttgggctcggtgctcttcctttggggacgtcagcagccccttcttgaaaacgggttgcaactcgatttgttgttggcttcacctcctctctctgtcccagacctgagccctgtgatctggggaggaggacaacgggacaacctgtttgcttgttttcccatcactctcagggattgaatcacagtggagccaggaagatggggagagtccaggcttgctgctctcccatcctcagagcagcagcaggccatccatcacctgtcgcctgtcctcagagtgatcagccaaggcctggggcggctggggtcaggtcaggcagggcgtgggtgggagctggcagggctggctcctccaggccacttcgtgctgagtcactgagtcggccaatcctccccagctggccctgctcccactccatgactcagatgtctattccagccctggctgcttggtggggctcctcccatctgtccttctggctctggggctgccgaggcttttgggagcctgggcagggctgaccaagactgccagagctccggccggtccccagtctcctgccttttttctcattggcactgagtctgtggtttaggtttgggggaggagggtcttgtagataaggggatcaaggccaaaggagatcatttattaggtcccagctgaaagcagaggtccttggaccagttggaatgctcgacatcccccggaagcttgctagaaatgctgggtctcaggcctcatcccagacctaccaagtcaaactcattttaacaagatctccaggtggttcagggttgcaaatcactggtttggaacattcagtgaaagctactcagctcgtttgcagtaagaggtatttttagtcctgtctgtataatatgtaatattttccccccagcattttactatgaacattcttaaacctacagaaaagtcgaaagaattctactgtgagcagtcatatagttggtacctagagccacagttaacattttgctaaacttgctttgtcacatatctgtctgtctaaccagatagctaatcagccagccaaccggctacttttgttttgttttttgtttttgagatagggtctcactctgtctcgcagactagagtgcagtggtgtgatcatagctcactgcagcctccaactcctgggctccaatgatcttcccgcttctgcctcccaggtagcttgggccctacaggtgcacactactgtgtttggctaatttttaaattttttgtaggcgtgagggctccttatgttgcccagtctggtcttgaactcctggcctcaagccatcctcccacctcagcctcccaaaatactgggattacaggcctgagccactgaacctagtttttttgatatctgaaacttccttcgaaatatattagtattctttcatgcacccacttccaagtaaatcattagctagagtttaagatctgtttacacttctgagttttttgcttaaaatttacatacagtgaaattgctgatctcaagttagcatttgatgaatcttggtaaaggaatactttaaacccctgtcaagatatagaacactgcaaggacgccaggaagttccctcgtgccccttcatgatcagtctctgtccccacccaccaaggcctgatcttggaccgttgattaaagcgttgaaactccattttctttccatttctccgtcatgctttcagtcatttaataatcaggtgttgtgccaggggctgagctagaaagaaacagaccttgaccactgccctggaggagagatggaaggtgggtggcaggcagttgaaccaacaactgcaggatggacagtgggggctctgagggagggaagtgctgggagttgtgggggctgggagagtggtccctgactcagcctggggctccagggctagcatccagggaggagaggggatgctcaagtctaaggaatgcgaggctctggccaggtgaatatgtttggaggtggtggggtgggagggtgctcctggtagagcaactggcatgtgcaaaggtccagttgagggagcttgtgggtgttgggaatcacttggaattcggcttggctaggctgggtgcagtggctcatgcctgtaatcccagcactttgggaggccgaggcaggcagatcacctgagactaggagctcaagaccagcctggccaacgtggtaaaaccccgtctctactgatcataaaaaaattagctgggtgtggtggtgcatgcctgtaatcccagctactcgggaggctcaggcaggagaattgcttgaacccgggaggcggaggttgcagtgcgccgagatcgcgccactgtactccagtctgggcgacagagcaagactctgtctcaaaagaaagaaagaaaaaaagaattctgcttggctagattggaagggctaggatgtaagcgaaaagagaggcaagagtcagcatcagagatcaagggtgcaattatgtgtcacaataaggacttggaattttttgtttgtttgtttgttttgagatggagtttcactctgtcaccaaggttggagtgcggtggtgccatctcagctcaccgtgccctccacctccggggctcaagcgatcctcccacctcagcctcgcaagtagctgggaccatagttgcgtgccaccacgcccaagtaactttttctgtttttggtagagatggggtttctgtatgttactcaggctggtcttgaactcctgagctcaagtgatgccctgccttggcctcccaaaatgctaggattacagggatgggtgaaccaccacatccagccaggacttggaattttaaccctactgtggtgggagctgaggaaaggtttttcaccagtggaatgacacactcaggttggacaggttgtggaagatcctcaggctcaaaggaagaggatacattggacatgggggtgaggtcggtggcacttaaaaagcctttgcaggcacccaggcaggtagagagggaggctgagccaggatattcccctgtgcccactacagcatcaaaaaccagaaaaagggccaggtgcgtggctcacacctgtagtcttggcattttgggaggcttaggggggaagatttcttgagaccaatctggtcaacatagtgagaccccatctcttgaaacaaaaaaacaaagaaaacagacaagttgatgggcaaagggcatgggcaaagattctggggtgtgctccagtagaggaaacggaggtcctgggcagggaggcattttgcacagttggtaagcaacagggcaaacaaatcaccagtgtttacgttatactggcaaatctcttactgctggacatttaggctccgtctaataataaggataacagctgggtgcactgtattatttatttagtcctcacagtagggcaggatgatcagtctccccacttgacagatgaagacactgagggtcagagtggtgatgtgtcaggaaccctcccactgggttctcacgcttgaaacacagattgctggtccccacccacacagtttctgatgcagtaggtctgggtggggcccgagcatctgcggttcccaacaagttcccaggtgccaccgatgctggtgacagagctgcgtttgaggatcactgctctaaacattattgctgctgcacgcattgcctcctgctgggtgcaggggttgtggggggcactttggcagtgcagagcggaggtaaccagcagaaaacccgttagaactaaaagctgagagtgtttctgacaaacaggtcaacatgctgaaagacccagacaaggtccttaaactaccctgcgctccaagaatcagtgcctggggctgccgtacctaattggttcaaaccacagggtttctggccagctcatctggtaccaaacgtagatgtcaatatggtggatgccaaagaacacatcactctgtttggatgaatcaggcttttcctccctctgccttcagccaggacttctctgaattgttttcatttcaaatgaaagagggaccagttcacaagctgctttcatgctatctgggacaggagttactgtatttcagtgtctgaggctgggaaaccccctggaggtggctctgtcttttgtacctagtgtgtgatgtcaaaagattctccttggtttgggttaaatgacatgctccctggattacaatccagtgccccatgattttttttcctccttttttattgtcaatccttgacctacttcagaagttagttgtctttgttgtcaagtaaggccttccacgtcagatagaggctgtttccaggccgggtgcagtggctcatgcctgtaatcccagcactttgggaggccgaggtgggtggatcgcttgaggtcaggagtttgagaccagcctggccaacatgataaaacccccgtctgtactacaaatgcaaaaattagccaggcatggtggtgtgcaccatgtaatccccgctatgtggcaggatgaggcaggagaactgtttcaatttgggaagcggaggctgcagtgagctgagaacgcaccattgcgctgcagcctgggcgatgagagtgaaaccgtctcaaaaaaaaaaaaaaaaaaaaaaaggctatttcctttttttttttttttttttttttgccagtgaaggggggaccctgtgttggcctccctatcggtcacttgagataatctgaaaatctgtgtttagatccatagaagagaggcggcctgaggagaagaatttgacaaagctctttgagtgtgcaaattagaaatggcaattgctgggcgcggtgggtcatgcctgtaatcccagcgctttgtgaggccgagataggcggatcagttgaggtcaggagttcgagaccagcctagccaacatggtgaaaccccatctctatcaaaaaatccaaaaattagccaggtgtggtggcagatgcctataatcccagctactcaggaggctgaggcaggagaattgcttgaacctgggaggtggaggttgcagtgagccgagatcgggccactgcactccagcctgggcgacagagtgagactcagtctcaaaacacaaaaaacaaaaaactgtgcagtgttctgtctgtcaatgtccttgttgcatttgcagggcaggttttctaccagtggctggggacttagttttactgggccgagggaaggttaggatttgagggtcttgttaagctggatatgggctgcatttcaagcctcccctggctgtctctatcctgcgtgttgatgccaaggctgaagaagactggatttgcaggcaaaagactgtcatttgaggcctgttttcaccccttaatcactgtgtcttggtatgttgtgggggttgaggtaggcagaggttagccaaccttttctggaaagggctggctgataaatacttgaggctttgcatcccatacactgtctgtggcaacccctaactccgctgtgtagctcaaaagctgccatactcatttataatacataaatgaatgggtgtgactgttccaatgaaactttatttataaatagctggtctgtgggccatagatgcttctgatatataaagcatctggtatagtggtgtattgtgaacccactggggttttttcccccccaaacacttgagctttattgatgtatattgacaaataaaaatggtatataggttgggcacggtggttcatgcctataatcccaggactttgggaggccgaggcaggtggatcacttgagctcaggagttcgagactagctcaaggaatagagtgaaattctgtctctacaaaaaatacaaaaattagctgggtgttgtggtgtgcgtctgtagtcccagctacctggggggctgaggtgggaggatcacttgaacctgggaggtcgaggctgcaaagagctatgattacactaccgtgctccagcctgggtgacagagcgagaccctgtctcgaaaatatatttaaggtgtacagttttatgtttccatataccagaggctactgtcactgcttctattattattactactactactactcatgttaccctttctttggctgttactttgtgccaggtactattctaagtacttaccatgtttgatctcatttaatcttcaccaccaaggaactgacccaaggtcccacagctaggaaatggcaagctgggattgagccgtgccagctagccccgtgctatgcactgcttcacacagaagctgcccctccacccctgccgccttccttttcctttgttcctttgttatcagctggccgtttccagaaacggttggttaacctctgcctacctcaaccctcagtgattaaggggtgatatcgggcctcaaatgactgacctttttcctttgttgcagctctcactgattgtaattctgattgtaattatatatttgtttgcaccgtggtttacttactgtccatcttccccagggcaggaggctgaatggggcaggggtctcgctgtctcgtttgcagctccgtccgcggcacttcacccacatcctggcctataagcaagtcctgcccatatatttgaccaataaataaatgaatcattgacagccgtgccccaccccttcctcctctctctgccagccagcaccttggtctttcacagtgggtagagggcttgggctgcaggtgaaatggatttgcaattccctgataacccacccgccgactgtgggagtgggcaggaaggtgtcagctcttccggatgaaaaaccagcctgcaatgcagtgtttctacccagcctacaaagcaaacaccactacctccacgccttaggttggagaaattccgctttacgacacagtcccatgggcctcatgtcatttgtccctcctggcagtcccgggggataggtcgagcaagcagtaggacaaacgactcccattttccaggtgtaaaaactgaggcttggaggtgaagggacttgcccaaggtcatcagctagaatatagcagggctgggattagaacccaggtctgtccgggtccacggtctgatctgaactcggcttcagttggtctggaatgcaccggctgcatctgatgatcttattaaagatctgtggctgtcagggtcctccccctggaggtgctgatttagttggtctgggttggggccctaggcacttggcacttaacaaactccttaggtgattccagtggacaggcagggctgggaacttcatcacccctccgagccccagagcggagcctgatccttagccctggctgtgtatttgaatcactggaggagctttttatttagccttttatgatggaaacataaagtagacagcctaggataatgaactaccatgagctctttttcttttctttttatttatttttgagacagggtctcactattacccaggctggagtgcgatggcacaatctcagcttgctgcaacctctgcctcccgggttcaagccattctcgtgcctcagcctcttgagtagctgggactacaggcacgtgccaccatgtccggccaatttttatattttttgtagagacagggtcttgccatgttgcccagactggtctcgaactcctgaactcaaagcagttctcccgcctcagcctcccaaagtgttggggttacaagtgtgagccactgcgcccagctgccatgagctctttaccatgcattgcataggtgaacgttttaatatgtatctctgaaggacatggatttgtttattttaaatgactttttatttcgcaatagtttggctcacaaaaagttgcaaaaataacagagttcctgttgttcattgctcaactttctctaatgataacatctgaaagataagaattttaaaaactgtaactgttgggctgcatgtgatggctcatgcctgtaattccagcactttgggaagctgaggcaggaggatcacttaagcccaggagtttgagaccagcctgatcaatataggtagaccttgtcttgacaaaaaacatgtatatgtgactgtaatactaactttaataataattcattattatcaaatattccagtaatccattgtgtttgtacaatggctcattcttctatgatatcattctttatgttttagctgggatttttttatggaaaagagtttccccttcatttctttgatcactgatcactctgtggtgatcgaataaatgactgttttcctcagggaagccttctccaaccctggtgaaccaaatgagtacatttgggaaaggtggagaaaatacttgtttctttccgctttttctgcgttcaaacaatgacctggttcactgacaacatcagatgtttctctttatttccagcgtcaatatgaaatttgtgtacataaacatgtaaggctgggcgcagtggctcaagcctgtaatcccaccactttgggaagccacggtgggcagatcacttgagtcaggagttcgagaccagcctgttcaccaacatggtgaaaccccatctctactaaagatacaaacattagcccagtgtggtggctgatgcttgtaatcccagctacttaggaggccgaggcgggaggatcacttgaacccaggaggcggagtttgcagtgagccaagatcacgccactggactccagcctgggcgacagagcaagactccatctcaaaaaacaaaacaaaacaaaaaccttgcttggtatgtttcagcctgttgtacttattctccttgtcaaagctcaaattgtccctcttttagcctgcagcggccacttctgcttggctcttgagccttttaacaatcctgttcatgcttagtttccttgttgtccggtgtgacaagatgttcttggcttaccttgcatatttcctgcccagccacttttccaagaaaaatctggaagtttaaaacaaaaacaaagcttcagtgccccagtcgcacccagaaccagcttaatcagattgcctggtgcgggtagggcccggatacagtatttttttaaattttatttttattttgtttgagacagggtccctaggctggagtgtagtggcacgatctcagcttactgcaacctccgcctcatggattcaagcaattctgcctcagcctcccgagtagctgagcttgcaggcacccaccaccacatccagctaattttttgtatttttggtagagacgaggtttcatcatgttgcctaggctggtctcgaactcctgaccacaagtgatctgcccgccttggcctcccaaagtactgggattacaggcatgagccaccacacccagccaggatacagtattttttaaaaagcacgcccagccttgaatggaaaaccactggacgagagtatgccaccttatcgggctctgtaaatgccttatatctgcacaaggctggaactttgagtggagtccttggctaaagctttcattactgcctggtgacctctcttccctctgctgctaaagcttgtgtttcagaatttagacccggatgcatccatgttgaaagccaggctttgtctgtcatcccaggagctctgtatcggtccctttccttgcctgcatgttgttgacttggggctcatcttcatttctctgggaaatgagttctttgatagcttgcttagaatctctcagtacttcccattgcccttagaatgaagaccaaaatatgtggcctgcagtgtagactgtgcacagcctccagtgtagactactcaggccccttcttggttcctggagtctaccatgctttcttctaccaccgggcctttgcacacactgctgtctgttgggaatgcgttgcctttccttgttacttagttctcatctactcacccttcaggtgccagcttgactgtctgcctcgggggcgccttctctgaccttcgtacaccagatcagcccccatgcacttactttgtctcattggtaatatttctctcccttcaggacacacatcaaggcccagaagttgtagttttgcatttgttcatgtgatcatttgatgcatgtctctctctggagcctgactctttggggctcacatcctcactccaccgcttttagctgtgggaccttgaacaaatcttttcatctctggtccccagtttttaagttaaattaaattttattttatttttattttgagacactcttgctctgttgccaggctgtagtgcagtcgttcgatcatggctcactgcaacctccgcctcctgggttcaagcgattctcttgcctcagcctcccaagtagctggaactacaggcgcctgccaccacatccagctaatttttgtatttttaggagagacagggtttcaccatgttggctaggatggtctcgatctcttgacctcatgatctgcctgcctcggtctccgaaagtgctgggattacaggcccagtttcttttaactgcaaaacagggatgatataatacttttatttatcttgtgaggtgaggatgaagattaaataaggtagtttgtgtaaagcacttagaaaagagctagctactaatagtagagaatcttggcaggtattactgatgattactgcagtagaccacaagctccatacaggcaggggtcatttctgtttgtttagatttgtatgcagggtgcttggcacaagggttgtgctcaggaaatacttgttggatgaacgaatgaatgaagtggagataatagtaataccatgtttatagaattccatgaggatataaaataatgcaagtatataagctcttggtagagtgtctagcacatagtagatggtcaataaatattcagtgactgaatgagtaaagtggggacaatagtaatacccgctcatgaggttgtcgtggggatataaggcaaccctgtagtaccttgtagaatgcctagcacatagtaggtgctcagaaaatatttgttgaatgaatgagtgaagtagggatgacgttaacaccaactcctagggttgttgtggggatagaagacaaggcaggtctatagcatgttgtattgtggttgcacatggtagacactccgttgattgaaactggaagagctgccatgaatttctttctcctggctattaggagagggtccttttggggtgcagaatggtgtggagctgacgctagtcctctggaaggaagagtgagcagctgactacttgctaagctctgacctggatgaaaagtcaaatcattcctttccctcttcctcccaaacctgtgctttctttccactagaatccctgcccagagtccagcgcttccttcctgtcgaggatcaccttctggtggatcacagggtaaggccaggccccccagacctcagggaggtggtggggagtgaatgaatgaatgaatgaacgaatgaacatgctcagctccccctccccaacttctccctcctttgctcttctgcagagttgtcttgaatctgcctgtgctggccatgtggtctcagagacaccaactctgtccggcagttccgtgaacttgaatgtgataaacacgtgagccgtgagcagctgacacctctgcagaaggctttgcctgggacagccatatgctggactgcttttgctttagcttcagatttgggtttttaaaatattaggtatagttattattgacattgtccccctcctgtcccccacgccttagaaaaataatactgtctcaccacaggaagtgtgggttaaaaaaccacatgtgcagatcagcagtgcaggagacatctagaggtaaccagtgtcaccattttagtatgccttcttctggtcgtctttcttttttttttgagacggagtcttactctgtcagtctcagctcactacaagtctccgcctcccaggttcaagcgattctcctgcctcagcctcccaggtagctgggattacaggcttgcgccaccatgcccggctactttttgtatttttagtagagacagagttttgccatgttggccaggcttgtcttgaaactcctgacctcaggtgatccacccgcatcgacttcccaaagtgctgggattacaggtgtgagccaccatgcccagctaccttctggtcctctttttgtatatctttttctgcccgttgttaacatcttagtggggattgtttgaagaatctttttttgcccctaataagcatcatcttttttttttttttttttttttgagacaggctttcgctctgtcgctgaggctggagtgcagcggcacacttgtagctcactgcagtcccaatctactgggcttaggtgatgctcctgcctcagcctcctgagtagctggggctacaggcacactcccccatgcccagcagatttttgtactttctgtagagatggggtttcatcatgttgcccaggctggtctccagcttctgagctcaagtgattctcccgcctcagcctccagagtgctgggattacaggcgtgaaccaccatgcccggtctcatccttgtcttaatgacaaacatcgttttaaaaaattagatgttttaaataatttcttcaagttactattaaaaagcatcactgggacagttgatgtaatttgttcatgactacaggaccccggatgcatgctaataacattcattcttgttttggaaaattgtgctctagttacataagagcatgtcctggattggaagagaatacctccagtttttcttgggtaaaggcatgtagaggctgtatgttaactttttttttttttttttttttttttgagatggagtcttgctctgtcatccagggtgcagtgcagtggcaggacctcagctctctgcaacctctgcttcctgggttcaagagattctcctgtctcagcctcctgagtagctgggattacagggacctgccaccacatccagctaatttttgtatttttagtagagatggagtttcactgtgttgtccaggctggtctcaaactcctgacttcaggtgatccacccacgtcagcctcccaaggtgctgagattacaggtgtgagccaccatgccagccctttaactgtttaagtggttcagaaaaagatgatgtgtttgcatgtgtgtgtgtgtttgtgtgtgcatgtcaatggatacagacagagaatgatactgcaaacgtggcaacgtgttaacaatggtgagttgagtgaattcttagtatgatttgagtaatttttctataagtttgaaattattttagaacaaaacatgaaagtattttaccttttattataaaagtgtttagtctgctgggcacggtggctcatgcctgtaatgttagcactttcagaggccaaggtgggtggatcacctgaggtcaggagttcgagaccagcctggcctacatggtgaaaccctgtctccactaacaatacaaaaattagccgggcagcacacgcctgtaatcccagctacttgggagggtgaggcaggagaattgctagaatacaggaggcagaggttgcagtgcactgagatggcgccattacactccagcctggatggagtgacatagaaagattaatataataaaactcaataatctcatcacccagatttcatgcttactaatgctttgtcatgtcagcctttttattttttaattttttccttcagcctatttttttttttttctttttatagggtctgactctgttgcccaggctggagtgcagtgacacaatgacggctctttgcagcctccacctcctggccttgagcaatcctgccacctcagcctcccgagtagctgggactacaggtgcgagccatcatgactggctaatttttttatttttacttttcgtagagatagtctccctatgttgtccaggctggtcttgaactccagggctcacaaaatcctcccacctcggcctcccagagcgctaggattatagacatgagctaccgtgcctggcccatatcagccttttttaatttaaaattttaaaaagttggcggggcacggtggcttatgcctataattccaagacttcgggaggccaaggtgggagggttgcttgagcccgggggttcaagaccagcttgggcaacatagggagactcttgtctctacaaaaataaaaaataaaaaaaaaattagccagtcataatggcttacacccaaagtcccagctactcgggaggttgagatgggagaaccactctagaccgggagctggaggctgcagggagctgcgatcgcaccactgtactccatcctgggtgacacagcgagaccctctctccaagtaaataaatgaatgaacgaataataaaaaataaaaaagagctatcctgatacttcgctcctaaatcatctttttttccctaagtcttttgtatgcaccactaaaaaaaaaaaaagccatttttcctgcatgacccaacagaatgagctgtaattagcttgtaatatatgcaaatgtccatctgcattctgacttcccaagctgcatggctgccttcatttgcagcgggcagctgtgctgcagaggggagcagcatcagcaggcgtgtggagtgagtgagccccgtcctccccctcctcctgtcattgactctcattgcctaacccccttgtgtcttggccccaggttgattgtccggggctaccgccagcccctggagggcagtgacctctggtccttaaacaaggaggacacgtcggaacaagtcgtgcctgttttggtaaagaactggaagaaggaatgcgccaagactaggaagtaagtgtgagtttccttgtcctccaggatgccctggtcacctcctttccactcctgtggcctcaatccaggatggggccctggcagtgctgcctgttactagctttgtggttctgggcaagatgcctcacttctcctcctggcctcagtttgcttttctgccaaatggggtaggatctcacatgtcattaaagcaactgggcagagaaaagaagaaagaagctgggtgcggtggctctcgtgtctaatcccagcactttgggaggccaaggcaggcggatcacttggtcgggagtttgagaccagcctggccaacatggtgaaaccctgtctctactaaaaatacaaaaattagctaggcatggtggcaggcgcctgtaatcatagctactcaggaggctgacaggagaatcacttgaacccaggaggcggaggttgcagtgagctgagattgtgccactgcatactagcctgggagacagagtgagactccgtctcaaaaaaaaaaaaagaagaaaaatgttgtccaaacaggcagttgatgctgtctgccatggcgcgtgactatccctccttgagtcagtctcacttttttctgtctctttctgagcatctggcatcctgcatgttcttgctgtttgaatgttctgtccaacatgcccagctgaccacgtaagtctgtttagccaaagaagccccatttgagggtgattttggctgtactggattttaggctctaccccctatgtaaggcgtgccccactgcaccacctctgtcactcttcgggaatcaggccagtgcctcccctgcacataccttaactcatcaaatctgagacaccattagttgcgtgatgcgttattattctatgtaacagtaagaaagaaaagcagctgccaattaaacaaggacataagacttgtctcgagcccggacgaactggaacatgaaattgtgggtgacatgggggcagtggattgcggccatgggggtagtagaatggctgtttttgttcctgttgcctgttctggggtaagtttactacgataaactgtggtggggccagtgtggtgcattggattccccacagacccattggccttacagggaaaaaccccagaccggggttctgttcctcattctattccggggatgcccaggatacaggccttcagtcagacccagatggtgggtgggaatctggacatccatgtgccagccactaggacatcagcagaggacctcgtgactccggtcggaggctgtttgggtggtccaggtgatgggagaaattgtctcgtgggaggcagatagagcttgggcctctgtgactgagcattgtaaggaaatggcccatgtccatgacccagttgaaggtttttggcaggcaaaggtggggtccctgtttattacagttcttcatggagacagaactagtaggatggatggatggatggatagatgatagatagatggatgatagattgatagatgataggtagatgatagacggatagttggtggatgtatacatggtaggtagatggatagatgatagatagatggatgattgatagatgatggatggatggatggatggaggatgagaggggatctactagggaaactggatcatgtgattatggaggctgagaagtcccaccctaggtcatctgcaacctggagaacccaggaagctggtagcatggctcaggcctagtccaaaagtctcagacccagggaagctgatggtggaattctcagtccatagtcaaaggcctgagaacctggagtcattgggtaagtcccagaggccagaaatcctggagttctgatgttcaagggtgggagaggatgacatcctggctgcagaagagagagtgcctgcatttgccattactctgactttttgttgtgtccggaccctctgctgattgggcggtgccacccacatggggcgaggatggatcttccttagtcagtccactcattcaaatgccagtctcgtctggaaacatcctcacagacacacccagaaataacactttaacagcaatctgggtatcccttaacccagtcaacttgacccctaacatcacccatctcatctggattccttcagcctcacctgcagcatcccccccgctaagcaggccacatttgtagtgtgggcttcagcattcctcatcatccacgcctctgctgatcacctggctcggcttcctctcatggaagacggatgcccacctttgtgtcccctggagcttgtcaggagagcaggttgctggagacaccatgggagaggccaatatcacagccttgggaggaggacagagtttgaatccagaagctcctccactggcctggctcttaatccactgagcagatgaaactgactgctgcttttgtgcttagcgacgtttagtccctgagggttcagagagtggaacaaaagagacacactctagttgggtgccatcgacattctatatgggagacaggacgttggttgtgaaacatgcattgacaagaagctttggagaatgatggtgttggggtgagataaaaatgaggaaatgagggtgagagtaaccgaggaagcttttgtgtgtgtgtgtgtgtgtgtgtgtatgtatgtgtgtgtgtgtgtgtgtgtgttttctttttttttttttttttttgagatggagtctcattctgttacccagggtggaatacagtagtgtgatctcggctcactgcaacctctgcctctcgggttcaagcaattcttctgccccggtctcccaaagtgctgggattacaggtgcatgccaccacgcctgactaattttttgtatttttagtagagacggggtttcaccatgttggccaggctggtcttaaacttctaatctcaagtgatcctcctgccttggcctcccaaagtgctgggattacaggcatgagctactgtgtccggctgagagaggtgttttagatacagtggtcaaaggttctacccagtgtggccatgacccttggtgagcatgtgcctgtccctccctaagtctatctctggctgttttcgagcctctggcatcctgagtgttactgctttttgaagtgtttttgttcaacatgcccagctgaccatgtatgattgttttgagaaggtcacatttgagcagagacttgcattggagggagtgagccttgtgtgtatctggggaaggaagggctttccaggtagagggagcagccagtgcaaaggctctgaggacactcgtggtgcatcagggggcttgtgtggcttgaggaaagtgagtgagggggagaaagggaggagatgaagcaggagaaggatttgcaggggtctcctctgagagttaaggtgggattccaggtgcagtgagaacacaggcgcaggttttctgcagggcagtggtgtgacgtgagttctgttgtttgtttgtttgtttgtatgtatgtatgtatgtatgtatgtatgtatgtatgtatgtattttagagacagggtcttgctctgttgctcaggctggatggcagtggcatgataacagctcattgcagcctggaaattccgggctcaagcagtcctcccacctcatcctcccagagtagctgggattacaggtgcacaccaccatgcctggctgatgaattaattaattaattttatattttatatttgtttttttgagatggaattttgctcttgttgcttaggctggagtgcagtggtgctgtcttggctcactgcaacctccaccccccgggttcaagcgattttcctgcctcagcctccggagtagctgggattacaggaatgtaccaccatgcccggctaattgtgtatttttagtagagatggggtttctccatgttggtcagtctagtgtcaaactcctgacatcaggtgatctgcctgcctcggcctcccaaagtgctgggattacaggtgtgagccactgcgcctggcctttttaaatttattttattttattattattatactttaagttttagggtacatgtgcacaatgtgcaggttagttacatatgtatagagacaggtctcactgtgttgcccaggctggtctccaagtcttggcttcaagcagtcctcctgcctcagcctcccaaatagctgggattacaggtgtgagccaccacacccagctgagttctggttcataacaacccaggctgtcctggggaaggtggatatttagggacaagagtgaaggcagggagaccagggtgggaacctcaagggctgtccatgaagtcccttcatgcctcaccgggagccgccattgtatttatttatttattttttgagacagggtgtcactcttttgtccaggctggagtgcagtggcacgatctcggctcactgcaacctccatctcctaggctggagtgatcctcccacctcagcttccctagtagctgggactacaggcacgtgccaccacacctggctaattttttttttttttttttgtagagatgatatctcgccatgttgcccaggctgttctcaagctcctgagctcaagcagtccacctaccttggtctcccaaagtgctggtattacaggcgtgagccactgtgcctgactggagcctccatttttcacccagagcattttctgagaattcagtgagatatatgatatgataagctgtgccctagccctgagtacatgctgggcaggttttaattgtacaagttttatttattcatctgtacactttgatcttgccagggaggatgtggtgagaactgggtcttggggcttgaaagcgggccacctgagaagggtctggctctgtgagtaccttggtgtttagagatcctcagcgtggagccaggggatcatttacttgggacattggtagacggatcgcttgctttattcccagaggcataagccagatctggcacctgtaacccctgtgaacctggagagagtgagaaggaaaaccctgtcctaggctggaatttcctggtgtggccccttacactcagatcccttttgttaaccagagaaaggaatgcagctcgtgcagctctgggctgctgggtatcctaggctcggggatcaggtgatggacgccagggctgggggctctgcatggcttcctggatccttttaccacctctcttcacccatgagtgactccttctcaaaagtcaggtgtggctgggcatggtggctcatgcctgtaattgcagtacgttgggaggctgaggcgggaggctcacctgagttcatgagttcgagaccagcctggccaacatggtgaatccctgtctctgctaaaaatacaaaaattagccgggtgtggtggcgctcacctgtaatccagctacaggggggctgaagcatgagaattgcttgaattgtttggatttaaaaacccagtgcttcattggtttgtgtgtagtggttttatgttctcttttgtgtatggccactcagagcttagggccattttggactgtggtttctgctggcatgaatgtgaaatgcttctgtgactctggaagagtttggcagttttttttttttttttttttaagttagacacagtgaacataccaccagtcacccccttcccaggcatccagccaacagagctgagaacatatgttcataaaaggctggtacaggaatgttcttagctactttgtgataacccaaactggaggtaagccagacatctattagcaagtgaacagacagatgcaccagttatgtacatctgcacaactgaatactaagtgatgtacaagaacgaactattggccgggcacagtggctcatgcccataatctcagcactttgggggcccaaggcaggcagatcacttgaggtcaggagttcaagaccagcttggctaacatggtgaaaccctgtctctactaaaaacataaaaattagctgggtgtggtagcgcacacctgtaatcccagctactcgggaggctgaggcaggagaatcgcttgaacgcaggaggcggaggttgcagggagtcaggatcgcaccattgcactccagcctgtgtgatagagcaagactccatctcaaaaaaaaaaaaaaaaatccctataagataaagactacttttttggtgacagctttattgagatattcatacaccgcacaattcatgtatgcagaacatacaattcactgatttttagtgtgttcacagagttgtgcagtcatcatcacagtcaattttatttatttgctttttaagacagagtcttgctgtggcgctgaggctggagtgcagtggcacaacctcggctcattgcaaccccctcctcctcctgagttcaagcgattctcctttctcaccctcccaagtagctgggattacaggcaaccgccaccatgcctggctaattttttatatttttagtagagacaaggttttgccatgttggtcagggtgttctcaaactcctgacctcaagtgatccacccgcctcgacctcccgaagtgctggcattacaggcatgaaccactgcacccagtcaaaaaaaaaatttttttttagaaatagggtcttgctgtgttgctctggctggctggactgtttttttttttttttttttttccactgatgtatatatgcctatccctttacctgtcttgatgattgttgttcttttttttgttttgtttttttctttttgagactgagtctttttgcccaggctggagtgcaatggtgtggtctcagctcaccacaacctccgcctcctgggtttaagcgattctcctgcctcagcctcccaagtagctgggattataggtatgtgccaccatgccgggctgattttgtatttttagtagagatgaggtttctccatgtttggtcaggctggtcttgaacctgccgacctcaggtgatctgcccacctcggcctcccatagtgctgggattacaggcgtgagccactgcgcccagcctattgttgttctttctttttgagatggagttttgctctgtcacccaggctggagtgcaatggcctgatctccactcacagcaacctccacctcccaggttcaagtaattctcctgcctcagcctcccaagtagctgggattacaggcacctgccatcatgcccggctaatttttgtatttttagtagagatggggtttcactatgttggtcaggctggtctcaaactcctgaccccaagtgatccagccaccttggcctcccaaagtgctgggattacaggtgtgaaccaccactcctggccatgattgttattttgtattgttttgaaatcaggaagtgtgaatcctccaacttgattcttatttttcatgattgttttgactgttctggatccttgagtttccatgtgaattttaaagttagctcataatttctacctggcagccagctgggcttttgatggggattgccttgactctagatcagtttggagccatcagttttctaagtctttaacttattcaactcgtttaatcttacctaccttggaggtaggtcctacttttatcctcatttcacagaggaggaaactgaggcccagagagcttaaggaccttgtctgaagtcacgcagctggccagtggccaagccagaccttgagccggtggctctggagcccgtggctctggagcccgtgtttgtaaccactgtgctgagctgcctctttccctgggcttgttgtctttgactctgccttccctgaagggtgacattccctggccatgtccctgtggtagggggctgcatctctggcagaccccacaacggcttcacctccttgtgttccaggcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagtaagaccccttccctcccaggtgggctccattttccctccttggctttgatctttcagttgcatcagtcataaccctggggtcatgctgtgtcctgaagtgggctcatagccagatgtctccatttttactttagcttttttgaaaaaaatagagacagggtcttgctttgttggtcaggctggtctcgagctcctgacttcaagcgatcctcctgcctcggcctcccaaagtgctgggattgcagatgtgagccatggtcactgcctagctttactttatgctttacttaattaccatattagtgaagaccacatcgtttgcaagtaacagaaacccactaggctcccctaaaacccaaatggggaggatatggcattgtcttgggaaaccaagagcaaggaaatgccagcagatctcatgaaaaaactgcaaccagggttgggcgcagtggctcatgcctataatcccagcactttgagaggctgaggtgggaagatcacctgaggtcaggaggtcaagaccagcctggccagcatggtaaaaccatctgctaaaaatacaaaaattagccgggcgtggtggtgcacgcctgtaatcccagctactcaggaggctgaggcataaaaattgcttgaacccaggaggcagaggttacagcaagctgattgcatcactgaactcaaaccttggcgacagagcaagactttgtctcaaaaaaaaaaaaaaaaaaaaaaagaataaaaacaacaacaaaaaactgcaaccaggaactggggagtcagaaaggaagttgcctctctcctacctggctctctgctgctctgtgactcaggggctacacatcccttctcttttcctccctacctctttacctcgtgttccctatgcaattcctttgggtgacttgctggtgatgagatatagctagagcaattagtgcacaaccccaaggcagaggcctcttttatgagcagtttgggtcacctgcacagccagatcaccactgtggacttgtttttccatctatgaaattgaagtgatagtgtctagctcatctggctcaggagaaagttgcagtgccaacactgaagctctcttccctgcccccacgtgtcacaagtcattccaggccctctctttgctcctttgcaggttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggtaggggacgctgtgccattggcatgtggcccgacttccacatcccctcctgcagccctgggttactctggggccagcgtggggatttccagcccagcttctggagcagtaggatgagggtagcttccgtgaccttaggtggcagggacagcacgcatcaggcattgtacgttaggaaagctgatttcaagggtgggcgtgtagatgtctttgtgtatcagctgtgagtaattgagtttcttagatggatcagtggcccttgttgtggggaaatccaagtttggatcctcattctgctgttaacattctgtgtttcagcttgttgtcactctttttttttcgtttttttgagaccaggtctcactctctcccccagactggagtgcagtggcatgatattggctcactgcaacttctgcctcctgagttcaagcgattcttctgcctcagcctcctgagtagcggggactacaggcgcctgccaccacgaccggctaatttttgtatttttagtagagacagggtttcgccatgttggccaggctgatcttgaactgctgacctcaggtgatccgcctgcctcagcctcccaaagtgctgggattacaggcatgagccaccgcgcccagcctgttgtcactcttaatttgaactgagcaggtggcacattccttgcatggtaagagtatgtagcaggcatttgtgtacatccaatttcaaaggacctaaattaccttcttgatccctataaatttttttttttttttgtctcgaggtcaaggaaactgcttggctcctaggttaggaagagacagtcttgcaggtacttgatgaactagaggagtgattctcaggcctgtctgtgaattagactcacctggggagcttaaactgatgcaggccaggcactgtagctcatgcctgtaatcccagcagcttgggagaccaaggtgggggaatcactggaggcttggaagttcaataccagcctggtcaatatagcaagaccctggctctgcagaaaatttaaaaaaattagccaggtatggtggtgcgtacctgtagtcccgtctactcaggagattgagttaaaagaatcacttcagccccggagttggaggctgcagtgagtcctgatagcatccctgcattccggcctgtgtgacagaatgagaccctgtctgaaaaaacaaaaaaacttcctgacacctaggttgcaccagaccagtgaaattgcgattgctgtggtggcacccaggtgtcattgtttttgttttttatttatttttatgttttgagacagggtctcgctctgtcacccaggctagagtgcagtggcatgatcttggctcactgcagcctccacctcctgggctcaaacgatcctgccacctcagcccaccacgtagctgggcccagaggcatgcatcaccacgcctgctaatgtcttagtgtttttaaaactcacgaggtgatagtgtgcaatcatgtttgagggctagggacattttcccccaccagggcacgtttggcaatatctgggggcattttcggttgtcccaactgggggcgagggcatgtagtgggtcgaggccaggtattgctgctaaaactcctacagtgcgcaggacagccccccaaagaattatctggctccagatgtcaagaatgccaaggattagagaccctggcccacaccctcagtccttcagtgggatctgggaccagtagcactgacacagcctggaagcgtagaaatgcagaatcccaggccacaccccagacttgcagaatccaaaacaactccccccaccccccaccactccccccagaaaaacccggccgcatgtgtgcacattaaagcatgcgaagccctggtttcgaggacacctagggtcccttgccaactgatgagttcaaggttgggaggcactgagcaccgcggataagaatgtgggctttgagatgacacaggcgtcctgggcagacagataggtcgggaggggaggaggagagatctgcggcatttctgcccctgagagtctccttcctctccgtgggtctggagggagagtcaggcctcttcagctgccacactcacccaccttccctctcctttgtcccacaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctggtgtgtgtttaacgccgtttccctttgcatgcagggagggacttctacgtgtgggcagtgggccgagggagtgggtgttgatggtaatggcatgtagagctccctggcagttccggctgtggttcatattttattttccagcctgttaaccaattcctcagtattttgttcctttcctgaattgtcaggttgatgttctccttggtggcatggcgttttcattttctcttttccttgacagtgtcagtaattaactaccctacaatggacgacacatcatatttctccccttgaatcctcccaaacgctaaccagactcacttattcattagtccctaattatggtggtcaaaattctctcaattgcaagggatataaatctgtcttaaagtagcctaagtggccggttgcagaggctcacgcctgtaatcccagcactttgggaggccgaggcgggcagatcacctgagatcaggagttcgagaccagcctcaacgtggagaaaccccgtctctactaaaaatacaaaatgagctgggcgtggtggtgtatgcctgtaatgccagctacctgggaggctgagacaggagaattgcttgaacctggaaggcggaggttgcggtgagccgagattgggccattgcactccagcctgggcaacaagagtgaaactccaattccaaaaaaaaaaaaaagtagcctaagtaaatagagggaactttggggctgcatgtatctcagaaatctggggactagcttcaggtgtggattgatccaggagatcaagcaatgttgtcagtactcagtttcacccactgccctgttgtcctctgagttaacatcattctcagtggtacttccctacatggctccgtagctttgggctgataacatcctgatagataaaggtgccagagaaaagacaaggcagcatttctctgcacagccagagtcagtctcagagagcactctgattagcctggcttggtcctattcacacccgtgaaccaatcactgtggcccaggaggcagagttctctcattggccagcctgggtcacatgtcctctcccatggcagaagagatgtgattgacagcccttccatgtggagagggagagttcccaaaataaaatgataagcaaagaggctcatagcacaacacatgccttgtgctttgctacctctggatctttgccacgtacctttccttccttcttcctaattgatgaaagcctgctcatcccccaaggctgtaacaaacactacttccattgatttaccctcccttctcaattagatggacttcttcttttgaattttgagtcccaataactttagtataggaactcatctaataatactttctgaaatagttttttttgttttgtttttgttttgacatggagtcgcgctctgttgcccaggctggagtgtggtgtgccatcttggctcgctgcaacctctgcctcccagcttcaagcaattctcctacctcagtctcccgagtagctgggactacaggcttacaccaccacgcccattaaattttcttttttttttgtatttttagtagagacagtgtttgatcatgttggctaggctgatcttgaactcctggcctcaggtgatctaccctctgtggtctcccaaagtgttggaattacaggcgtgagccaccgtgcccagcccactccctgaaatagttttgttttgttttttttgcatgctcagtgtactgcctcctctttgaagggtaacatgttagctacttgcagacatatagcagctgacttttgtgtcttctgtgggtacaaccccagcagggcctgatgcataatgggcacagctcaaattattatctgttattgaaagagaagggctggacgaaatggctcatgcttgtgatctgaacactttgggaggccaaggcgggtggatcatctgaggccaggagagcagcctggccaacatggcaaaaccccgtctctactaaaaatataaacattagtcaggcatggtggtgtatgcctataatctcaactacttgggtggctgaggcaggagaatggcctgaatccgggaggcggaggttgtattgagctgagtttgtaccactgcataccagcttgggcaacagagcgagactctgtctcaaaaaaaagaaaaaggaagaagaaaaaattactggtttatttggctgtagtttggtttttttttgtacatttgtagagcagaaggtgagtaaagtgtttctaataataaaactcagaaaaaacaccagaatttaattgtctaataggctgggtacagatataggtggcatgcgcctgtaatccctgcactttgggaggctgaggtggaaggattgcttgaagccaggagtttgagaccagcctgggcaacatagtgagaccctgtctctacaaaaaaaaaaaaaaaaaaaaaaaattagctgggcatggtggtgcctacctgtggtcccagctaccgtggaggctgaggcaggaggattgcttgagcctaggagtgcagaggctgcagtaagctaggatcacaccactgcactcctacctgggtgacaaggcaagaccctgtctctagaagaaaaaaaaaatctaaataaagtgtcttttcaagcaggtgtcttggggagtccacttttgtaaaagtgctactatgggaaaaatatttttggaacatttgttctagaactgccttcaggattggtttatgaaccgttaagaaaattgtctaacatcacgttttgttttagatggtagttgcttgagctcagcactgttgacacttggggccagacagttctttgttgtgggggctgtcttttttttttgttcttgttattgttttttttgtttttttaagggacagagtcttgctctgttgcccaggctggagtgcagtggtgcgatcatagctcactgcagccttgaattcttggcctcaagcagtcttcccactttgtcatctcatctagctggggactacaggtgcacgccaccatgcctggctaagttatttatttttttgtagaaatgggggtcttgctgtgttgcccaggctggtctcgaacttctaccctcaagctatcttaccactttggcctcccaaagtgatgggattacaggtgtcagtcactgcacctggccacaaggctataagttaatacagcaaaattagcaaggaattaaggcacacatggggcggtgttcaagagaagccaggtgcaggcttccaggagtccccagcagagtcacaggttcactaattctctggcaaccatgatgattatgtgtgtgaaatgttgccaaccagggaagcttggtaggagctcagttcctgggtttgtattaggggcaggtcacataagcagcctttgcttggcacataccaaaagtctagactcccagagggaaagcggtgttcagcataaaccatattgtttgtacaaacagttgaggcacactgagctactctacccaattctgttaatggtggaaaccctgtaagtatgcagacactagccaagggctaaacttgtaagcagccttcaagcaggaaaagcaatcaggtggtcgtgttcacacttttctgcttactaccttattacctttctaaaaatctaagctgggtgtgatggctcgcgcctgtaatcccagctacttgggaggcagaggtgggaaagtcgcttgagcccatgagtttgagaccagcttaggcaacatagtgagaccttgtctctacaaaaaatcaaaaaaatagctgggcatggtggtgtgagtgtagtcacagctacttgggaggctgagttgggaggatcacttgagcccaggagatcgagagcagtttgagtaacatagtgagaccttgtccttacaaaaaaccaaaaaaattagctgggcatggtgatgtgactagtcacagctacttgggaggctgaattgggaggatcgctggagcccaggagttggagaccagcctgggcaatgtagcaagacctaatgcttacctgtagtcccagctactttggaggctgaagtaggaggatcactgatgcaaatagccactgtactgcagcctgggcaacatagcgagacctcatctcctaaaaaaaaaaaaattagaatcctgcagttgtaatttgcaaaactcatgtggccccaagggcttgggagaaaggagcgtggacctgcttattcttcaagggattgggaggacctggagagatgctcaggaatgaaaccacaggctcttaacaccctattgtggggtaaaagtaacacaccttgccctgaacttggtcagcagcatccacgtgggatggatcaaccggggaagctgttacgggccctgttttcttctgtctggtgagtgatgaagagtctcctttccttccttagaatctgggcccttccgtcctggctggagtggcggtgatggtcctcatggtgcccgtcaatgctgtgatggcgatgaagaccaagacgtatcaggtaaggcatgtgtctctgcgggcccccaagccgggccctaggcagaggcctctccatgaggattttagtccagttccttctgctctgtccctggggttctcagccttgcctgccagttggactcacttggggagccttaacaaatgctgatgccccggctgcatatctgggattctgattcacttattgtgggtggggtctggacatcaagatgttttaaagcttcccaggtcattatattgggcagccaagattgagagctcctgacacatggttagaccttgtaggccggtgactggaatcagaaggtctgtgagcctctgagaaagtccttgtttcccacggtcttgtttattatgtgtatgtgtgactcagctttcaagagttgagtacaaattaccccctacttttttcccccttattagctcttaccttataggatacatgctgttaatctctttatttaaattaaaataattaatttctaaaatggggccttgctgtgttgcccaggctggtctcaaactcctgggcttaagtgatcctgttgcctcagcctctcaaagtgttgggattacaggtgtgagccatcatgcccggctttcagctttttatttttggagatattttgtattttaaaaagtttgaatacccaagtaatagagtgatgtttcttattataaaaaagtccaaatcaagccgggctcacccctgtaatttcagcattttgggaggccaaggtgggtggatcgcctgagcttaggagttcaagaccagcctgggaaacatggtgaaacctgtctctaccaaaaatggaaaagttagctgcatgtggtgatgcgtgcctgtagtcccagctacttgggaggctgaagcatgaggatcacctgaacccaggaggtcgaagctgtagtgagccatgattgtgccactgcacaacagagtgagaccctgtctcaaaaaaaaaaaaaaaaaaaaaaaaaaaaaaaaaaaaaaaagtttaaatcgtacaaaagtacataaattaaaaggggatacccccttccctactctctcaaccactgcaaatatatagaagcaaatccttctacaactttctacgtatgtatatacagacctgattaatggtatagtttggtttgtttttatatatgtgggtttttttttttgtttgtggagatggagtctcactttgttgcccaggctagagtgcagtcgtacgatcttggctcactgcaacctctgcctcccgggttcaagtagttctcctgcctcagcctcccgagcagctgggattacaggtgcccaccaccacacccagctaatctttgtatttttagtagagatgaggctttaccacattggccaggctggtcttgaactcctgacctcagatgatccacccgcctcggcctcccaaattgctgggattacaggcatgagccaccatgcctggccattatatatgttttgtgtgtgtgatattattaccatatctgtttttacctaaatgggcccacgtggcagcatgatttttgtcctttagcgccctgctttggggacctctctgtgctgtgccgtatagcttcaattcattcttccaacccggtgccttttggtctataatggagatggtgcagtttatttctttgctcttctgttgatggatatttatggtgtgctgtggaatttcaaatgggagcactaggctgcactgacgataccacagggagatgagtttcaggacatgggcctgttggaaggagaggcctcacgtggtagggttgggtgggatgggtgaggcaggggctttaggattgagtcacccttcagtctcttgatgtgtaggatgccctgagtggcccgactcaacccatttcagtccctggcctccagatcatgtagcttatattcttcccatctgtgacccggggatgactgtagcactaaatgataagagttcttgtgattgttaagtgtctgaatacatgtaaaatgcttagaaaagttgctgggatacacaaaatcctgggtggtagtaaaagtatttaacaactgcactgcacaagtatccactatttggaaccagtgctagccagtacagaaacatttcactattttaacaaccatgggccaggcacaggggctcatgtctgtaatcccagctctttgggagcctgaggcaggaggttggcttgtggccaggagtgcaagaccagcctgagcaacatagcaaggtgccatctctacaagaaatacaaaaatgaactgggtgtggtggcatatgcctgtggtcccagatactaaggaggctgaggtgggaggatcgcttgagcccaggaattcaaggctgcagtgagctatgatcatgccactgcactccagcctggatgccagagtgagatgatgtttccaaaaaaaaagaaaactgggctgacaagaaataagaaaacaggctgggtgcggtggctcacacctgtaatcccagcactctggtaggccgaggttggatcacttgaagtcaggagttcgaaaccagcctggccaacatggtgaagccccgtctctactaaaaatagaaaaattagccaggcgtggtggcaggcgtttatagtcccagctactcaggaggctgaggtaggagaatctctttaacccgggaggcagaggttgcagtgagccaagatcgtgctactgcactccagcctgggcaagagagcgagactccgtcacaaaaaaaaaaagaaaaaatacgaaaacagagaagaaaaacaccaccaccatgtctcctgtgtttgggtcagcagagtagggactgaatcccttcttttctgtacacctgaagggtttttcttgcctctgttcctggattctaaattgagtatgtttctccaatgtctaacctaacgtgatttgaaggggttttttttttcttgatagcggggtcctttggtgtggtcttggggctcaagagtagggctagtagggattacagggtcagctctcccaccctcaggaggcccatttttaatagacggtgaagttgaggcccagtgcggtggctcacacctgtaatcccagcacaggagtttgagaccagcctgggcagcatggtgaaaccccatctctattgaaaagaaaaaaaaaaatcaatataaaaaacatttacatgtcaaagtatataataaagtttatgagaaaaatagctggtgatgttgagtgatgggctgatcccagggtcgccccagatgtgttgactgcccgtctcttccaaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtgagtgaagccacatttttcctggccctcattgtttgatgttttattttctctgcgtacctgaatatttttaaaaggtcactatgttgcccaggtgcagtggctcatgcttggtaatcccagcactctgggaggccaaagcaggtggatcacctgaggtcaggagttcaagaccagcctggccaacatggtgaaacccagtctctactaaaaatacaaaaaaataagccgggtgtggtggcgcatgcctgtagtcccagctactagggaggctgaggcaagagaattacttcaacctgggaggcgacggttggagtgggccaagatcacgccagtgcactccagcctgggcgacagagcaagaccttgtctcaaaaacaaacaaaaaagtcactatgtcagcaaggccttccctgaacacttggtttaaacatttgccatcttctccattctcctttgttttattcacacttagcagcttctagccaacctgtgtaggaaccgttcgttatctatttactgtgatataaggagcttgtgccagaatgtaaaccagtgccccctgcttcctgcattaagatagccttgcaagacaaaaagtgcgagctgagtcgaacggcacgcttggtgccatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttgggagtccaaggtgggtagatcacttgaggccaggagctcgagaccagcctggccaacctggtgaaaccctgttactgcttaaaaaaaaaaaaaaaaaagaaagaaaaaaaaagctgggcatggtggtgcatgcctatattcccagctactcaggaggccgagacatgagaatcccttgaacctgggaggctgaggttgcagtgagccgagatcgagccacggcactccagcctgggcaacacagcaagaccctgtctcaaaaaagtaaaaaaaaaaaaaaataagtaaaataaaatgtacttattttattgtctgcttttcccccactaggatgtcagctccagatgggcatttttgtcgtttctcttgactgctgtatcctcagtatataaaacagtgcatagcaggtgctgaacaaatattgtcatccattgtaaaaaaaaaaaaatacagaaagatataaaatgaaaagtatattgtcctctcttccatcagttcctcccttctaaagtgacagtttcgtgtacgcttttagagaaaaatggacaagcatataggtatttaaaaatactttgacagatataaatggaatcatactgtacatagtgttctcttttctttggttaacaatatatagtcttggttcgttcattctggtctacttcattttagttttttggggggttttgttttgaaatggggtctcgctctgtcccccaggctggagtactgtggtgcgatcatagctcactgcagccttgaactcctgggcccaagcaatcctcctgctttagtttcctaagtagctgggactccaggtgcactgctaccactcccagcttgtttcatttgtgttcatgatggatgcttgtctgacgtgcagatgcgccctgctggaattaccctttctcccattccttgcaaaaacaggttgttccctgttttttttgctgttatgatccatgctacactgaaagttctggtacctgtcctggggtatggtaatgggtctatccctgcctagctggctttgaaaagtttaaagacaacagtgcaacttacaatttgcaaagttggccgcaaatcaggagaccatacagagatggactttggaaattccctttttaagcacagttaaaaacagttaatggtgaaggatgacttcagatcatgccccatgtttgttttttctttctgtctttttattaactgtgtcattctttttgtaatgttgtgctcattacaactattccttcttggtcaggttggcaaattatatgtttttctggcaagtttctgtgaagcagagttaaacatgtttatgaatatgaacttttctgttaaactaccatctgcttcatctttgttgagtttcaggtggaatgtctaaggaagctccagctgtttcagcatttgcgaaagcgtgttcatgctcccactgaattttcttagtcttgccttacttctctcagggtctggaactgcaggagagatggtgttcaaattcaagcctgcatcagaatcacctggagagcttgttattatattttattatttattcatttattgagatgaagtcccagtctgtcacccaggttggattgctatggcactatcttggctcactgcaatctctgcctcccgggttcaagcgattcttccacctcagcctctgagtagctgggattacaggcatgcagcaaccatgctcagctaatttttaaaatatctttagtgtagagatggtgtttcaccatgttggccaggctggtctcgaactcctgacctcaggagatctacccgccttggcctccgaaagtgctgggattacaggcatgagccacagtgctggctgttagcttgttactataaaactcagctttctgggccccacccaaattttcagttttagtaggtctggttggggcctgagtatttgctttcctaacatatccctaggtgctgctgcttctggttcaggttgacatgtagagacaccggagtggatcctcactgcctaaagtctggtccgtggaccagcagccatggcatcacctggtgcttgttaacggtgcagaatttcaggcctcagcccagatccactgaaacggaatctgagttgtaactagttctctaggtggtgtgtatgcacattaaatttcgagagagactggcagaaagtaggagtaaagaaactttttctgtaaatactttcggaattccgggccatacagtctctgtcacaaataccagtctcttccagcgtagtgcaaaaacagccttagataatatggaaatcgatgggtgtggctgtgttcctgtaaaaaagtatttagagacaccaaaatttgaattttatagaatttgcatgtgtcatgtaatattgttttgatttttttaacttttaaaaaatatgaaatctggctgggcgcaggggctcatgcctgtaatctcagcactttgggaggccgaggcgggcgggttgcttgaggctagcagattgagaccagcctagccaacgtggtgaaaccccgtctatactaaaaatacaaaaattagctggaagtggtggtgcgcacctgtggtcatagctactcgggaggctgaggcaggaggatcgcttcaacccaggaggcagaagttgcagtgagccaagatcatgccacacactcctggctgggcaacagagtgagaccctttcctgctgctgcccccccaccccctcccagccccccacaaaaaaaaattagccaggtgtggtggagcatgctggtcatccaagctttttgggaggctgaggtacgggaatcgtttgaacccgggaggcggagatcgcagcgagctgaggtcacgccactgcactctaagcctgggcaacagaacaagactctgtctcaaaaaaaataaaaaaaatgaaatcaatgctgagctcatgggccgtatgtaaacaggtgtgggccaaatgtggacctgagccatccttgttggccagcccctggcttagaggactggaatgttcttctgagaatcaggacacctgccacattctactgccagctcacagtgtgaccccaaagctggtcatctcacctcgctggctctagattttgtcacatggaaaatgaaggggttagattccaagcatgtcaaatactgggccctgtcctccttcctcatgcccacagcagacacccacagtcactcatggggttctttcccactgagttatgttcaagcagccctccaggtgactggtgccagtggcctagagttgagcaagaaatgacatcttgttgcccttctgtaactccatgttccctaagatcacttccagctccaatgcccctgcattctgccttgtacattgcattcttcttacactccaataccttgactttaccggggtgcgttgatgaactctctctttttttgttttttttgggactgagtctcactctgtcacccaggctgaagtgcagtggtgccatctcagctcactgcaacctccatctcccagttcaagcaattctcctgcctcagtcccccgactagctgggattacaaacatgcactaccatgccttgttaattttaatatttttagtagagatgggtttttgtcatgttcgccaggctggtctcgaactcctgacctcaagtgatctacctgccttgatctcccaacgtgctgggattacaagcgtgagccaccgcgcctggactctcctttttttttgagaaggagtcttgctctctcgccaggctggagtgcattggcacgatctcagctcactgcaatctctgcctcttgggttcaagcgattctcctgcctcagcctcctgagtagctgggattacaggcgcctactaccatgcccagctaagttttgtatttttagtagagacggggtttcaccagggttcaagcaattctcctgcctcagcgtccgagtagctgggagtacaggcgcacgccaccatgccaagccaattttttgtatttttagtagagatggggtttagccgtgttggccaggctggtctcaaactcctggcctctagtggtccacccacctcggcctcctaaagtgctgggattacaggtgtgagccgccatgcccggtgggtcttactttataaagtaggaagtaatgtatttgcatatggtgaaacataattaaagctgcaccagatggtattcatacagccggacttcgcacgtggccacctcagcctgctgacattcgccaacaggtcatcctttgtccctgtgttgtagggcctggactgcacattgcaggatgtttcccagcatctgtggcctctacctgccagatgctaagtcgtacctctccctcttcttcccagtggtgacaatagaaaatggctccaggcattgcgaagtgtccccttgggggacagaattctcccagttgagaaccacagtcaatagtgaaaggcccaagcccttcctcctaacaccagtcaccttgcttccctctctccatgtttcttgtgtgtttttccagagtccacgtctgtatcactgtaatggtggatacatgtcatacatgtagttatggttacttgattctgtttactttacttttatacaagtgatagtaagagtcatacataaatacatacaaaatggctttttttttctttttttctttttttttttttttttttgagatggggtctcacactgccgcccaagctggagtgcagtgacatgatcttggctcactgcaacctctgcctcccaggctcaagtaatcctccaacctcagcctcccaggcagctgggactacaagcatgcaccaccatgcccagctaatttctgtaattttgcagagacagggtctcactttgttgcccaggatgttttcaaactcctgagctcgagcagtccgcctgcctctgtctcccaaagtgctgggattgtaggtatgagccactgcacctggccttgatggcattttgaaaggtcttgtctcagaggaaaagatacaagccagagggcgctggtgatgaggtttggtctgtgccttgtgtcccgcttaggaggggatgggcagcgtgttctcacagctttttgctctgcacattggattcgttggcaaaacccacagtttccaggctgtcaccaaactttgcttatcacttcctgccctgttccccattaggaaaccacagcagaagatgcttaagagcaggactggcttttcttctcttttttctttctttctttcttttttaaagagacagggtcttgttttgctgtccaggctggagtacagtggcttgatcacagctcactgcaacctccaactcctgagctaaagcgatcctcctgcttcagcctctggagtagctgggattacagatgtgaaatactgagcccggctaccggctttacttaaccttttcttgagctttcttgccatttagtttcccggagtttccagagacagagtttgttgagctgtttggcaagaaacagatgggcctgggtgtcagctggggagaccttgtcctggccgaggcatcgaagcctctgactacattaggataaaatatgtggcctttagttcccctggaaggtgcctgagtgttttttccactggtgtgcattcctgtgcttcaaagacgatgaggtgtttacccagcggtaggtgtgatggaacacagaggccggggaaggccagggatgccatccagggactgatgggactgtttttctggaatggcaaacctggcatttaccacgtccacctaatgcactttcctaaaatagcatcgccaggcagccgtcaatatttaacattttctgtcttggatgatttgtgagcttcttgccttctgtttaccctgaatctccctttgttagaataattcatcattctctatggtaatgatctgtcctgtagttctctgctgatcatatcctagggcccatggagacactgccacgaccatgtcattttatttatttatatatttatacatttctgtatttttgagacggagtctcattctgccgcccaggctggagtgcagtggcacaatcacagctcactgcaacctccacctcccaggttcagctgattctcctgcctcagcctcccgaagagctgggattacaggtgtgcgccaccacacctggctaattttttgtctttttagtagagatggggtttcaccatgttggccaggctggtctcaaactcctgacctcaagtgatccgcccacctcggcctcccaaagtgctgggattgcaggtgtgagctaccatgcccagtcagaccttgtcattttgtgcttgtaccagcaaagcatagggaccttggcaaatagttcatgctctgtaaatgtatgtaggtaaatgaataaatacatgaatgaatgagaggttgaaataaatcatattaattaggaactgtcttgcaaataacagaaacctagcttaaatcaactagagtaagagaagagggggatttttgagtcacaaaactaaaaagtctagaaaaagacttttaagcatgaatggggttccaggcatggctggatctaggagttcccaagataatgttgggaataacaacgtctctgactctcagctctgctttcttgatggtggtttctttattagctggtagtttcctgatcatcctgtcacctcagcaacccctgtgaacagagagtcttactcttttcccctaatatttcctgcaaagctatgggattgagtctcattggttgtggtcgatcacatgcttcttcctgagccagtcactgaggccagggagataggatgcttgggtcagccagggctaggtcatgtctttcagggcttggggccaaggtagggggtgagggaggaggttcatctgtggctgaagctcataggttgacactgggagaagttcagttcccccagagaaaattgcatgttgccataaacagagtaatagatgccaggtaggcaggaagagcaggtaactgcacacagggcatcaggatttttagggagtgggctggagtgtaggggttccattcattggttttccacgtttctcagaaaaggcacctaggggacaggtgctcctcactgtgtatgaagggcttttgcaccctagaccctcgcctattacaaggcgaactccagtctcctgctgcctggagccccagtcattgtgcccgtcctaccagcctcttcggatttccaaacactgcctgcagggaacctgttaaagcctgtgcttccactagactgtgcgtctcagggttgccaagcccacctcagtccccagcgcatgatgggtgctcagttaccacctgaggggtggatggctagatgacctcctccttctggagaagccaggaccatggacctgaaaggggccgcatgatgttgtcctgtcccctctctgtgtgtgccctgtgctgccagcagccggcatcgattggtacttggctcaccaagggggctggtacgttttggtggtgagatgcctgaggcctggtttgcttcactgctgaagagacacctgtgatgtgctcttctgccctcaggcaaattcacctaccccgtccccacccatttatccactcccacccatccattatctatccagcagacattcactgagcaccatgatctgggctctgtcctaggctctgacaatacagcagtgcatactacaggtaataatctccagtcatggaacattcatttttcacggagagaaacagacaaggaaaaataggcacaataaataaatcctagtgctagagaaagccatcctaagtgctatagaaagaaaagagtcagatctttggaataagggcggcttgcagttttaagtagggtggtccaagctcactgagaaggtgacacttgaggaaagacttgatggaggtaaagaggccaaccagggagtagcaagagcatgtgcaaaggccctggggcattactgtgcccattcataggtgggataaccatggaggctgaaacagtgggagtgaggggagagtgacagatgacgccaaatgaggtacagggaagggactttacaaatcagctgggccttgggatctgagtcagcactttgacttctacactgaaaaataggttgactttggagaggtacttttttaaaaattacttgtttagagatgggggcctcactctgttacccaggctggtgcgggggcacagtaatagctcactgcagcctcgacctcctgggctcaaatgattctcctgcctcagcctccctagtagctaggactacaggtgcatgccactatgcttgacttatttattaatattattgttgttttgagacggagtcttgctctgttgcacacgctggggtgcagtggtgcaatcttggctcactgcaacctccacctcccgggttaaagtgattctcctacttcagcctccctagtagctgggactacaggcacatgccaccacacccggctaatttttgtatttttagtagagacagggttttgccctgtcagacaggctggtcttgaactcctgacttcaggagatccacctgccttggcctcccaacatgctgggattacaggcatgagccattgagcccagccacctggcttattttttaaaaaattttgtagagacacagccttgcttttttgccctggctctgctcgaacttctggcctcaagtgatcctccctcctcggccttgcaaagcatttggattacaggcatgggctaccatgccgatcgaaatgtatttttttaacggaggtataattcaccatttaaaagtgtgcaattcagtggtttttttgtgtgatgtgtggtggtgtgaaggtcacccagtgggttttttgtataaatgataatgacaatcaccactaattccaggacgttttcattaccccaaaaggaagccctgtacctgttaccagttgctccccaaatcttccattccattccaggcaaccagtaatctgctttctgtctgtctctgtttatctactgtggacttttcatataaatggaatcaaacaacaggtggccttttctgactgttttctttttttttgagacgaagtgtctcccttgttgcccacctgaagcgcaatggcatgaccttgcctcactacaacgtttgcctcctaggttcaagcgattctcctgcctcagcctactgagtagctgggattataggcatgcaccaccactcctggctaattgtgtatttttagtagagacggagtttctccatgttggtcaggctggtctggaactcccgacctcaagtgatccgcccgcctcagcctcccgaagtgctgggatttcaggtgtgagccaccccgcctggccatctgactggtttcttagcatgatgttttcaaggtttatccatgttttagcatgtataagaatttcactcctttttatggttgagaagtctatcatgtagatacatgtagaccctttcgagtaaagaatatctctgggctgggcatggtggctcatacctgtaatcccagcattttgggaggccgaggcagacggatcacttgaggccaggagctcaagaccagcctgaccaacatggcgaaaccccatctctactaagaaaaatacaaaaagattagctgggcatggtggtgggcgcctataatcccagctacttggagactgaggcatgagaatcgtttgaccttgggaggcagaggttgcggtgaactgcgatcgcaccactgcactccatcttgtgcaaaagaatgagactgtgtctcaaaaaaaaaaaaagtatctttaggtaagatgccagtgttgcgttaccgcttagaagatgggagccaggatgggtgcagtggctcatgtctgtaatcccagcactttaggtggccgaggcaggcagatggcctgagcccaggtgttcgagaacagcctaggaagcatagggagaccctgtctctacaaaaataaaaaaactagccgggcatggtggtatgcgcctgtagtcctagctactcgggaggctgaggtgggaggaatgcttgagcccgggaggtcgaggctgtggtgagccatgattgcaccactgcacccagggatcatgcgtccctgtcgtttcgagcaccttgcctccctcttgacatcggagcctggaaaatttctgtgccatggctcagcgtcatctgtcttgttaatgtcagagccagaacacgaaccagctctggcttcccgtgggaccgggctctcgcttgtgtgaccacgttaatagattccttggaagaatgatctaaggaatttggaccaaatcttccaacaagaaataaaaacagctgccatctgttgagttttactgtgcttgggccctgtgcaaataaacaccctacataagtgccaacagcccttaaaagcctatcatgacttccattttatagatgagaaaataggggcttgcctggagaggtgaaataactcaaccagggtcccacagcggaaatatggcaaagtgtatggtttttatttttaagctgtatgaccttccaggaagtaacaatgaaatggcagtgctgagaccctgaaaatacatgggccgatggccagatggcagggctatttgggtaaagtgggagagacagctcccttgaatggtgagagggaggagtcaggtggccccctggatggaagatggtttcaggcagaggaaacgtcaggggcaaaggcctggcttggggattgtgcttggtgcttttgaggaatactaagaatgcccctctaggacatctctgagaaagttgatgggagaggccggctctttgggctcccggtcgttgatttatccagttcattcccagagtgtttagtgagcacctgccatgtgccagatactgccccaggtttttccacgagctccagcagctggtcagttgtggccacctggggagggcccaagcgcgtctccagggcctgtcactgctcctaggatgatgactctcactcggggcacagcagtcagcactgggcgttctgcttgcaggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggtacagggggaagctggggcgacttccgagagggggccttggggttctaggccacgaaagcatggaagtgcccccgagcgcagcctctagatcacactcccggtcgggctccatgaggcccggacaaaggctgccatgctttcgtctggtcatgcctgaaagaaagaaaacacatttgacttcttgacagagaactcgcacttgagtatatgaatcaagtttaatgcagcagggctttcccatgctctggaagaatctttccgaaatactctgttctcttcagcctgttcctccgccattcctatcctttttttaaaaaacgtagctcttgtctgacttgattgattttacaacccactgataggtcttgaccacccacgctttgagaaaccccaaccttacagccgggcgcggcggctcatgcctgtattcccaccattttgggaggctgaggcgggtagatcacctgaggtcaagagttcgagaccagcctggccaacatagtgcaacctcatctctactaaaaatacaaaaattagccaggtgtggtggcgggtccctgtaatcccagctactcggaaggctgaggcaggagaattgcttgagcccaggaggaagaggttgcagtgagccaagatcgtgccattgcattccagtctgggtgacacagcaaaaactccgtctcaaaattaaaaaaaaaaaaaagaaaaaccccaaccttacggccgggcatgatggtacatgcctgtaatcccagcactttgggaggccaaggcaggtggatctcttaagcccaggagtttgagactagcctgggcaatatggtaaaaccctgtatgtaaaaaaaaataaaataaaataaaataaaaataaataaataaataaataaataaataaataaataaataaatatgtttgaaaattagccaggcatggtggtgtgcccctgtactcccagcgactcagaaggctggggtgggaggatcagctgagcttgggaagttgaggctgcagtgagtcatagtctcaccactacactccagcctgggtgaagggagtaagaccctgtttttttttgttttttgtttttattttttagaaacaatgtagaccatgtagaatctctaaaattcctgccattgactgtgtaaggaggggtggctttctgttttgtcacacttgggcactactggaagctcctgtcacttttctgcactgttttcacattctttttccgagcattgcgaacatcccttttgaaaactccattttaactacataggcaaatcaaccgtaaaatttggtagtacaaggctgatagcaggctttgtcaaaaacaaaaaaatccattttattatgaaaaatgtcaagtgtacacagaagtagaatagcttaaagtttgtaaactggcattaaaagaaaaagaaaaagaaaaaaaaagccaagcatgatggctcacacctgcaatcccagcattttgggagaccaaggcagacagatcagctgaggtcaggagttcgagaccagcctggccaacatggggaaaccttgtctctactaaaaatacaaaaattagccagatgtattggttggtgcctgtaatcccagctaatctggaggctgagacacgagaatcgcttgaacctgggaggtggaggttgccgaggttgcagtgagccgagattgtgccactgcactccagcctgggcgactgagtgagactcagtctccaagaaaggaaataatacaacatgaaccccgtgtacacatcactcagattcaacatcggcattttttggctgggcgcagtggctcacgcctgtaatcccagcactgtgggaggctgaggtggtaggattgcttcagcccaggagttcaaaatcagcctgggcaatgagacccttaatctacaaaaaataacaaaatgggtgtggggtgcatgcctgcagtgactacatgggaggctgaggcagaaggatcgcttgagcctaggagtttgaggctgcagtgagttatgtttgcaccactgcactccagcctgggcaacagagcaagactctgtctcaaataaagaaaccaaggttgggcgcagtggctcatgcctgtaatcccagcactctgggaggccgaggtgggcggatcatgaggtcaggagatggagaccatcctggctaacacggtgaaaccctgtctctgctaaaaatataaaaaaattagccaggtgtggtggcaggtgcctgtagtcccagctactcggttggctgaggcaggagaatgttgtgaacccgggaggtggagcttgcagtgagccgagattgcgccactgcactccagcctgggtgacagagcgagactccatctcaaaaacgaacaaaaaaacccaaaacattttgccacagttgatttatctcattctttttcagtatccctcccttgtccctctttcccttcatttgtttttaatgctaaactctgctatctatcccttcattctttcctttctttgccgaataattttaaagcaaatctcagaccccttacattctacccacaaatatttcagcatgcatttcttcctacataatgtaataccatcatcatgtctaagcaaactaacaataagtttttacaataatactcagcccatatccaagttttctggaatatctcagaaatgcctgtcccattgggctgtttgaattggctctgttgcatttgctgttacgtttccagagtcccttttccaccaggcctctgcccttttcttcttttatttttatttttatttatttattttttgaaatggagcctcactctgtcacccaggctggagtgcagtggcatgatcttggctcactgcgacctctgccttcccaggttcaagtgattcttctgcctcagcctcccgagtagctgggattgcaggtgcgtgccaccatgccaggctaattttatgtatttttttttttttttttagctgaggcggggtttcaccatgttggccaggctggtctcaaactcctgacctcaagtgatctgcctgccttggcctcccaaagtgctgggattacaggtttgagctaccgtgcccagccattcgcccattttttctgaaataccttttgtgggcttttaaaacaaagcagaaccaaacctgtttctttttttgttttgtttaattctaaagtatacactggttctaagaaatgtgggaccttcagaaataagggagggtgtgtgcccctccacacctggggaaacccttgaaagttaaccttggttggttttgcaaaaatgctttttaaaaataactctcccctgccattgctctctgtacaggcgagtgtctccctcaaacgcctgaggatctttctctcccatgaggagctggaacctgacagcatcgagcgacggcctgtcaaagacggtgtgtgtgtgttcagtcctggcttctggaagtggccgccttcccatctcccactgggtcctccctacttgcatttctttcccttggctgccctcaggtttgactctgcccagccgcttgtctgcgagaccccgggggacaagggttctgcagagcctgcagaagggaagggaagcctggcctcctgggcttctgtcctgtctcacacttcccaggagggtgaacttgcacttgcatttttgttttcttgctgagggtcagcagctgcttgaggcttccccgtgggagtcactttccaaggctttgaccttgattctattctgggctaaatgaggactctggaggctggccagcctccatcacccacaagctgtgtagacttaggtctgagcctcagttttatctagataagggaaacaaaagtacctttctttggctgagtgttacttggatttttttttttttttgagacagggtctcattccatttcccaggctggagtgcagtggtgcagtcacagctgtcactgcagccttgatttcgtgggctcaggtgatcctctgaccttagcctcccaagtagctagaactacaggcacacacagcaccatacttggataatattttggtatgttttgtagagacagggtttcaccatgttgtccaggccggtctcgaactccttagctcaagcaatccacctgcctcagcctcccaaagtgctgggcttataggcatgagccagttctcctggcctttttttttttttcaatattaaattgttttatttggagagacaaggtcttgctttgttcctcaagttggtcttgagctcctgggctcaaggatccctctgcctcagcctcccaaagtgctgggatgacagatgtgagccactgcacctggccatgcatttttattggcaggtttgtttgttttgtagcttgttaatttatcgtttcccagcccatccccctgagccagggatgttgtttgtaaccatctctctaggcacttaataataaatattaggccgggcacagtggctcacgcctgtaatcccagcactttggggagctgaggcaggtggatcacttgaggtcaggagttcgagatcagcctggccaacaaggtgaaaccccgtctctactgaaaatacaaaaattagctggacatggtgttgggcacctgtaatcccaactactcgggaggctgaggcaggagaatcacttgaacccaggaggcggaggttgcagtgagccaagatcgcgccactgcactccagccagggcaaagagtgagacttcatctcaaaaaaaaaaaaaaaaataataataataaatattaatggcactaagtgcagtgacacgttcacttataaagcctctgtcatgcacatgccattccaaggatgtcaatgtcccaacttgtccattactcaccatggtacccctggaggagggtgatggaaacccccattttccagatgaagaaactggtctctgaaacttgcctgagattgcacagctgatcaaaagaagaaccagcattcacacccacagcccatcggtagagtccatgctcttcctggccatagggtgttgcctcactgagatttactgagcacctactatgtgccaagcattgtgagaagtgctctgtgtgcactgcctcatagacaccccatcacagccctctgaagttgattgcatgattgtcagccttattttacagatgaaaaagtgaggcacaggctgggtgcagtggctcctacctataatcctagtactttgggaggccaaggctggaggattgcttgaggccaggagtttgagaccaccttgggtaatgtagtgagacctcgtctctacaaaaattaaattcaccaggcatggtggtgcacctgtagtcctagttacttgagaggctgaggcaggaggattggctgagcccgggagttcaaggctatagtgagctatgatcatgccactgtactccagcctgggtgtcagagtgagaccctgtctcaaaaaacaaacaaacaaaggcacagagaagttaactaacttgcctgtggctacccaggtacgaagtggtagccccaggattcaaacccatacagtctggctccagagtccaatgtcagaagattgaatgtgtgtaaacgtcggttataccgcgtgagctgtgtctggcacctcgcaggcgctcaggtatctttagtggcacctaaaacgtttgacacgtttgacacagcacctggtgcatagaagatgataaacagatcctgggagttgtcacttctctggtctgagcgagatggtctcagcatcttcagctcagccccctggtgtggggttttttatcctgggcgctactgacatctggagacacattgttctttgtggttggggactgtcctgtgcactgtgggatgttgagcagcaaccctggactctacccattagatacagtagtatccatcccaattttggcaaccaaaaatggctccagacattgccagatgtgccttgagggacacagttacctccagttgagaaccgtggcccaagtggatgctggactcttcctcccaacactcctgggctgtggtcatctggtttctgctgtcccagtgtcccacatcccctcacatcataaggcaatgattccatctactctggggtcaaatttctctgctaaccacaggctgaaatttgaggtggccggcggtgggtggggggtggtttcttggtactgaagttgttcacagctcaatgcaagcatcaggaaacccctaggcccctgggtgccgcccgcaccccagcccctccttcctgccctaatagtggcctcctaggtggttggacttcctggaatgtttagcacgctctagccagtgggggcccccttggctgctcccagctcccaagctaaccgttctctgcaacctctctgtctccagtggcttttcttaaattccttaaatagcaactcccagtttcctcattccacgtccactcgtagaagagctgagggagaaagttaatctaggttaaccagcaccttcctctctctctaggttttttgtttttttgatgcatggaggaagttatttcttcatttgacaacttaaacaaaaaatactcctgtattatctccagatggtcttaaggtggctcataattcagagagctgcttttctgttttttctttttctttttttttttttttttgagacagagtttcactctgttgcccaggctggagtgcaatggcacgatcttggctctctgcgacctctgccttggtttcaagcgattctcatgtctcagactcccgagtagctgggactacaggcatgcgctaccacacctggctaatgtttgtatttttagtagagatggggtttcaccacgttggccaggctggtctcgaactcctgacatcaggtgatctgcccgcctcggtctcccgaagtgttgggattacaggcatgagcccctgcgactggcctgcttttgttttaagtgagagacatgaagtaaaaggaaaataacaggaagaagagtaaaagaagacagaggtgctaggagctttagaagtgtggagctggccgggcatggtgtctcatgcctgtaatcccggcactttggaaggccgaggcaagcagatcacttgaggccaagagttcgagaccaggctgagcaacatgtcaagaccccacctctacaaaaaatacaaaaaaaaaattagctgggtgtgatggtgcacatcctgtagtcccagttgctcaggaggctgaagtgggagaatcgcctgcgcctgggagatggaggttgcagtaggccgagatcgcaccactgcgctccagcctgggtgcagaagccagatcctgtctcaggagaagacagaaacatggaaccagttaacgtgggctttgtctccgacactctccccttccctgtgccctcgtaccacacttcctgttccgtatcctctttttttgagtttatcgtgatggatgttttagaaagatccacctgctgtgatgtgctgtgtgtagagtggtgtggctgggggaggaagacagaggacctggggagaagggtgaacgacctccctttgcacctcaaggagggcccagcggtctgatgctggccaccccagtggagagaggtttgcatgtggacgccagctgtttcccactgaccttggccactgctcggccctcccagctggagctgccccgaacctgcctgagaagggccagggcatcgagagcattgagtaattctcatgcggcccccgcctctgcagtcatctcccaagatgatcgtccagatggcgcaaccccatcttacaaggacaaagctgcttgcagtttccttctgctttctgggtctggggctgcctccagaactgcaggttgagtttcttctttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatgggtaagccgggacgtggacacacgtgatggtgtggagagagccacagggcttttgttaaacgtggattcgaattcccaccgtgctccctctctgtgaccttgaacaactcactttgcctttctaagacttagcttacccatctggacaatgggtgcagatacacctgcttaggctgtcgtgagaagcagacacacatgcctagcacagagggttccctgggattgtaagttacagcagccttggacagctagacttagacaatacaggagattcttggcttgcgtaactgggaagttctactttcaggtgcggtgtgatccagggactctgccgtcagaactttcttcatattttctgtgtttcactttctcctggtctgctttatcctcacgcatcctctccccttgtgatggtaaatggtcccaacagctcccactgtgtatcccactgttaggagaactgcctgcttcttattgacccagattgggtcctgtgccctctgtgaggcaatcgctatgccttcagacactgagtgtgctgattggccagtctcagtcaggggctgtgatgctgctgaactccagtgcccctcagctgcccagctcaccctttcttgccagctttctatctggcaccccacaccctacagtccttacctttccaaagcacatgatgtctaggaaattgaccttatccccaggcaacttgtcaagcacctctcattttgttctgaccagaggccttgatcaacagctttttaggcccccttaaggaatccgcaaaacacaggggtgatgggacccttttagaggtttagctcatgcctgggtagccaaatcactgctgtattttatgatgaaggagagaaactctccagagaaaacaatctgtagaaggcctgcattgaaaattcatgggggtactgcatgcttaggaagttcttccttatgtctaacttaaatcctgcctgcttcaattgtagctgttctgtcttgttgagctgcacaactaatctgtatctgtgtccctttcctgacccagtggttttcctgttcagttaccttccccccatgagcccccagaacctttctctaacccttttctctcatcagcctgtaagaatatttcagtctcacgtggacagtggcaggtactgtctcacgtggacagtggcaggtattgtctcactgggcttcctgcccactcaggccccataatcctttcccctcccagcacaggaacaaaaagcctgatgagtgtcaccatgcagcagtgtcataagaatgaaacaatcagtgacagcaacgactatcagcatttccactaatactctgaaatcagaaaggtggcagttaaaaagcacagaatcccagcactttgggaggccaaggtgggcacatcacctgaagtccgaagtctgagaccagcttggccaacatggtgaaaccctgtcactactaaaaataaaaaaactagctgggcatggtggtgcatgcctgtaatcccagcactttgggaggctgaggcgggcagatcactggaggtcagcagttcgagaccagcctggccaatgtggggaaaccccatctgtactaaaaatacaaaaattagctggatgtggtggcgctcgcctgtaatcccagctacttgggaggctgaggcacaagaatcatttgaacctgggaggcacaggtttcagtgagccaagattgagccactgtactccagcctgggccacagagtgagactcttgtctcaaaaaaataaataaatacttaagtaactaaatacagataaataaaaaataaaagcacattccatataagtgagtccagcaaaggtttggatgtgccctcccttccctgggaggatggaaaccctgctctggaggtgccgtcggcagtgggagtggcctggggttgacctgccccattgacagccggtcttactgggtgaatgctgagcttattttattttgctttctgctgttcgttaaaggatgatttcaatagagacatcttcctgaaattcaactcagatttattcatatgcgtttcccttttcaaccctttggtggctcccggctggcagagttcaggtgtcttagcacagcgtccttccagggcatatttcaaggtgctcccaggtctggccactacctacctcagtgccatcgcatccctggttacaccctgtgccttcacccctttacacctttctccggctctccacatgtttctgtgtgtgggacactcctgctttttgtcagagttttttggtttatttattttctgagacagagtctcacgctcttgcccagatcggagtgcagtggcacgatctcagctcactgtaacctccgcctcttgggttcaagtgattcttgtgcctcagcctcctcagtagctgggaccacaggccctgccaccaccacgcctggctaatttttatatttttagtagaaacggggtttcaccatgttggccagactggtctcgagctcctgacctcgtgatccgcctgcgttggcctcccaaagtgctgggattaccagcactggcatgagctaccgtgtccggccccagtttgtcttgaggtgtcctctcctttcagaccttgcgtcatgcccccagtaaagtttctgcctctccgaggggcaaaaactgttccagaagcccactgtgacaggatccctcaggttactccctgcctcacttctctaagggacacctgtcacctgcctcccacctggaggccccctgagacaggtcactgaactgaactcagcagtagaaatggaaggaatgttgaggccttcagtgtttagtacagtcttgccttctgtctttctctttctctacttggggtaaattgaggctcggtggccatgggcattagcccggcaggcctcattcagcgtggctgagccaggtgtgttgtgtcgtttcagcatcaccttctccatccccgaaggtgctttggtggccgtggtgggccaggtgggctgcggaaagtcgtccctgctctcagccctcttggctgagatggacaaagtggaggggcacgtggctatcaaggtaggatgaggaccagcggggaggggcagtggggaagctggtggtctgaggaaaagctcagaaatgatggtgtttcttttgactgtccctgtgccagaagcgaaagcagcaacgtctcttttcctcctcctcctgtatctttccactgtctctttctctctcgttctttctgttctgttccgtgctgtcctagaaggcaggattttggtatcatttatttccatctgtctcccagcacttaaaatagtgcccagtatatagtaggcacttaataaatatttattttgttacctctttattaagctgttattttattattattattatcattattattgtgtttttttttttttgagacagggtcaggctctgtcccgcaggctggagtgaagtggcgtgatctcggctcactgcagcctctgcctcctgggtccaagcgattctccctcagcctcccgagtagctaggattacaggcatgcgccaccatgtccagctaatttttatatttttttagtagagacggtgttttaccatgttggccaggctggtctcaaactcctgacctcaagtgatctgcacacctctgtctcccaaagtgctgggattgcaggtgtgagccaccgcatttggccacttaagaaatacttagtagacacacgaagactccctggtacgcagcctgtgtctccttcccttgcgtctctgcctgtcactgagtgtctcttggtctgtttgggtctttttggattgttctttatctttatggatctctgagtatctattcttataaatgtaacaaaacaaaaatgtttatgtggttggaatattttcttagaacattttttaaagggaacagtttaaatttttagtgttgaattcttaatatggagctaaaagaagactgcagttttactgcttttaaatacacagtgtactttgaagtaagttgaaattccccaggagtgagcttaagaggctcctttacaaataatccccactggaaatcaacagcctttgtttgcatttagttcactccccatgaaggccttttcctagtgtaacgacacgtccctggaagttttgctaccagcatttccaggagtgtggtctgcagccagctcatcttgcaggacatttgggcgataaagaaccccaggctcaaagaagcgtgggaaataatgcatactccagccccctccctcttggagacttacagtaaacattagcaaattaaaggctctgacaagtcctgcaaggagaaaaaatctattaactgtttaaccttatgtgtcccaggtgtacttgtccgcacctctttagtgtctgtgcaactgcacatttgtctcttggaatctgcctttgggaatgtcaagtttatgacgttgtttgttgttgtgggttttgagacagagttttttttgttgcccaggctggagtgcagtcgtgtgatcttgactcactgcaacctctgcctcctgggttcaaccgattcttctgtctcagcctcttgagtagctgggattataggcacccaccattactgcacccggctaatttttgtattttcagtaaagacgggattttaccatgttgacctgggtagtctagaactcctaacctcaggtgatctccccatctcggcttcccaaagtgctgggattacaggcgtgagccaccgctcctggcctagttaatgacattgtttttatttcagagcaaaaccctttctttgattatacagtgcctttagaaagtatacattgtggttgggtccaaattaatgacctttagctgttgttttaagaaatgttttatcattactttcaagttcctgccataaaataagatgaatgaaccatgagagctagattaatggaagaaaattccaaatcccgatgggatccacattgctttctgtttccttaaccccagctttctgctatcctggcactattagcatttcaggccagatgattatttattattggttgtttggcctaggtaaggggagtgctagaaatgtatataaaatatttatcttttcccaaatgttttagttggtgtggtttgtgtatattatgtctgaaatttctgtgggttctatggtaaggcaccactgttgacattttggctttttaaaagttaggatattcaagtcagcaggttaattatttgagaatttagagtaagaatgagggtacctgggacctgctgtcagctttgccctctctagaattcccttattcaagaatcttctggctgggcgcggtggctcacatctgtaatcccagcactttgggaggctgaggcaggttgatcacctgaggtcaggagtttgagaccagcctgaccagcatggcgaaaccccgtctctactgaaaatacaaaaattagtgggcctggtggtgtgtgcctttagtcccagctactcaggaggctgaggaaggagaatcccttgagcccggaggcagagactgcagtgagctgagatcttgacactgtattccagcctgagcgacagcaaggcttcgtttcaaaaaaaaatcttcaggggctccccttgcccctctgataaagcccatgctccccaccaagtataggcccccttgctgtccctggtgtgttttctgccagtcgttccctcacaggattgatcgatgttcctgtcacgctggcctttctgttccttgaatgtgccaagtacttttcacttccaggccttcgcatgtgctgttccctcggacttgaatgctcttccctcttctcctcatgaaactgactcattcttcactttttggttcttgtctaaacatatgtttgagctgagcatgatggctcatgcctataatcccagcacttcaggaggccaaggcaggaggattgcttgaggccaggagtttgagaccaggcttagcaacatggcaagattttgtttctacaaacgtaataaatatatagagaattaactacctcagcattttcattagcaaaatacacaaaacaaatatccttactctagcctttattctcatgctgtttgtgatacctgacatatggaaataaaaataagcctttgaaatggatgcttgatataggagtctttgcttcaatttttagcaaggatatttcctcaaagatccttcccggatgtcccaaactaggtcagtcttttaatttttttgagacaggatcttgctctgtggtccaggctggagtgcagtggcacggtgcaatctcagctcgtggtacctccatttcctgggctcaggtgatcctcccacctcagcctcccaagtagctgggactacagatgcacagcgccatgcctggctaatttttctattttttttagagatgggatttctctatgttgtccaggctggctttgaactcctgacctcaagcagtctgcctgccttggcctcccaaagtgctgggattacaggcatgagccactgcgcctagtcaagttagactcttaaaaagtgtcatatatctttttatctttgcgtccaccgtaactgtaatcaagtagttttccgtcacctgagggacttccactctttggaagcaggggttttgatcaccgctgtaggcattgagttaatagctagctactaagtaaataactgtaatcttatcaacgaggatatcaactctttgactcctgatattggagtcagtgattcacctgctgtgggttctgatcccagccctggcatctgttgtcctttgtgagtcagtttccctcttgccaaagcaatagttgtgatgaaaatgacttgtgaagtgaggccctcctagcaggcgggtgggccagctgttgtctcgttgatcagatctgtctgtgtgtctgtctcacctcgttctccatttgcaacttagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaaggtcagtataggttggatgttggcccctgaatcagtcagctgttgccgcgtaacaaatgctctcacaatctcagtgggctgtgagtctgctgctatcagctgacccggcagggctcagctgggcggctctgctgcacgctgcaggccagctgaacttgggtccaggctgtgggtgtggctcaggtctcacttacagagcttttgctggggaccggggtgaggggtccacagctttccaaaggggggctcttctcatggtggcagcagaggcccaagataggccccccagaaagcatgcaatgtcccttaaagtacactgtcccttctactcacaaagcaagtcacttggccaagctcaaaggcaagggaccaagaaggaagtacattctacctttgtggtcacatgactgcagagtcacatgacagagggcatgctgttgggaggaggggagtcgatgattcatatgttcacagtccctgtcaagatagccataatactgaaaatagcacaatagctaacacttactgagcattttctctttcttttctttctttctttttatttatttatttatttttgagatggagtcttgctctcttgcccaggctggagtgcagtggcacgatctcagctcactgcaacctctgcctcccgcgttcaggtgattctcctgcctcagcttcctgaggggctggaattacaggtgcatatcaccacactcggctaatttttgtatttttagtcgaggcagggtttcaccatgttggccaggttggtgtctaactcctgacctcaagtgatccgctggcctcagcctctcaaagttcttttttttttttgaaatggagtctctctctgtcgcccaggctagagtgtagtggctcactcttggctcattgcaacctctgcctcctgagttcaagtgattctcctccctcagcctcttgaatagctgggactacaggcccctgccaccacgcacagctaatttttgtatttttattcgaggcagggtttcaccatgttggccaggttggtgtctaactcctgacctcaagtgatcggctggcctcagcctctcaaagttctttttttttttttgaaatggagtctctctctgtcgcccaggctagagtgtagtggctcactcttggttcaacctctgcctcctgagttcaagtgattctcctccctcagcctcttgaatagctgggactacaggcccctgccaccacgcacagctaatttctgtatttttagtagagatgggatttcgctgtgttggccatgctgatcttgaactcctggcctcaggtgatctgcccgcctctgcctctcacaatgctgggattacagatgttaaccacctcgcccggcctataacttgagtattttctgtatgttgggaactatgctaaacattttacacgtaattcttccccacagcaagcccatgggtggaatttgttgttatacctaggtaatcattgaggaaaaaggaggcacagagaggccaagtgacttacctgaggccacacagccacagagctgcagagagcatggttcctgtgtccatgttgttacctgctcattttgtcatctctaaaagggccattctctgcctctcaccactgcagaccctccctcctgctgtgctccatctcccaggttttcctgctgcttcacagcaacccccagcccctgcccacctccacaccttggtctgagccttcaaggcctggggtgcctcccctgctgcttgcctggccactttgctctggcaccccatggtggtcgtctggtgtgtcccctcttggaagaccaagagtgcaaagcactggcccatttctgtttttagttacaagccaggggctctgtcggctttcttacgtggtgaatgatgtttaaaaattgagataagcctgcagctccttggaaataaaaaacgaattattggctgggcgcggtagctcacgcctataatcccagcactttgggagaccaaggtgggaggattgtctgaggtcaggagttcgagaccagcctgggcaacatggtgaaaacccacctctactaaaaatacaaaaagttgccaggcatggtgccgtgcacctgtggtcccagccacttagggggctgaggtgagaggattgcttgaacctgggaagcggagattacagtgagctgagattgtgccactgcactccagcctgggcgacagagtgagattctgtctccaaaaacaaaaagaaggcacgtggctgccaggaccccacctcagtgcatgggagtcagggcaggcatctcaggagggactgggcagtaacctgtgatttccagccaaatagggaaacgacgttggcttatctgtcatggtgggagctggcgctgctgctggtccatgcattgtccttcctcctggtgactgggatgtgggctggatttcagcatccccaggccggagccttgcttcacctatatgtggctttgccagacagtgacagatccagagtaagctggcaaacatggcagctgtcaccaacagcagcagtaacaataatatgaccacgtccaccagcgccttccatgagactaagggatcacggccttcccactggtcaacatgatttggtgccgtcagccatcctttgctgagcacttgctgtgcaccacgtgccctgctcagcacctcacgggagattcaggttttctcttttgcccagttgacaggtggggctaaaccctgtgcctgtgatcccatccttggtggtggtggagctggggcctggctccaggtttgtgcaggcgtgacctcatgccttcagcatcaaacttaaagaagaggaggtgggtgcagctctgcagggccttcacccaggacctgctgtgtcctgagcaggctctatgcctttctttctttcttgtttaaagagacagggtctcattctgtcgcccaggctggagtgcagtggcccagccatagctcgttgcagcctggaactcctgggctcaagccatcttcccactcagcctcctgaatagctggaactacaggcgcacatcagcaggcttggctaattttttcttttcttttcttttctttttttgtagagacagggtctccctatattgctcaggctggtctcaaacccctggtctcaagcagtccttccaccttggcctcccaaagttctgggatcacaccacactcggcctgcttctacgtattgtgagtctcaagatttcccaggaaacccactcctgtgtgtgtctctccccagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaaggtgcctgctggcggggtggggcttggtgttgggccgtctcgccctttggttaagtcagaacgtgtcccctttaggagtcctttactttctctggctttctttgtttttaattggactttaaagaacacatttctcatgcttgtcttggaagccttcctaagacagccgtcttgtacttgtctttataggggtaagtcctccgcgcagagttaaattcattgcctctccatggccaagggaggcctctcttcctgattaagtcacagggctggcttcttagcggggaatcccactccaagacattgcctgtgacctagcaggctgcattttcttacttgcagaggtgtctgtgggtagaggggtcggaaaattgccacaacaccttaacataataggaaatagttcctgtgttctttttatagggcagttgtggtaatgggtacacactggctcttttttttctccccctgattttatttttttgaggtggagtttcgctactgttgcccaggctggagtgcagtggcatgatctcagctcactgcaacctccgcatctcgggttcaagcacttctcctgctttggcctcccaagtagctgggattacaggtgcccaccaccacgcctggctaattttttttatttttagtagaatcgaggtttcaccatgttggtcaggctggtctcgaactcctgacctcaagtgatctgcccgcctgggtctcctgcaatgctgggattacaggcgtgagccaccacacccggctgtttctgctgattttaaaactaacacatccccatggggggcatatagattaagaaaaacatgaaaaagaaaaatggaagcagttacacacattccactggttagaggttttgtatttttttcaagtctttttgctctgtgtataaactttttaaatagggttatcttgttccacgtatatatacaggaaacatcgtgctacatgacctcttgtaatcgttcccatacataccactaacattctgtgtaaacatattttaaaatagtacaaaacatttttgaaaattactaagtaatacatgcccattgtaacaaaattgaaaagtacaagaatatggatatcttcttataatatatgtgtgtatgcgtgtgtgtgtgtgtgtgtgtgtgtgtgcatgtatataaagtaaataaagctgggcacggtgagtaatcccaacacttttggaggcctagaccagtggatcacctgaggtcaggagttcgagaccagcctggccaacatggtgaaaccccatctctactaaaaatacaaaaatcagccgagtgtggtgatgcatggctgtaatcccagctactcgggaagctgaggccggagaatgtcttgaacccgggacgtggaggttgcagtgagctgagattgcgccactgcactctagcctgggtaacagagcgagactccgtctcagaaaatatatctaaataaagtaaataaaatagtccctcttcatcctgcatccctaatctttaattcttctcttagagagcaagggttagcaaatctggcccactgcctgctttttatatggctcttgagctaagaatgatgtgtgtatttttaaatagaagaaatctaaacaggaagaatattttatgacatttgaaaatcgtattaaatttagatatcagtgtccataaataaaactttattggaacatggccaatgtattttttttctttttttttctgcagacagggttttcctctgttgtccaggctggagtgcagtgccacagtcatggcatggtagcctccagctcctcggctgaatcaatcctcctgccttctgagtagctcctgggaccacaggcatgcagcaccatgcctggctaatttatttttatttttattttgtggagacaggtctcactatgtttcccaggctggtttcaaactcttggcctcaaggaatcctcccgttttggcctcccaaagtgctgggattacaggtgtgagccaccgcacgtgtcctgttctttaaagcatcgtctacagctgcttcaactcggcagggctgagttggtgccatggcaactgtaagatccataaagctgaaaagattgaccgttagctgtttaaggaaacatatgctgacttctattaatagtttgatgaatgtcttcccaaactttcagatttgcagataaaatgtatgcatgtgcatattttgtagtggttttgggggtggctgacagcgggagttgttttagaaaaaaattaagccagagctgggcacggtagcgcatgcctgtagtcccagcacttttgtaagccaagggcgaatggatcgcttcagttcaggagttcaagatgagcctggacaacatgatgagacccctgtcttgacaaaaaatacaaaaattatctgggcatggtggcacgtatctgtagtcccagctacttgggaggctgaggcaggagaatcgcttgaacccaggaagcataggttgtggtgagccgaggtcgcaccactgcactccagcctgggcgacagagcgagaccctatctcaaaaagaaaaaaaaaaaagaagaaaaaaattaagccattgggctgggcgcagcggctcacacctgtaatcctaaaactttgggaggccaagataggcagattgcctgaggtcaggagtttgagaccagcctgggcaacatggtgaaacgccatctctactaaaatacaacaacaaaaaaatcagccaggtgtggtggcgggcgcatgtaatcccagctacgcgggagggaggctgaggcacgggaattgcttgaacccgggaggcggaggttgcagtgagccgagactgtgccactgcactccagcctggacaacaaagtgaaactctgtctcaaaaaaaaaaaaaaaagccattgcatacaaactgttttgctgtggcaccatccttttattcctttacacacttgtatggttccctccctacctcttgtcattcaggtttttgttaaaaaataaccttccccattacctttgttaaaattgcaaaacccgcacacttggtacacccgttcccctttttgctgtgtttttgccattcagcaagcactattctactagtgttcgtttctcctgcggccctggaatctggggcaggggtctttgtttccttccccttccccagcttttagctcagcacctgaggcgtggcaggccctttgcacatgcatgttacaggaccgtgtgcacaggttcagctgctcctggatgctgttatcgcgggtgcatgtcccaccttcagacctgagttttgcccaccaggtgttcgtcggctcattcctcctttagtcttcactctgccaagctaggcagtctcacacatgtgcactcacgtggccgggtgtcccctttgcccacagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggtaggggcagccccagggttccacccactcagggtgtctggcaccttgaagggccacattggcctctttgaggttgccaccagccacttggggaaggcggctcctcagggcatgagggtgggagctggatggagccccctaaagaagcaatgtggaaaaccaccttagtccctgcagtgctgaactgggagagagtctcggtgctttatggccaggggatgggagcaccaggcttcagctcagctgacctcagggcagggtctagcgccttcctggaacatgaccttggacctgatgagtttcagggtccttatggcaaaaatgggaatgatggtaattaaagtcctggctctcggggctgagagaaactgaggacatacgtgacacaagagatgtgagggttgtgaggtgaagcacggagttaagctggcaggctcgggttggtgacgtctgggttcaatccccggccgctcatctccccagctatgtgacctgaggcctgcccttcagacccatctgagcttcactttcctccctcataaagcagttcagcagggccagacgtggtggttcccagcacttgtaatcccaacacatagagaggctgaggtgggaggatcgctccagctcaggagtttgagaccatcctcagtagcatggcgaaacctcatctctacaaaaaatacaaaaaatttgccaggcacagtggctcacgcctgtaatcccagcactttgggaggccgtggtgggtggatcccttgaagccaggaggaattcaagaccagcctggccaacatactgaaaccccaactctacaaaaaaaaaaaaaaaaaaattcagatgctattaagtgctttggaggggaaacaaaaaagacaatgccatgggctgaggagtgatgggtgtcattgtggcaactcaggcaggggatagggaaaccctctctggggaggttgcattggcatgggaaggagccagcagggagaagatctgggaagtgttgtgggcagagggaacagccagtacaaaggcctcaggaccagcatgagctcaatttgtttacaaaacaaaaagggtggtgtggccagaccatggtgtgccaggacgtggggggcaggagaagaggtcagcacagtgattgtcctgcagggccttccaggtgggttttggtctaactgccctgggaagccactgagtgtcagagaggcaaagtgaccagccccaggatacacagcagctgctggcagggttggttctcaagttggtctctgagtttctcatcctttgcctggggtgggagctccttctctgcagaggtcctagtgatctctaataagtgctttcttgagatgtaattcacacacgtaggctgggcgcagtggctcacgcctgtaatcccagcactgtgggaggctgacacaggtggatcacctgaggtcaggagttggagaccagcctggccaacatgatgaaaccctgtctctactaaaaatacaaaaattatcctggcgtggtggcgcacgcctataggcccagctactggggaggctgaggcaggagaatagtttgaaccttggaggcggaggttgcagtgaaccgagatcgtgccactacactccagcttgggcaacagagcaagacttcgtctcagaaaaacaaaacaaaacaaaacaaaaattcatacaacatacaattaacccacttaaatcacaaaatccaaccatcaccacagtcaggtttagaactttttttaatcacccccaaaagaaaccccaatccatcagccatgactccctattttccccagcacctccgaagccctaggcaaccactaatctttctgtctctctagatttgcttattctggacatttcatataaatgccatcacaataggtggaatgttgtgactggcggcttttacacttagcgtggtgttttcaaggttcgtctatgttgtagcttcatttccttttattgcggaataatatgccattgtgcagatagaccatactgtgttgatctgttcactggttgatggacattcaggttttttccactttctgactcttgtgaatactgctgtcatgagccctggtggttttaaaggaaaagttggtggccgggtgtggtggtttgtgcctgtaatcccaccactttgggaggccaaggcgggtggatcacttgaggttaggagttcaagaccagcctgggcagcatggtgaaacctcgtctctactgaaagtacaaacattagctgggatggtggtgcacacctgtagtcccggctattcgggaggctgaggtgggggaatcgcttgagcctgggagtcaggctgctgtgagccaaaatcatgccactgcactccatctggcctgggtgacagagcaagaccatgtctcaaaatacagttggatttttgtttcttgccagtgcatgatagctgacattcccttcagcttttaaattatttgattagactgaatttctgcatgttcattcccttgtggttgggaagttctaccttgagtctagcctgtttcttcttgctgcagaatccccctttgtctatctctcagcccgagcaatgcattgtggcaacttctcggtgactttttcactgacctgcttggcaggctacttttaggtgacaataccctttgtgctctctaaatcaaaatgtgtgggtttagctgaatcttttgcccagcgtgaggtctgtctctctacccttccgtccaggtgagcaaaaaatgtccttaaactctcttggccccagataggttccgcacccccgcctttctttcccagctgctagagtatccaagcagtgtatacagaacatggaaggctgccagatgctttgtgatttttgtacacatcagcacttaatttggtgatgcaaatgccgcccaccaccctggcacctcgtgcgttcattttcccagtttgacctccctacctcctgcctttgaggttacatagaagtccttggcagtgggtcttacatcaaactggggcacccccctctctcaccacccacccttttccattgctctggaggggccctggctataaagtcttgacatcagggtctggtcttgcccagccttagccaactcgaagcgccaatgaccttgggtttgtttaaaccacatttttggctcttcctaaaggggaacttttttccttgttggattaatcagctcttttttttagaacacccaggctgaaggggtgcaggtgttggtatttggtttgggagaatccttgaggggggatgggcaggaaccaggcttgtgaatggggccataccgacctctctcccgggatattcagtttactgatttctaagaaatatatcttttttactgtttgtctccctctctccttttttttttttttttttttttaacttttaatggcattccttttattcctaatttattcccatgccataagcttttgtttcttcaatttcttctgggatatatttttcttctgtgcagcctccccttccggtttaggaacagtttgttccctttcaggcaggatcatctggatgtggcagagtgagctcacgtatgggttaatccgaccgaccctgagctctgtaggtccggcgacgcaacttaggtgctttcttcagttggatatgctcaaggaccagagaatctgcatctgaacccttaagttcagtgtgactctctgtatttttaagcatgtgcagcagaaattcagtgctctttttgggccgccgaccttgtggccagccccacttcttggcctgggtacatctaccaactccaccattataatgtcagaatggtacatgttgtttctgtaaagtggcatctttctgatactttgtggccttttgtacgtgcatacctttgatggcctgggcgctttcaggagtgttctttttctttttcttttttttgagacggagtcttgctctgtcgcccaggctggagtgcagtggcgcgatcttggctccctgcaagctctgccgcccaggttcacgccattctcctgcctcagcctcccgagtagctgggactacaggcgcccgccaccatgcccagctaattttttttgtatttttagtagaaacggggtttcaccgtgttagtcaggatggtctcgatctcttgacgtcatgatccgcccgcctcggcctcccaaagtgctgggattacaggcgtgagccactgcgcctggccttttttttttttttttttttttgatacagagtctcacttgttgcccaggctggagtgtagtggcacgatcttggctcactgcagcctccacctcccgggttcaagaaattcttgtgcctcagcctctcgagtagctggagttacaggcatgtgccaccacgcccagctaatttttgtatttttagtagagatggggtttcaccatgctgaccaggctggtctcaaactcctggcctcaagggatcctcctgcctcagcctcccaaagtgttgggataacaggcatgagccaccatgcccggcctcacaaatgttcttaaggtgaacacgaagatttgaacctcttgatctgcatgattctgtggtgttttctggataaagtgaatagtgaaccattttcacagattgcctcaagccccttaggggaacaaatttttaagggatttaaaaaaatggctcattaaccttcatacctggaaggtaaaacacatcttcatgactctggtttctttcttaggaacctaatacctagagcagtggttttccatcaggggcaaattgcccccaccctggggacagttggcaatgtttggagacatgttgggatgtcaaaactggagtggggtttgcccctggcaggcaagcagggtagaggccagcgatgtcgctaaacatcctacagcactcaagacgaattcccccttaccctgccccccgtgacagggaatccccttgccaggacatccaaagcaccacgagcaagaaaccctgtgtgctccgacttcacactgctgaattcttcccttgtcctcttgggagaaggatctttattccaacaatgtggccatttttctcttttaaaaaattttatttatatatttttatgtttttttatggagatgggatatcagtctgttgcccaggctggtctcgaactcctgggctcaagcgatcctcccaccttgacctcccaaaatgcaaatgctgggattataagcatgagtcgcggcacctggcccgtggccatttttcaaaaccttgcttgaaccatctgttaacctcatggcaaatatttttccctcttaagtatttaccgagtttttcttaatgattataaaagcaacatgtgctcatcgtagacatttgcaaactacaaaagagtacaaagaatcaggaaaaaaggtggctcatatgtgtaatgccaggactttgggaggccaaggtaggcggatcacctgagggcaggagttcgagaccagcctcgccaacatggtgaaaccccatctctactaaaaatacagaaatgtcaggaggctgaggcaggagaatagcgtgaatccggggggcagagcttgcagtgagccaagattgtgccactgcactctagcctgggtaacagagcgagactgtctcaaaaaaaaaacaaaaaaacaaaaaaaaactcccgagaaagaacatctttctgccctcactgcccagaaggggagctgttgttagctttggcatctttttcacctgtccttccttcctaggccttctcccttgacaagattgagagtatatcttagagttttctcatctcctgccaccttttgatttcttttcttaacagtgggccataagcacctccccaagttacacaaattagttgtcagcacagagcagctgccgagagagttcatcagacagacccccacattccttctggctgtcctcagaggccggatttcttcctcttttgaggatgaagagctttctctgccgaggctgggggaggaggtcagtgaggcagccagtgaatgccgtttttggtcaaaaatgaggcgttgactataaagctgtgagttgaattcttccctccggggaggctggcctgctggaccttgcccaagcagagttccagaaccttcttgagtaaaggcagtgttggtggaataaacagtgagaggactggcaacggaatacacagacccggggcagcacttaacgtacgtgggtcaagggtagaaacagcacctggcttgacagcatccaaaacccaacacctggtggttgcatgaactcagtgacagtcactgaattacaagtttcgtgtgtttgctttaaaaaaaaaaagaaagaactcttgctactttatagcattctccaccctggcccccagccttcatgtccctcttcttccctgctttgattactttgtggcacttattgctgcctggagtaaattatggatctacttgttcatttattgttgatctcttcctttggaatttaagatctgagggttttgtttgtttgttttgttttgttttgtttgttttgggagtctcacgctgttgcccaggctggagtgcaatggtgcaatctcggctcactgcaacctccacctcctgggtccaagtgattctcctgccgcaacctcccaagtagctgggattacggatgcctgccaccacgcccggctaatttttgtatttttagtagagacggcgttgtgccacattggtcaggctggtcttgaactccggacctcaagtgatccacccgcctcagcctcccaaagtgctgggattacaggcatgagccatcgtgcccggctgctctgagggctttttggttgtctctccatccccaggactaagaaaagagcctgacacatagtagacactcagtaaatgtgttaaatgagtggatgaatcgcaccttggctgttcaaggcatgtcctgcataagcagtgggtaggccggagggctttggatgtttacactgcagataaatacctcagactaggagaaaataggagtggatttcaccccctctcaggtctgctttagaaagcagctttgtcagtcctgcctatgagaggggcccctctggcattgggaagtcagctctgcttcttgacttgactatacacttgtcagtctgcccatctgtctgtcgggtgtgtacagagtgcctgctgtgtgccacaaggccacctggtacgtgagcctctgtgtggaatggtgccccccacgttgagttgtgcagtgtgcatcttgtgtaactgcacttggccacctgctgtgccaggtgctggtgatacagtaatggatatgacccacttcatgcccttgagagctcacagtctgatgggagagacaaacgccaaacaattaagggtatcatagtgctaaatgcagtgatggagggctgcttgagggcctgggaaatcacagagaaggagcccccatcccagcctgggagggtccagggtgatatctgggctaagtcaccttttcttctcctcttgggcacatgtgcatctggctctgtgtggggccagcccctctcaggagcagtgtctgtcctcaaaggggctggagctgatgcccatgccacctcccagtgtcatgcctggcctgcctactgtaatactttatttcttttcctctcctgcgtaaaaacaagcctgaagactgaaggttggtctgcattatttgtttagctctatttatggttaaacacagttatgactttggccaggcatggtggctcacgcctgtaatcctagcactttgggaggccaaggcaggtgtatcagctgaggtcaggagtttgagaccagcctggccaacatggcaaaaccccgtctctactaaaaatacgaaaattagccaggtgtggtggcgggcacctgtaatcccagctatttgggaggctgaggctggagaattgcttgaacctgggtggcggaggttgcggtgagctaagatcacgccacttccctccagcctgggctaaagagtgaaactctgtcacaaacaaacaaacaaaaacccaacacagttatgactttggagaaaggggttggtcttgtgcagtgtgcttgtcccggatccacccagcacgtgtgggatggggaaactgacgcacaaatggagcagacccttcagccattcttgcctctccccctttagaaaagacactcccttcactcctttatttagataggggcttagggcgggagtttcgctttgcttcttaacaatatcttgggtcttctgaattcccaggcagcacagtgatggacgaggaggaagcaggtcagtactgcccgggttggagttggcttggctcatagaatgaggccagagacgggccgagactgtcgctgcatgtctggggaggtgccgtcagatgtctgtgttttcacccctccggttgttcattggttcatttagcacacatttactgggtacctactgtgtgtctggctttgaggctggcactgggggatacagcctgagtccccagatccctttattgtcactgatgaccttgggtaagctctactgtttcatgcatcacgttaccgtgaccagcatgccttgaggggaccatgcttatgaagtgcctggcacacagtggatggacaataaatggcaacagtttgattgtgagctgccacgcatagatcctggggcacagtcaagacacacatgggcccagacaatgcagggtgatcagcgcctgttggggaactgcagcaggtggtggtggggaccctgaagagggatgtcgcctagtggaattccagtggccagactggacccatccctcctgccttctgcagtgtgtggcttagggtcccagccaagggctttttttgtaagcagcagaagctgaatctggccaccttaaacaaacagagggtgtttcctggaaggataccaggtaactcatgaatcaaaggcagaactgagcaagtaggactcaggaaatgggaactctgggagactagactcttttaggacaggtgaacttgaactgtctttggtccttgtagaccactgatgacggttcaaatcctgggagaggggcttttatggggcgacctcagacagtgcccaccttggctgggggaatctgaggcaccctgattgacaggcccaccaaggctgtaggaagagggagagctgatcccttcaaaaagccaacagggggccaggcacagtggctcacacctgtaatcccagcactctgggaggccgaggtgggtggatcacctgaggtcaggggtttgagaccagcctggccaacatggtgaaaccccgtctctactagaaatacaaaagaattagccaggcacggtggtgcatgcctgtaatcccagcttcctgggaggctgaggtgggaggatcgattgaacccaagaggcagaggttgcagtgagccaagatggcaccagtgcaatccagcctgggcgacagagaagaccttgtctcaagacaaggaaaaaaaaaaatgctgagaggatggtggactaactgatgttcagattcctcctcttaggcgcttggtcctcctccgtgcagagtggaattttccagctgcccagttcgacctgtgggctaattggtgggttgagagggtaagacagccttagcgagcactgcatgcctgcagaagctcccagctgaccatggtggctgcgctcagtgacgaacaggagaagtgaaggctgaggcttataggagggtggcctgaggctgctggtaggagagcgggggggctctctgcggcatgcagcctccagatgggggtccctgggagtgttctggaacattctcatccctgcacagagaaagatggttaagggcatggctggttcccagtgtcacacatgtgtgtgaggacaggctgcatgggaagtcctgcttggtatcattcttccttcctgggtgatgtggctatttgtgttttgtttgttttttaagttagtgtttagttagtttagacaaaacaaaacagatgctgacattaaagggaatgtttaaagcagagtttctcagttcctggctgtgcctagaattctctgtagaacctgtttaaaaatgtatttagtaataagcaacacgggggtcgccatcactgaacacttgctgtgccaggcactgcgtgcagtctcgtttcaccctctcgcaaatgaaggttgggtctgctgttcctgttttgcagatgtggaagatgaggctcagacagatttatcatttccccaaggggcacagccaggaagtgagagaacacttcccacatatcacagttcctggagctctaatcgagactcatagcagggactgggctggacacgagggcacctgctcagtttttaattttaattttttggtttattttcttttattcgtgttttttagattttttttttatttttattttttatttttatttttagacagagtctcgctctgtcacccaggctggagtgtggtagcatgatttcagctcactgcaacctccgcctcccgggttcaagcaattctagagcctcagcctcccgagtaggtgggattacaggcatgcaccaccacgcccagctaatttttgtatttttagaatagagttggggtttttccatgttggccaggctggtcttgaactcctggcctcaagcgatctgcccgcctcggccttgaaagtgctggggattacaggtgtgagccaccgtgcccggcggccacctgctcatttataaagccccccgtgactcatttacaaccaagactgagaattcctggcatggagtgcctccctctgtccaggaatgatctgcagccccctcttcccttccaggtgtgtctgtgtctccctgtggctgtttctgcaagattttgcatttttgagctctgcttttattcatgtcatcacccgagcatgttcccagggtcaccctgaccatgctgctggctgcgtatttatcccttttgtatcttctgtcctgggtcctctcccaccttctctggggtcagccctgtggtgccttacattgtgctgctttctctcctggcaccaaagaatgaggcagtcagtgcggagtgggggcagtagtcatcatcatcactgagttattgtgaaccgggaaagagatatgatctgtgttgacacgacacacggtgcccaagtgcacttgataaatgttggctgtcattgtcattgttgatgttccggtgattattgttgatgctgggtggattcttcctgggatcagggcagatatccagctgctgtgtcccttggtgtccttatcagtgtccttcctaattctgcaaccaaggcatctgccagggctggggtctcatctgaagactcaatcagggaagggtccactttgaagctcacctggttgttggcagaacttggttccccagttcaaatgttgaaatactttattactgtggaaacagccactgccccaggtaccttttaccctgaactcttgggacctctctgtggtctaggaactgaagggttaactcctggcactacaggggtctccgggcctctgcctgttggctgatggccttgtcaaattggttatctattttgaatatcacttcttctttcaatgcttgggaatcacggggctatgccctttccctcatgcgtttccttgcatcctggtcctaggaagtgagcttaacatagcagggctactgttttctgggctgggttttacccattgctgctggcacaggatgctggctcaggcccagtgccctcagtggatggagccttctgcacagttgcaaagcactgtccctaccccaagggactgagctccagataccacctgccccacaaccagacagcctgttcatggcctctgcagagcaggtctcctactttctgatcatcctggcggccaggtgctctgtggtctcctcactgaagtggccggtttttgttgcccttggttttagcatctgcctcatataaccccacttgccccctttgtctctcttctgccaggggtcacgggcgtcagcggtccagggaaggaagcaaagcaaatggagaatggcatgctggtgacggacagtgcagggaagcaactgcagaggtaagggcggggaggaaggccccaacctaaggaccctgccctgccagtgggaggacaagaggaggaacaaaaaaaggcctcagccccctgaggtcctggaaggcctgggcttttaccttccctcccaaatcctccaaggaccttgcttttcagagtacagaggcccaaagaaggaatgtggcactctttttgccaggtggcacaactcacacaggcctcatgatttaaccagctgtccacgcttctgacactcgggctccctacatggtgtgggtctttgctcaggtctcttggcggggcctggaaggttcaggctttgtgaagcagcatttgatttaaaactgtctcaaggccaggtgtggtggctcctgcttgtaatctcagcactttgggaggttgaggcaggaggatcgcttgaggccaggagtttgagaccacagtgggtaacatagcaagacctcatctctacaaaaaaggaagtatgctcgtgtttgattatagagggcttccttagatccctggggatttatagcgtatgcagtatattaaccatcctagcttttaaaaaactggctaagtcggccaggcagggtggctcatgcctataatcccagcacttcgggaggctgaggcgggcggatcacctgaggacaggagttgaagaccagcctggccaacatgatgaaaccctgtctctactaaagatacaaaaattagccaggcatggtggcaggcgcctgtagtcccagctactcgggaggctgaggcacgagaatcgcttgaacccaggaggtggaggttgcagtgagccgagattgcgccatggcactccagcctgggtgacagagcgagactccatctcaaaaaacaaaaacaaaacaaaacagcagcagcagcagaaaacagtaaaacaacaacaaaaattgacaaagtcggagcctaaacgtatcagaccgcggagatctgagaaaggatcccggacctgcagttgctacaggggtcaggagagagcaaagaccatgcggcatagcacggtgcctggaacagacaaacacttcgtagatgtcgcttttgccatggttatcatccggacatggttatggtccggaattggtgggtcttggtctcactgacttcaagaatgaagccgcagaccctcacggtgagtgttacagttcttaaaggtggcacgtctggggtttgttccttctgctgttcggatgtgttcggagtttcttccttctggtgggttcgtggtctcgctggcctcaggagtgaagctgcagaccttcgcggtaagtgttacagctcttaaggtggcgtgtctggagtcgttcgttcctcccgctgggtttgtgctctggctggcttcaggagtgaagctgtagaccttgatggtgagtgttacagctcacaaaggcaatgtggacccaaacactgagcagcagaaagatttatcgcaaagagtgaaacaataaagcttccacagtttggaagggtaccccagtaggtggccactgctggctctggcagccagcttttattctcttatctggccctacccacatcctgctgattggtccattttacagagagccgattggtctgtttttacagagtgttgattggtccgttttgacagggtgctgattggtgtgtttacaacccctgagctagatacgtaagttccccacatccccactagattagctagatatagagtgttgattggtgcattcacaaaccctgagctagacacagggtgctgattggtgtgtttacaaaccttgagctagatacagagtgctgattggtgtatttacaatcccttagctagacataaagggcctccaagtcagcaccagactcaggagcccagctggcttcaccaggtggatgccacactggggctgcaggtggagctgcctgccagtcccgtgccgtgcgccctcactcctcagcccttgggcggtggaagggactgggcgccatggagcaggggcggcactcgtccgggaggctcgggccgcgcaggagcccatagcggggaggtggggaggctcaggcatggcaggctgcaggtcccgagccctgccccgcggggaggcagctaaagcccggtgagaaatcaagtgcagcagctgctggcccaggtgctaagcccctcactacccgggctggcggggctgcccggcagctctgagtgcggggtccaccgagccgacgcccacccagaactagcgctggcccgcaagcgccctgtgcagctccggttccctcccgttcctctccctccacacctccccgcaagctgagggagccggctccagccttggccagcccagaaaggggctcccacagtgcagcggcgggctgaagggctcctcaagcgctgccagagtgggtgccaaggccgaggaggcacagagagcgagcgagggctgcgagggctgccagcacgctgtcacttctcaatcttacacagcctaaattctagtgggagactccagacagtgcatgagtgtagaaggatgtaagattttctgtcgaggtgtgtggatgtgtgaagtcctaggtcatgaagcaggaagccccagctccccatttgaattctagattccatccagagttggttccagttgctccctctgccactccctgaaaactcactcttgctttcagatttgagggccacttccacctcactaggccttaactaaagacctttgcacagatctcatgggtaaggaaagtttacccaatcccaggcgctaattcaaagaggggaggtggtggaggtttattcggccttcaggaagtgttttcaggggacacagttctgggggtgcagggatgactcatatggggctcttgacctcagttagcttataatcttgtgcaggagataagtgggtagaggaaagtatagaaatttccacggcagtgagccgcagctgtgttttgcatggtctccataatttcttttcttttcttttcttttttttttttttttgacatgagtctccctctgtcgcccaggctggagtgcagtgtgcagtggcgcgatgtcagccactgaacggaaaactgtgggcgacgcaatctgtgatcatctctgggggtctgcataaagctcatgaccactgatgtgcgaaaagtgcttttttttttttttttgagacagggtcttactcagtcgctgaggctggagtgcagtggtgcaatcacggctcactgcaatttctgcctctgggattcaagcgattctcctgcctcaacctcccaagtagttgggactgcaggtgcacggtaccacgcctggctaatttttgtatttttagtagagacggggtttcaccgtgttggccaggctagtcttgaactcctggcctcaagtgatccgcccacctcggcctcccaaagtgctgggattacaggtgtgagccactgcacctggccaaataatgctttctgagtaacacgcttgcatgaaggagcagtcaggcaagatcccaccccagtgcccaccacatttgtaaaacaagaaaatcgaactagctgggtactttgccctatgtttttcatcatatgttacattttgaatctttttcatgtttgaaaaatgatctacgatgtgccctttctgttatatcttttattggcttttttttttttgagatgaattctaattgatctcagaaaaaaaaaaaaaaagcacgcactttttatataccagttgtcatgggctttttgcaggcccccagagatcatcacagattgcgtttcccatgggtctcattcctgcctgagacactgcctttctctgggtacctataaacctggagagtgacatggtggggtgtggtgcatatattcatatatatgtttacatgtgtgcatgtggaaacactccgtctcttatgccatggttcagacccacaatagcagtcccagcagggagccctccgaccctgcccaaggcatctgtacggttgacacccttgtgctttgcttctccagacagctcagcagctcctcctcctatagtggggacatcagcaggcaccacaacagcaccgcagaactgcagaaagctgaggccaagaaggaggagacctggaagctgatggaggctgacaaggcgcagacagggcaggtgagattcgctccttaagtgatgacagtggctggagtttatagagcgcccactgtgcactgggcactgtgcaaagtgccttgtctatgttaactcacctgtccatcacaacacacctgtgaagatactatttgcagcaccagaaactgaggccagagaggctaagtgacttactcacggtcacccctggtcagcggcagaactgggatttgaaccctggccaactccagggttagtacttgtagtctctgctctattgactgcctgagcagctcaggggggtctcattcgctagaggtgagctggatgctttaaatcagggcttcctgcaacgtggggttcagttgtgcatgagatggtgtccggttgtgcacagacgcattaaatgacagaggaatgtttgtttcatttctttttttaatttttatttttttgagatggagtctcactctgtcaccaaggctggagtgcagtggtgcgatctcggctcactacaacctctgcctcctgggttcaagcagttttcctgcctcagcctcctgagtagctgggattacagaaacttgctaccttgcccagctaatttttgtatttttagtagagacagggtttcaccatgttggccaggctggtcttgaactcctgacctcaggtgatccacccaccttggcctcccaaaatgctgggattacaggggtgagcaccgcgtcctgcctgtttttcatttctcatttggtcctaatgattacgtccctgagaaagtcccagttgggtcctaccctgccttctcaacctatcaaccactatcctctctttgtaacaaggagaccgggttttgagctcctgttttattgtttttaaagatcgtctattttgggcaagtgttaataattctccatttatggtggtgatccaaagtttatttttaaaaataaatgtggttttttttgtttttgtttttaaagggaatggaatttttaaagtaggtaaaaaataagcatgcagataaagaaaaacaaaaaaaaaaacatgaaaggtggtagccggggagtggggctggggcactttctcttagatctgcccggatgtgtccagagcttccgaggactgtctgttcctggcttcttccttaacttgtcatcagagtcaggaccgtaacaaggggcagaggtgactctggtgtcctctctcgccttacccttagtgaccctccaggaagccagagaagttaccccaaatcgcaggacatgggaaggaagggccagagatgccaggcccatttaatcctcatttaactccaattttatattcaaggaacatcaaagccagggggcttgttacttgtcaaagttggacccagagtggagccaggcacaacacgcttatcgtttctttgtgtcttttttttttttttttttttttttgagacgaagtcctgctgtgttgcccaggctgtagtgccgtggcgctcaccgcaacctccgcctcccgggttcaagcaatttacctgcctcagcctcccgagtagctgggactacaggcctgcgccaccatgcctagctaatttttgtattttcggtagagatggcgtttcactatgttggccaggctggtctcaaactcctgaccttgtgatctgcctgcctcagcctcccaaagagctggtgctgggattataggcatgagccactgcgcccggccttttttttttttttaatttgttttcttttttttttttctgagacaaggtctgactctgtcacccaggatggagtgcagtggcacaatcatggctaactgcagcctccacctcccggattcaagtgattctcccacctcagccttccaagtagctgtgactacatgtgtgcacccccacgcttgactaatttttttaatttttttgtggagatgaggtttcgccctgtcgcccagactggtcttgagctcctgggctcaagtgactggcccgcctcccaaagtactgggattacagatgtgagccaccacacctggccacacacttgtcatttctgacccccgagcccaccacattccactactcatgagaaagaggttcctgaacgctgcaggctaatttcagggacagcaggcaacttggccgcatgacaaagccaagtggtgaaataaacacattcttaattatgacctgtctcctcacccacatttttcattttccagaatggggacttgaaaactcaaaaggaagcagccagttacacatcagacctgttatctttcacctgttacctttcagctagaccgtagggtcagatgatttttgtttttttttctggtgaggggcagagcctcactgtgtcgctcaggctggagtgcagtggtgtgaccaacgctcactgcagccttaagcttctgggttcaagagctcctcctagctcagcttcctgagtagctgggactataggtgtggaccaccacacctagctaattttaaaattttttgtagagacagggtcttactgtgtttcccaggctggtctcaaactcctgggctcaagtcattgtcctgccttggcctcccaaagtgctggcattataggtgtgagccaccgcacccagtccagatgattttcatgacccaaaattcagcatgaaaagcttgaaatgacaatgagcacagacacgggtaaagatccctggaatttcttgaaaccaagtcaggtggtttaggtgggggctggcctaaagcagattgccctgtctctcatgtcaggcggctagacacatttgtttagccccatgctgggctccacagggaatataggagggaaagaaactccaaccttcacctcctggagcgaactgggcactgggaagatgggtgagatggtattctgtgctcagagtgaaaagagttggaggaggctggcccagttgtggtgttgaggtgacatttggccttggttgccaggcaacatgtcacacgttgcttaaaactcattggtggcttctgctttctgtcagtcttggctaaaagttggaatcctgacccgagtctcccatgccatgtgtggtctgactgcgaccggtttttccagcctcttgttccttgctgccccatgatctcctggctccagccaccagtgccttctctcagttccccagatgcactgtgttccctcctacctcagggcctttgcacatgctggttctgccaccttttttccattttcagctggtttaactcctttttttttttttccccctggaggcaatgtctccctctgtcacccaggctggtgtgcagtaagtttggcttggtgcaacctccacctcctggcttcaagcgacccttgtgcctcagcctacaggcatgtgcccccacgcctgactaatttttgtattttttgtagaggtgagatttcatcatgttggccaggctggtctcggattcctgacctcaggtgatccacttgccgcagcccctcaaagtgctgggattacaggtgtgtgagccacgatgcccagcactctttatttttttttattttttagagacagtctcactctgtcacccacgctggagtgcagtggcgcattctcggctcactgtaacctccgcctactgggttcaagccattctcttgcctcagcctcccgagtagctgagatgacatgtgcctaccaccatgcccagctaatttttgtattttagtaggcaaggggtttcgccatgttagtcaggctggtctcaaactcctgacctcaggtaatccacccgcctcggcctaccgacgtgctgggatcacaggcatgagccactgcacccagccttggtttaactctttaatgtcacttcctcgaagaaaacctcccccaatacctctctagactgcattaggtcaggttgtctgattttatactcacgtggaattgtgcaccgtttacagcccttctctgtgatgacgcatttatctgggatgattttatgggagcctatctcaccacgcgactggaagctccatgcatgagggcagagaccctgagtttgtctcttttttttgagacggagtctcactctgtcgcccaggctggagtgcagtggggcaatcttggctcactgcttctacctctgcctcctgggttcgaggaattctgcctcggccttccaattagctgggattacagatgccgaccacacacccggctaactttatatttttaatagaggcaggattttgccatattggccaggctggtctcgaagtctctacctcagttgatctgcccgcctcagcctcccaaaatgttgggattacaggtgtgagccacggcgcctggccctcgactttgtttactgctgactttgttgaatagctaaaggggaggggtgttctacgtaggagcaaaggcaggcagctgggtggcacagtgctggtgaagcccccgaccttgtggggctggggctggggctgggtgcgtgcatgtgctaagctgccttatctcctgtgatctccaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaaggttggtgccgctgtctcccaccccgcctgatttgggcccctgttgtggctttgtctaattatagaaatggatccttagagtcctcagcgttttgtgggaccccaaaccaagccaaacccagaaaaatggtagctgtcagctagtagacactcagatatttgtagagtgggtgtttgagtgctttgttcatatgggccttggtggtagacgggaggagtgctccagtgtgcccattttacagatgaggacagttgagaacagaggcctctggaagcactgagggttgggaggacccccttgagcatgtttgctttgtcacagtgacagagcttccatgaggtctcatttgcggacttttgcctgctgagtgagggcggaaattggcttatactagtaattcccaattatgggcagtgttgtccctcagggatgtttgacaatatctggagatgcttttggttgtcaaaagattgagaaaccctgctgttggccaggcatggtggctcacacctgtaatcccacactttgggaggctgaagtcaaaggattgcttgaggccagatattcgagaccagcctgggcaacatagtgagaccctatttctagaaaaaatagataaataaaataaactacaggtcacgtggtggtatgcgcttgtggtctcagctacttgggcagctgaggtcacaagattgcttgagcccaggagtttgagcctacagttagacctatgattgcaccactgccctccagcctgggtgacagagcaagaccctgtctcaaaaaataaacaaaaaaaaaaaaaccctgctctatactgttctgtgtggtcctatgggagtcctcaaatgcagcagcgttgatattaacagctggcatttactgagcatttacttggtgcttggatttgttctaaacacttccacgtgttttaacttattttatccttgcagcagtcctgtgaggtaggagttaatatttccctcattttggagatacagaaactgaggcccggagaggttgagtcagttgccaaaagtcacacagctaatacatggcagcattggcattgaacaaggcagtctggctcaggagctcacgctgttatccactgtgctacgcagtatgtgagccatgtttgcaaatacacatgtatggtccatatgatatatacacagtaaatggatagtcttgacacatttgagtacttctgtatgccaggcacattgccaggtggggacttcacattccacagtgctccgaggtcagcgtcattgtcccattttacagatgaggaaactgagagattcagtgaccagtaggaggtcccatagctggtaagtggcagagatgggatttggcagcattggctccagagcctgttacttgagcccctgcctattgggtgtcttcccgattaaagaggccgagatggaagcctctctgttcctaggaagttgctgctctggaacacacagtgcgctcctgtggattgtttgagagaagcaccagtgtctcaggatctccaggaggtggctttgggaaaacccagcggtagcagagcacacatggactccttgagtctctcaatccctcccctcccctctccttgccattaggggaaaggactgtggcctacaaattataattgagggaaggtagagaacagagagggtgtggtattacctgaactcacacagcaacaacgtctgttccagagctgtgctgtctggtgcggtagtcacaagacacaggtggctattttaatttcagctgttaaaattaaataaacgttgggcgcagtagctcacgcctgtaaccccaacactttgagaggccaaggcgggtggatcgcttaatccaggggttcaagaccagcctgggcagcatggcaaaaccctgtttctacaaaaaatacaaaaattcgctgggcgtggtggcgcatgtctgtaatccctgctactcaggaggctgaggtgggaggattgcttgagcccaggaggtcgaggctgcagtgagccgtgatcacagccctgtactccatcctgggtgacaggatgagagagaccccatctcaaaagaaaaataaaattaaagatttattcgattagactagacacgtttcaagtgctcagtagccatcatttcagaaaattatctcagcactgttctaaaacagcgatccctagcctttttggcaccagggactggtttcatggaaatggtgggtggtgatttcgggatgaaactgttccaccttagatcatcaggcattagttagattatcagaagaagcgcacagtctaggtcccttgcatgcacggttcacaatagggttcgcactgctaggaggatctaatgccaccactgagctcacaggaggcagagctcaggcgctgatgctcaggaggtgaccaccactcacctcctgctgtggggcctggttcctaaccggtcatgagctgctgccaatctgtggccccggggttggggacccctggtctagaagaatatggcatggggattaagagcaggctgtctggattaaaatcccagttctgcttctgctaggcacagtatactaagggcaaaggcgttcacctatctggacttcagttttcttatctgtaagttgggtagtaatagaagttattcagagtcatcataaaaatcagttacatgtaaaacccagcacagtgcttagcacataggaagtaccctctgaataatagctgccattatcatcatcattattattactatttttttttttttgagacggagtctcattctgtcgcccatgttggagtggagtggacgcagtcttggctcactgcaacctccacctcccggattcaagcaattcccttgcctcagcctcccgagtagctgggattacaggcgccaaccaccacgcctggctaatttttgtatttttaggagagacggagtttcactgtgttggccaggctggtctcgatctcctgacctcaagtgatccacccacctcggcctcccaaagtgctgggattacaggtgtgagccaccatgcctggttcatcattattattattattagaagttgggagtccaggcctgcctcgtccacatggccactcctccctgcagtgcctggtcagctccctctctgcattgtggagttttaactccgagtgtctgcagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccaggtaaggggtgaggtcttagtgttcgggacaagccctactgtgcattatataccagtgttacctaaagccttgttttatcttaccatgtccccagtgtggtgcttttgaagcatgtagatttgtttttgtcagtttcgaatacctaaattgtttttttgctcacaataacaaaatgcactttttttgtggaatgcagttttttcctaagttttacttttccacctgtcaattcaaaaaggaaacaaaacctatcactataaagacaacttcattattaaaatttctttttttttcttgagacagagtctcgctctgtcacccaggctggagtgcagtggcacaatcttggcttactgcaacctccacctcccagttcaagtgattcccctgcctcagcctcctgagttaacaggtgcgcaccaccacggccggctaatttttgtatttttagtagagacagggtttcaccagtgttggccaggctggtctcaaactcctgagctcaggtgatccacccacctcgacctccccaagtgttgggattacagatgtgagccactgcgtccagcctaaaatttcttcaagtataaaattctttagttcttaagcctcctgcaggaggcaggaactaaacaaaaaacatgactaatagcagcctaaataagatagacgttttctttttctctgtcataatagaaatttagaggtaggctgttcagggctggtatggcagcttcatgagtttaatatcccagatacctgcttttatttaaaaatttaaaaaatcttaccatatttatacaagcctttcattctttctttctttcttttttttttttaatttgacatggagtctcgctctgtcgcccaggctggagtgcagtggcgcgatctcggctcactgcaagctccacctctcgggttcacaccattctcctgcctcagcctcccgagtagctgggactacaggcgcccgccactacgcccagctaattttttttgtattttcagtagagacaaggtttcaccatgttagccaggatggtctcaatctcctgacctcgtgattcgcctgcctcagcctcccaaagtgctgggattacaggcgtgagccactgcgcccggcccctttcattcttaagttggcctcatggtccaaggtggctgctggagctccagccattatatctatatttcagtcagtgagatcaaggaagggaagtagggcaagggagcatatgggtgctgaatcagcactactcccttatctgcaggcacacattctaagactcccccaatggatgccttaaactgcagatagtattgaatcctacatatcctgtttttttctgtacatacatacctatgataaagtttaatttataaatttggcataatagattaatagcagtaatttataataataaaatagaacaattataacaatatgccagtatcactacttctccacattagaggcgttatttttattacttttttttttgagacagagtttagctgtgtccttcaggctggagtgcagtgatggaatctcggctcactgcaacatctgcctcccgggttcaagtgattctcttgcctcagcctcccaagtagctgggattacaggcatgcgccacacccagctagtttttgtatttttagtagagacgaggtttcaccatgttggccaggctagtctcaaactcctgacgtcaagtgatccgcccgcctcagcctgccaaagtgctgggattacaggcattgacccactgagcccagccaggggcattattgagtaaattcggattacttacccataagcactgcagtacaatggccgtcagtctgataaccgatatggctattaagtgactaaactgacagggagggtctgcagcatggacctgctggacaaagggatgattcacaccgcggatgggactgggggggatttcatcacactactcagaagggtgcacaatttaaaacttacacattatttttggaccacagttgaccatggataaccgaaaccatgtgtgttagtttgtcctcatactgctatgaagaaatacccaatactgggtaatttattaaggaaagaggtttaattgactcacagttccgcatggctgaggaggccatggcagaaggagaagcaaacatgtccttcttcacatggcagtaggaagaagaatgagagcaccacgaagtcggggagcccccttataaaaccatcagatcttgtgagaactaactcactatcatgagggttgggggaaactgcccccacgattcagttatctccacctggtccctcccatgacacatggggattaagggaactacaattcaagatgaaatttgggtggggacacagccaaaccatataaccacggaaagtgcaaccttggattagagggacacctgtacatctaattgtccagaacttagtcatgggaccacctctattcacaagggaccctggaaagtgccgtgttttagctgggcacattgcacttcccagcaaaaactttcagttgggcctaggcacggtggctcacgcctgtaaccctacccctttgggaggccgaggcgcgtgtatcacctgaagtcaggagttcgagagcagcctgaccaatatggtgaaaccccacctctactaaaaatacaaaaattagccaggtgtggtggcatgtgcctatagtcccagctgctctgaaggctgagacaggagaattgcttgaacctgggaggtggaggttgcagtgagccaagattgcatcactgcaatccagcctgggcaacagagtgatactctgtctaaaaaaaaacagagaagtttctgttgggaaaggagaaattgtgtaggcagtcagtcgtctctgctgcatcccttctgcagaaacggttatatgttctttgttctttgaacacatgtggtttcttaggatatcgcaggatagataatgttttcaattgacaggtggagcatcttgctaagtgggagagctgagagtgcaacctcaagtctgtccaattccaaaactgctgttaccgctaaaggattaaccgcagcacaattgccagtagggatgggttgtttagatgggagcattccagctgcaaagcaaaacaagagtaagaaaccatgaggctcaccatatctcaaaccacgctgcacagctgttcaggtggcatccagggggccttggttcaatcatgtggcccctgcgccccaccacactgtggcccaatgattgatgagaacgaacagtgatggaatcagagagagtaggtccagttcctggagtctcgttatatcctcttgaaattggtgccagcttttttttttttttttttttcccctgcatttaccaaatatgttatctgtgttcatacgcaagctggaaaatttcctgaaagacccaaaaagaacaaaacaggccaaatgcagtgttgaaggcaacttaaatgtctgccaatagcaggaccttgggtacaccgtggagcaatgtggctttgagcagggataattagaagacgcagctgttggagcaccaaggatttttatttttcaacaacaaaggaaatgattttagcaaaggaccaagttctaggtgcactgtcgttatcaccgagatgaaatgcataatgtgtgtgggcaggactggaagggaggcagatacatgaaaacatcgtctttttaagggttgagattatagaatagttaattttttaatggcttttggctaaatttacatttatcctctcactaggcagtctcattcctaagtgtatattaaaaaaaaaaaaaaaaaaaaaagagcaaaggcagtgcttagaatgttctcagcatcttgattcataatcgcccaaactggaaacagctcaaatgtccattaacaggaccgtggagaaataaattgtgatataattatacaatttatggttgagtagtaaaaaggaatgaaatgctaatacacaacaatttgggtttatctcagagatgttatagtgatcaaaagaagccagacgaaaaagagtaggtactgtgagatttcatttatatgaagttcggtcgggtgcagtggctcatgcctttaatcccagccctttgggaggcctagacaggaggattgcttgggcccaggagttcgagaccagcctgagcaacatgggaaaacctggtctctacagaaaatacaaaaattagctgggtgtggtggcgtgaacctgtagtcccacctgcttgggaggctgagatggaagggtcacttgagcctcggaggcggaggttgcagtgagctgacattgtgccagtgcacttcagccttggtgacagggcgagttgtctgaaaaaaacatcagatcggcagggcaggtggatcacctgaggtcaggagtttgagaccagcctggccaacatggtgaaaccccatctctactaaaaatagaaaaattagccaggcacggtggtgggcgcctgcaattccagctacttaggaggctaaggcaggagaattgcttgaacctgggaggcagaggttgcaatgagccaagattgtgccactgcactccagccagggtgacagagcgagactgtcttaaaaaataaaataagatcattcctgaacaaatattcatctcaggttagatttttccagtaagtaaggttcagaggcagtggcaagtggaggaaagtgaacaggtaacacacttgagagcgatttgcatctggattgttcagaaagcaagctggtaagagaggaaggagatgtggtccagggtaagatggggcagatcacctgggccttcagccatgcagaggggtctggatttcatgggaggcggtgggaacagctggagaagaaattatatctgatccacattccaggaattggcagaacagctattctgagactgcgtggggttgtgcggtacctgggttcacttacatagcttctggggccccagaagactctccatctgtgggttgcaattaacgcccgtgccgccacccaggaagaagctgccaaccacagaggccttgtaaaagccacctgctgctattgatgctttttgttggactctgccccaaagcagcccagtacacctggcccagggcaggatgcagggaggccgagttcctagcaaccctttgttagttttcccagctctcctgtcgataagcaattgtaggcaccttgtggaatcaggaaccccgggctcaccagttccttttgcgtagatgagaaaaacctaggctaggagagcgcagtgtcctcacatggctggtgcagcctctgatccacagctccacaaagcttgcagaaggtggttggcttttgttctgaatctaacaagacttatcgggaggctcttggtgcctggcactggctgaatgcccaggttgggggaggcagagcagatgaagcatctgcccgcgagggtgggtggagctgcttgtgaaacgtatcatcgtagcccgggagctgggacactgaagcccggagaaggtgctcatggaggatgggaagggcttcccgaggaagtgacatctgtgctcccatctgctgggtgatgaggaatggcctggacgggatgggcatggtgggtggaggcaggcggcctgtgtgcagggaaggaaggggagagttacaggatgagatgagttgagggaagaagcatggttggcaactctaacagcgctgggaggccatcggaggggggtgacgagattgaccctatcctcatgggcatctcagctgggctgagtgtgctggaaccggccattgcatggacacagtcactcctgaggggatgtgatcaacaggcggaattctgtcacttaatgataacaatagtcaccagctaactgaatgcttactgttaggtcaaactatatgaaactgctaatacttatttcttatctacagaaacagctatttcctgtggttcaacctagtattaccaggcactgtgcttagtgacatcatgcatatctatatgatttatgaaataatgtgtccacgcaaatacacatcacatgtaagactgtaactcttacatgtcaccctcacaatgaccccgtgaagcaagctttgttttgtttcgtttgttttcttaataatattttatttttgtagagatggcattttgccatgtgcctgggctggtctcagactcctggcctcaagtgatctcccgcctctgcctcctgaagtgcgggtattacaagcatgagccaccccacctggccgagcaagccttgttgttcccattttacagataaggaaactgaggcttagagaagtaaagtgttagtcgtgtttatattgccagtcagtagttgagtcaggatttgaactgaggtctcgttgacctcaaagcctatgctgaaaaccacactgctggttccagaaaaccctagaggtgaaaggcttcagagaggcagtacagggtagaggttagcactttgcagcccagatggcctgggtttgaatcccagttctgccccttgctagccatgtgaccttggggaggagattaactagcttctttgtgccttagtctacccatcacatataggaatgagcacctcaggttttttgtgaggattgaatgaactgatgtttgtaaaactgcttagaacgatgcctggggctgtgggctttgtataagcgtgagctattattgtcactgtccttgtcattggtggtgctattcctgtggttcaccaggtgagtgggcacccctgtgagggcagcccggctctaacattttgcctcctggaggtatcggttacgtctagatgttctccagcacagccctgccctgggaggatggcaggagggaaccttcatcaactccccgcgtctgttctctaccccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtgggcatggtgggcctgcaggagcgggtggaggaggccgccttagcaccttgtctctttgcctcgatcttttcctcgcaccttgagctgggtataaagccaaaccccggccttgcagaaaggatggagaggcttgatgagcgcggaggacagatgaatcattaagagcagacagcggcactgtagacatgcagtgcccgcggcatttaagtgcagggacacagctcttctggagtcagaaagccctgcaagtgcttcccgttaactgtcatcctagtgatgcaagactgccagcgaccgactctgctattgagtatcttcataccgctgttcccgtctgggggtgatcatgcacccctgggtgatgtgtgtcagaagcaatttactaatactaagctaaaccatatgagattgtcatcttgtgggccagatgtcatggctcacgcctgtaatcccagtactttgggaggctgaggcaggaggatccattagattccaggccagcctgggcaacatagcaagacccccatctctcttaaaaaaaaaaaaaaaaaaaaaaagtagcccatcatggtggtgtgtgcctgtagtcctagcttctcgagaggctgaggctggaggatcgtttcagcccaggagttcaaagttgcattgagctatgattacaccactgcactccagcctgggtgacagagtgagaccctgtctctggaaaaacaaaaaaaggagatgggggtgggagattgacatcttgtggatcacagataatagcatcaatccaaaagaggcagaagtttgctaattatttgctgaatttagagaagtgtccctctcacccatttgcatccttatagacttttctgaaaaagtgacagcaccccagaggtgtcccataaccattagcccgtcttacacactctaatcccatagcgtaagtctgggtgggctaaccctgaatgattacagaccttgacttcccttcagaatttttagggagtttgtcacaatctggctgtgtctgtcggagtagtgaggatcagtcacttggttcataagggctgcaatggagaaaagatcaacaccccatcttcctagaatgctttatattttagaacattaaaataatagttctagtgctatatgatatcatacgaagcctagctttaaacaaataagatggccaggcgcggtggctcacatctgtaatcccagcactttgggatgccaaagtgggtggatcacctgaggtcaggagttcaagaccagcctggtcaacatggcaaaatcccatctatattaaaaatacaaaaaaattagccgggcatgatggtgggtgcctgtacttgggaggctgaggcaggagaatcacttgaacccaagaggcagaggttgcagtgagccaagaccgcaccattgcactccagcctgggcaacgagagcgaaactctatctgaagaaataatagaagagaagagaagaataaaataaaaagtaaaataaaatagttctgatggtacatgataccatactaaacctagctttaaacaaataagatgaccaggcacattggttgacacctgtaatctcagcactttgggtggccaaggcaggcgggtcacttgagcccagcagttcgagaccagcctgggcactctagggagaccctgtctctaaaaacaaaacaaaaaaccaaaaatttgccaggtgtggtggcatgggcctgtagtcgcagctactcaggctgaggcaggaggatcactggaacttggaaggttgaggcggcagtgagctgtgatcatgtcatccacactccagcctggatggcagagtaagaccccatctcaaaaaaacaaaatgacagaaaacatgatttctgtttctattttaaagggtaaaatagtatattttaacactttgaaatgaagagtctgggcttgggaacgttacaatgatgtttactcgtactagttacgcactcccctcccagatctgtctcgtaacaagagactgttattttctacttgtttttagccaaaaggccgagaaacgatggttattttaaatccctagtgtctcttacagttgatgtcttcttagtatttaggaatttccaggacatctttttgttgttgttaatgcactgtgtgtgtgtgtgtgtgtgtgtgtgtgtgtgtgattataggagtgacccactacgcccggctgtgtgtgtgtgtgtgtgtgtgtgtgtgtgtgtatgtgtgtgtgtgtgattataggagtgacccactacgcccggcctatgtgtatgtattttaaaggcttcaatgagaaaaaagttggttcttaaaaaggcaagcttcagattccagggaagattgcctctggagagctctgttttaatccatgggtttgccagattaatgaggatttactggcctcgtgccttcggccctccctaccctgcgcccattgtgcatgttttgaaaaagcagtgccaggaaggactctctctggaattactgcggagttacttgagttagcaaagaatccccttcctcccccaagagctgtaagccaagtctctgtagagctgactccatgcctgtttgtctgcctgtgtgtcttggcgcaggtggctggccgtgcggctggagtgtgtgggcaactgcatcgttctgtttgctgccctgtttgcggtgatctccaggcacagcctcagtgctggcttggtgggcctctcagtgtcttactcattgcaggtaagaggggatgctcttggctggattattaaagtctgttaatgggggagccagttgtccttggctttggattccagctccaacaggaatgggggagaggaacttgagaggtacggagtttgaggagcaggtacagtgccacagtgcctggtgaccaactagagcaggagacggatttgacatgtggccaggattttccccatcagtcacacagattccttagtggcccaagaggatacttccaggtacgaggggaatgcttttaaagctatgaatttccctctaagaactgctttagctgcatctcacaaatgatgatacattgtgttttcatattgtcacctggctaaaaatattttccagtttcttattatgtggcccatgagttattttggaaatgtgtgtgcttaggagatggcaatgtggcaggcctgggtgatggctatacctggggttgctaatttcggtacctttcttacctgaatgtttcataactcataaccttttatttttatttatttattttttttggagacggaatctcactctgtcacccaggctggaatgcagtggtgggatctcggctcactgcaacctctgcctcctgggttcaagtgattcttctgcctcagcctcccaaatagctgggtttacaggtgtgcgtcaccatgcctggctaatttttatatttttagtagtgactgatggggtttcgccacatcggccaggctggtctcaaacccctgacctcaggtgatctgaccgcctcagcctcccataattcatacttgttgaaaataatttgtttcctattatctcagtggaaaaaaagaaaaaggaaagtcaagtacgcccgcttactctagaaatgccacgtgactcttccactcacaggtcaccacgtacttgaactggctggttcggatgtcatctgaaatggaaaccaacatcgtggccgtggagaggctcaaggagtattcagagactgagaaggaggtaggcaagggcccctggctggacctcttggtctttggtgtagctttaccccaaggagatctctggaccctatcctgtgcacctctgcctctgagctggatacctcaccaggtagaagtgcatcttaacgcttgtccagtctttttgcagcacttatttagagcccggttttagggtgaaaatagtttaccggctttacccaagatctggggtatccatatacgagactgtgggatgctgtcagggcattcagaaggtattcacattgtgaagaagtttccccctctatttctctttcataacttctgatggtatcacagagaaagtcttagtctggggctagcaggtctttaacaccttagcaattgagatgatctcccttcaacagacagataaacagcagccctcacacttggagtcttcaacaggacggattctgtctatcagaaataaccttctgttatttgttatgaatttggtttttttgtgtgtgtgatggagtctcactgtcacccaggctggagtgcagtggcacaatctcggctcactgcaacctcctcctcccaggttcaagtaattctcctgcctcagcctcccaaatagttgggattacaggtgcctgtcatcatgcctggctaatttttgtatttttagtagagatgggggtttcactaagttggccagtctggtctcaaactcttgacctcaggtgatccgcctgcctcagcctcccaaagtgctgggattacaggcgtgagccactgcgcctggcctgttatgtatttgtataggggactcctgttacggaaaataatactacttttccttttgtgattgtaataaattttcctcttaagtaagttgagaaattaagtctaagtgacttgattaagcatattaaaacaacaagagaatgagtacatgcatactacacgaatgatgtagctgggaactgaccaaagtttgggaaaccctgccgttattgaaccccagtcccctttttatagatggagaaaaagggaacctggggagggacaacagctgatccaaggtcccacgtggcttggtagaacagctgggactaggacccgtgcctccagtctttgatgttgcgttgcccttaataactgccttcttaggccctgaacagcagcacaagtaggaacagcagtgataatagataatcacaataatgcctggcgacacccccaccctacattaatgataacagggacacacatagtgccttgtagaatgtcaggcccagacttaaacgtttaatatagagtaatgcactcagtctttaccccgctctatgactgatttttgagacacggtctcactcttgcccgggttggagtgtagtgcgatctcattcgctgcctcccaggctcaagtgattctcctacctctgcctcctgagtgtctgggaccacgggcatatgccatcacaccggactgatttttgtatttttagtagagacgggattttgcccagactcatcttgatctcctgagctctagtgatctgcctgccttggcctcccaaagtgctgggattacaagcgggagccaccatgcccagcccagccctataatttagatgctactattacccccattttacaggtgaggaaactgagacaaaaagctgaagttacttgcccaagatcacatggctggtaaatggcagacctaggcgttgagcctgtgcctcctcagagaccctatccagtgccatgggagtcatgctacccggcctcctgaggagagatgccccttgggagtgagaccaaggcctctgtaaggtctgtcctcctgaggaattcacagaggtgacctcggcccactcctttaacattctgactgggtgaaccaggtcccatgtcacgggtgagcattgtaagaatggcgtgagtgcccccgtgaggaaccaagggtgtattacaccggcggcttccaacttgacactgaatttaattcacttacaaggtatttcattaggttttttttttttttttttttagatggaatttggctttttttttgcccaggctggaatgcagtggcacgatctcagctcactgcaacctccacctcctgggttcaagtgattctcctgcctcagcctcccaattagctgggattacaagtacccaccaccccgcccagctaacttatttcattagtttttataatagcctcattgacatgtgaatttcacatgccatggaattcacccagttaaagcgttcagttagattgaattcagttttttttttgtttgtttgagacttaagtctcgctccagcctggagtgcagtggcatgatctcagctcactgcaacctccttctcctgggttcaagcgattcccagcctcctgagtagctgggattacaggcgatttttgtatttttagtagagaagggatttcaccatgttggcccggctggtctcgaactcctgacctcgtgatccacccgcctcagcctcccaaagtgctgggatcacaggtgtgagccaccacacccggcctgagttcagtttttaaaagcattttacttttgactgacttttatatttttagaaggatcgtgtttgacaaacccaagagaaagtaattgtcctcattagtcctaccactattctgtatttgcatgtatttttatatatagatagaaagttccacatacttctctccattccgctcactgtgttgttatagcatctccccttcaattatgtacataaattataaaatagagatacacttgttgttttaaaaaagaaaaaatcaatacagggctggacacagtggcccacgcctgcaatcccagcactttgagaggccaaggtgggtggatcacttgaagccaggagttcgagaccagcctggccaacggtgaatcccgtctctactaaaaatacaaaaattagttggcatggtggcaggtgcctataattccagctacttgggaggctgaggtgggaggatcgctggaacccgggaggtggaggttgcagtgagctgaagaaacatcactgcactccagcctgggtgacagagtgagactctgtctcgaaaaacaaaaaaacaaagaagtttatggtggagaaagacagtttgttcctgttcgccccgttcctctcctctccagagagaggccccattagcattcgggtgaatttcccccaaaactttcccgtgtggattcccacataccccaacacttttgtttgcttgtttctttttcttttaacgtaagtggaatctacctgttatcctgtgaaaccttttctttaaccatgaggcacctttgcatctgtgtatagtaacagtcactgcctctaagggctgctgtgaggctcagatgagatcatgggtctcaagtgctgagcagagcaacttgccttagttgcattgtaagcgctcaataataacatttattttttggccaggcgcggtggctcacgcctgtaatcccagcactttgggaggccaaggcagatggatcacttgagcccaggagtttgagacgatcctgggcaacatggtgagacatcgtctctacaaaataaaaaataatactttttgttgttggcggtggtggtggggtttttttttgtttttttttttttgagacagaggagtcttgctgtgtcacccagactggagtgtagtggttttatcttggctcactgcaacctctgcctcccagattctagtgatcgtcgtgtctcaacctcccaagtagctgagattacaggctcccaccatcaggcccagctaatttttgtatttttagtagagccagggtttcaccatgttggtcaggctggtctcaaactcctgacctcaagtgttctgcccacctcggcctccctaagtgctgggattacaggtgtgagccactgcgccggcaacgctgtgattttatagcacgtccacaaaagggctgcatgtcttgcctaaaagttgcccggcgttttcttgttatgtgccgtctgcagtgcccctgagcttggccatgtgctctgcagcctggttcagcacctgtgtgtgccctggacggggaggtgcattccccgaggctaaaaccagtgaacctggcccaggccatatccagctgtgggcctcaggaaatgctgaactgaactacttttcaaaaggagggttgtgtgtccctgggcaagttaccgcccctctctgtgtctcagtctccttgtgtgtaaactggggataatgaaaggaccctcccacatggggttgctgtgaggattggatgagacactgcgatacagatgctgcttttatccttgccttcctgccggggtgggcagccagggtaactcacttttattgtcgtgtctgtccagagaagaccactcatttcattgactccatttataaatatttatttaaatttttttttatcaaaaagtaagttttattggcatctaaaaacaaaattcacccaacactgaaacatacttcaatatttatgttattgttttcttgtttcttttttactcactgcagtgtgaggaacaaatcacatttactttggagaaacagagaccatagtgtagattttacaaaatcactttttaaactctctgtattgcgctcctcaaatacctagagccagtctgtgcataacatggcacactgttgtctaaaccgtaaaattttgcatcagcctaaagatatggataagatatacctccacttgctcttttgaaatacatctattaccttatccagcctaatgatagttacctaaaaaattctttgttccgtaggaagtctctgacaagctgttattcatttccttgacgttaaaagaatctgggggcaacatttatattttatcagaaaaactttttaaaagtttacctatcatgttcatattgagaacaatgtctgtggcgggcatggtggctcacgcctgtaatcccagcactttgggaggtagaggtgggtggatcatgaggtcaggagttagagaccagcctggccaacatggtgaaaccacatctctactaaaaatacaaaaattagctgggtgtggtggcgggtgtctgtaatcccagctactcaggaggctgaggcaggagagtcgcttgaacctgggaggcaggggttgcagtgagctgagatcatgccattgcactccagcctgggcgacagagtgagactccatctcaaaaaaaaaagaacaatgtctatacaaatcagttgtacaattattttaaaagaatggtgagcatgaacgtcacgttaattctggcagacaaaaatgaacaactatggtccattgagccattatctgttacacagagatgacagctttacagaaggtatctctgacctactgagggatgatcatgtcctctcagtttctgtgccttctaccactagttcactttctatatcagcagctgtgtcactcttcttgtttatgttcataaatgtgtgttgaacacctactatgtgctctgagccctgggatacagcagtgaacaattagagcctgtcctcattgagtggatggtgcagtgggtgtgggagacagaatacactcaagcatgcgagccccaagagggctggggacaggcagtgccctgaaggagaaggcagtgcgggaggggacagagggacacagggctgagagggtgctctgtatcgaccagagatccacaggatgcaagggggtcatttggggaataacattccaggaagggcaaccccccagtgctgaggcctgggaggccaccttgggcagcagagtgagtgagaggggaggtcaggggagtcacagctttaccagatggactggaaattccttactctctcccttcactgcgatcgaaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtgggtacacatcgccccattccctcacccattcccagtcgggcacagggtgccatcgggcaggtgaacctagctgcagcgtctccccagtcactcacggctccacacctttgcttgaatggctttttggggggctgggagtggactgtggcagtaaaagctgttcagagcgcatacagcttgcagaagtgaaggcttttaggtgaactgacagcctgaagaccaaatgagccccacagatttgttttggaagattttttgttgttgttgttgagagagggtcttgctctgttacccaggctagagtgcagtggtgtgatctcagcccactgcagcggcagcctcccaagtggggggactacacatggttgggagtgcaggtgtgtgccactgcacctggctaatttttgtattttttgtagagatgggggtcctactatgttgtccaggctgatctggaactcttgagctcaaccggtctgcccgcctcagcttcccaaagtgctgggattacaggaatcagccaccattcctggcccctggaagaagttctttttttgttttttggttggttgtttttttttttttttttttttttttttttgagatggagtcttactctgttgccaaggccagagtgcaggggcccgatctcagctcactgcaacttctgcctcctgggttcaagtgattctcctgccttagcctcccgagtagctgggactacaggcatgcgccaccatgcctagctaatttttgtgttattagtagagatggggttttgccatgttggccagggtggtcttgaactcctgacctcaactgatccacccgcctcagcctccccaagtgctgggattacaggtgtgagccactgcacctggcctggaagaaatttgaataagttgcaaatactgaaaaatctggaagacttaatataaaaatttattttctgctttttttggaagatcagaacatctggcaacatcaggtcaatcctcccccgcctggctctttctagtcaacctgtgagcctcctggttcaccccagtccctccctgtcccattcattgcctagttggcccctccaaaacattagaatttgtgatctctagaataaggtgtcaccatcccttctagggggatggctcaagggaagtgagaaattgtcagaattttggaaccttctcttggttccgagctgttcttggaagaggttccttgacctgagtgatacccttagactttcctctggaattggtctgacagtcttcctggccatttgctgggggacaaggctgctttcacctctgaacatatggacttattgaactgttcctacgtacctcccacaaagctcagaacattctgttcccagcagataatttctctctgagttacagagaagagcagagtgggtgatgttcttgctgtctttttttgtttttgtttttgtttttgtttttgttttgttttgttttgttttgagacagcctctcactctgtcacccaggctggagtccagtggtgctatttcggctcactgcaacctccgtcccctgggttcaagtgattctcctgcctccgtctcccgagtatctgggactacaggtgcatgccaccacgcccagctaatttttgtagttttagtagagatggggttttaccatgttggccaggctggtctcgaactcctgaccttctctgatccaccttcctcggcctcccaaagtgctgggactacaggcatgagccaccgtgccccagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtgtgaaaaacagtggggaaatgaggaaatgcctgattattacttaatagtttcttgagtctaaacaaatagggctttgttggaaattccttctgcctcttctgtatctcttttgaggtctctagtaacttataaaaagccgagtcattccttttgggagcctggcaaagggaagagagtccttcttgaccttcggccgaaacacccttaaaggagtgtctctgggcagcgcgcaagggagagggctgtcgagttgggttgaccagatgactgatgcctgaggtggggccgagatgagggcactttggggcagggacaagtccggatgccagcattcccaccacacctgggcccttctgtcctgcaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggtggggtctgggtgtggcccagggggtgagccagagctggcaagccctatgattgcactgacagtggtgtatgtatatttttggggcaaacatacatttggccctacttcatcgttcttttttttttttttttttttttttttcctgaaacagggtctcgctctgttgcccagagtggagtgcgctggcgcaatctcagctcactgcaacctccgtctcccaggctcaagcgattctcccaccccagcctcctgagtagctgggactacaggcacatgccaccacacccagctaaatttgttttgtacttttttgtggagatggggttccactgtgttgcccaggctgcccttgaactcctgggctcaagcaatccacccaccttggcctccaaaagtgctgggattacaggcatgaggcaccgtggctggccttcattgtttttattgaagttaggctgtgctgctgcttccctgaatttcctcttagtatatgattaacaacgtgggaattaactgactatcagtcccgacttcctgtccccgggaggggtagtttcagagcatctagaaaaatccaaaaagacaccgtcttctctctctgctgccagagtcagactgagcatctctaacccttccaagagctagacaagaaataagactttttaattttcgattcacggggtgcacctgcaggcttgttacgtgggtatattgtgtgatgctgatgcttcggcttctatggatctcatcacccaactattgaacagagtacccgagagagagtagtttctcaaccattaccctcctccatctgtccccacttatggaggctccagtgtctatcatttccatctttacaaccatgagtacccagagtttagctccctcttacaagtgagaacacacagtatttggtgagaaataaggattttctttttctttctcttttcttttttttctttttttaactgagacggagtctcactctgtcacccagtgcagtggcacgatctcagcttactgcaacctgcacctcctgggttcaagcgattcttctgcctcagcttcccaagtagctgggattataggcacgcaccaccatgcgtggctagtttttgtatttttagtagaaacggggtttcaccatgttacccaggctggtctcaaactcctgacctcgagtgatctgcctgcctcggcctcccatagtgctgggattacaggggtgagccaacatgcttggctgaaataaggattttctagaccaatccccgcaggtggattccttaatatgttgccttttagtgtaatcttccctaaagtgtcttagaagattctcttctgtggttggatgacgggagaatccacgggactttactgttaggaatcacctgtgctgcgtctcatttctggaggttctcaacccacttgcatattgaaggctccaggaagttgtatggaaaggaaatctgttgtattctgccaaactcagactttccagacttttttttttttttccattattaaggcaattttttttttggagatagagtcttgctctggagtgcagtggcacaatcttggctcactgcaacttccgtctcccgggttcaagtgattctcctgcctcagtctcctgagtagctgggactacaggtatgcaccaccatgcccagctaatttttgtatttttactagagacagggtgttgccatgttggccaggctggtctcgaactcctgaccttaagtgatccactcgcctcggcctgccaaagtgctgggattacaggcgtgaaccaccgtacctggcctttttctccattattaacatctccagaaatagtgattccaaggagctctgataccccaccttcaacagtcctggccagaagtccttaggtcgcctccatccatgtcagcgtgacacaggtgtcacatgccgtccactctcttctctctgaacaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcaggtaggcgggggtgaacaaggagacaccgggtaaggtgtcctaggcgccatctcggtaggggtgtttgaagattctgtccagatctgtgtcacctggatttgagtcccagatgaccatttgtcccttcacctcttggagcctcagtttctgtatctgtaaaacgggtctcaatccaggctctttgtaccatgaggtagaataaccaggatgaccagtacatttccttttatacacaccagctccattcagttgatagtggctgtcagttgttaagctatggaaagtcttctgtaccagttggtcactagcactgctctgagcccccaggtccccatgcactaccccagctgtcttggtctctaccaggatcctggagctctgtccatgacccagcaactaaagcattaatgcctggcacaccagcggaacctctggggtcctgctttggtggtgtttgttagtgcctggttctggttctgttatccgtctccatgacaaccaaccataaagcctcaggcatgttcaaccataaagcaacgatcattgctgccatacgagggcagtcagccaggtggctctgctgatctcggctgggctcacatgcatgtctgggagtcagctggctgttggctgatctcggggtcagctggcttttggcctcaggtggggcaagaagggtatgttccgtgcatccctcattctccagcagaccagcttgggcatgttgtcatggcgatggcaggggcacaagagcgtgcaagcccctattgcatctaacagtattcttttggctgtccttacttttgctggtgtcccattggccaaagcaaggaacatgtctgattccagagccacctctcatggccccacagttggataagggatgcatgggtatgaggccttttttttttttttttttttttttttttgagacggagggtctcactctatcacccaggctggagtgcagtggcgcaatctcatctgcaacctccgcccccaggctcaagcaattgttctgcctctgcctcctaagtagctgggatgacaggtgcctgtcaccatgcccagttaaattttgcatttttagtagagatggggtatcaccacattgtccaggctagtctcaaactcctggcctcaagcgatccacccgccttagcctcacaaggtgctgggatactaggtgtgagccactgtgcccggctcttattttttttttattttattttttttaagagacagtgtctcactctgttgcctaggctggagtacagtggattgatctcggactctaactcctggactcaagcaatcctgcctcagcctcccagtaactgggactacaagagcatgccaccacacccagctaatttgtttatttttgtttttggagagatgggggtcttgcttttttgcccaggctggtctcaaattcctggcttcaagctatcctcccacctcagcctcccaaagtgctcagattgtaggtgtgagctgctgttttgagaatgattctgaacctgcatcttgctgaataggagatgtgctctgattgattagtgatgtctgctgcagacacagatgttgggagtggacatgctttcctggtcaagcaacatagagtgtctcctttcgcttctcccagcctgggcctaggttcagggtcaggggtggtttgacccaacactatctcctggtttttttcttccggtcaagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaaggtgatgccactggcacagtggcctctaggctttgggagtttgccttactcactggctcactcattaattcattaattcattcaacactgtccttatccctagtgacagccccagtgggtggatcctctcttcatcctggatggtaccagctatttctttttttttttttttttttgagacagagtctcgcttcatctctggagtgcagtggtgtgatctcggctcactgcaacctctgcctctggggttcaagcatttctcctgcctcagactcccgaatagctggaactacaggaatgtgccaccacgcccatctaacttttatatttttagtagtgacagggttttgccatgttggccaggctggtctcgaactcctgacctcaggcgatctgcccgcctccgcctcccaaattgctgggattacaggcatgaaccgctgtgcccagtggtaccaggtatttctaatatcatctagtcattcattcacgtcagcgcacctgcggtgttcccagacactggggactctgtaggctgctgtcagacaaagtccctgcctccaggaccaagtagcttattagatggaggagacaaaaaatatacagagcaataaaccaacaggattccagagggcagcaggtgctgggaaggacgcttgccaaggagacgggatagcgagtgctgggcagggccactgtttccattgaacactgcaggcccagtgcgtggggcccacaaaaaggttttattttttttaaaaaatcagaagcaggccaggtgcggtggctcacggctgtaatcccagcactttgggaggccgaggcaggcagatcacctgaggtcgatagtttgagaccagcttggccaacacggtgagaccctgtcaccattaaaaatacaaaaagtagccaagtgtggtggtgcgtgcccataatcccaggtacttgggaggctgaggaaggagaattgcttgaacctgggaggtggaggttgcagtgagctgagattgtgccactgcagtccagcctgggcaacagagtgagactccatctcaaaaaaaaaaaaaaaaaaaaaaagaatataatccaacctggattttatttatactaacacagtcataaaatagaatttctagcattttgtgtggagaaagccacctccgtaggcatcagtgccggggaccacaaaagtcagaatgctgccatagtgccagggtcctggggggttttgagttttgtgtgggtcatctctgaagaggtgacattttagctgagacctgaacaatgaaaaggagtcagccttgagaagatctgggacagcgatctgcaaccttgttcttaagggccggggtagtttcagctttgtgggccacatggcctctcagccacttgactccagtgttgccgtgtgaaagcagtcatagatagtgcacgaatgaatgagcatggctatgttccaataaaactttattcataaaaacaggcaaggggtcagatttggcctgcaggccacagtttgccaaccttggatctaaaggaagaacattctaggcagccggtacagccgaatgtaaaaatgaatgcgcttaatgaatttgaaggctagcatgaggaggccatgtacctagaggttggaattgagtggacaggggcaggagattaggccagaaaggtaggcaggggctggatcttagagcaccatgtaaccacggtgagaagcttggaacttactctaagagccctataaagccattggaaggttttaagcagggaagtgacatgagtttctattttattttatatatttttgagacagggtctcaccctgtcgcccaggctggagtgcagtggtgggatcacagctcactgcggcctcaagtgatcctcctgcctcagccttccaaagtgctgggattataggcgtgagtctctgcacccagctgacatgatgtttctagttcactgagtaccacctactaagtggcagatgctgagttggtgcttttgaaatataggacatagaaatgaggacagaagtgggcagtgtcaaatcttacaggacctaaaatattaggggtcagccaactatggcccacaggccacagatctggccccctgcgtgtttttatgaataaagttttattggcacgcagccacatctgttcattttcctgttgtctctggcagctttcacactataaatacagcagagatgcgtagttgtaacagaaagcatatggcctgcagagcctcaagtatttactatctggcctttttcagaaaaatgttgccaatcgttattgtagactgtggtaagatctttttattttactctgaatgtaatggaacagtgaatgtgaacagtcaacactgttaataccattcacaccatgattgatgtggggtagatattaaggagctggcctcatgggaatctgacattgactagaaatagggattgagggtgagcaaccagctggaaggtactgcaccagtcctagcaaaaagtgttaggggcctgacccgaagcagtgacttgcccaggtcagttgtcccaggggcacgaggtgctcacccctccccttcccctcatgtctgtatcccctctccctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaatggttccctttcctttggggcctcggcgagggttccagccatgtcctctgcagggtcaggatgtggcatcttcctgtttctgttctttccttttgacaacaagtcgcctctagtgggagctgttgccagaaagggcaagttgtagagatcactagtcagatggggtttagtgggaaggcgggacagccgcaaggtggacggagcccaggttttggggttggacagaccctggcttgagtcctgctcttgtcatttgctgttcttgtgaccctggggaagtcactcagcctctgtgcctcacttgctttgtctgtaaaatgaggctgatcgtacttaccctgtgagcagtgatgtgtgcggtactcgtagcctcggtcaggttctaagacacaggcgaggcagaaatcacatgtggccagaacgatccttgaaaatcctgccctccccctgcccttttttttttttttttttttgctagaggcacggtctcactctgttgcccaggctggtgtgcagtggcacgatcatagctcactgcagcctcaaactcctgggcttacgcaatcttcctgcctcagcctcctgggtagctgggactacaggcatgtgcccagctaatttttaaaaatttttatagagtcagggtcttgctatgttacccaggttgttcttaaactcctgggctctggggatcctcctgcctgagcctcccaaagtgctggggttcaggcacctggcctgaaaatccctttatgttagtccagagaggcgaggctgcgctgcagtaacaaattcgccgtaaaatcttcggaaatgatcacaaggctttatttcttgctcacgcagttcttggtgagggtcagctgcctctccagggtaggtgacttccctgtgacaagtgatccaggctgtcctggttttgtgacatggcctcccaagggttggcctccaggtccccacagtgggagaagggagagtggacgactctcacccactcttctgtgtctgaaaccggaactgacgcagttaatcccactcacagcccattggccaaaatgagtcacatggccccaacccaaccactgcgggagctgggaaatggagcggtgcctgtggaagagaaggatttctccctttcctaactgatgtggttctggagttttggatagcggagtagtcagactagtgtgttcggtttctaacttcgaactgggtgagtctgggcagtaaggaatgtctgtatttggggagcacaccatttctgccacacctaaaaccatgcaccaagtacatgtgcagatagaacgttctagcactgccattgttccctcaagctttcctgtcccctgattgaaattgttggcttgcactagggactgtggtgtacaaaggtgctcagggaagagccggcgaggtggtgaccattagaatgagtagtagtgtctgggtgcagtgactcatgccccattgaaactgttggcttgcattagggactgcagagtgtgaaggtgcctagtgaaaagccagtaaggtcataaccattagaataggtagtatcagccagccgggcatggtggctcatgcctgaatgatgtcattggcttgcattaggaaccacagagtatgaaggtgcccagtgaaaaactggtgacgttgtgactattagaattagcagtattggctagacgaggtggctcatgcctgtaatcccagcactttgagaggctgagacaggaggactgcttgagctgaagagttcaaaaccagcctaggcaacatagtggaactctttctatataaaaactttttttttgttaaattagaagtagttgaggctgggtgcagtggctgacgcctgtaatcccaggactttgggaggctgaggcgggtggattgcctgaggtcaggagttcaagaccagcctgatcaacatggtgaaaccccgtctctactaaaaacacaaaaattagttgggcatggtggcacatgcctgtagtcccagctactggggaggctgacaggagaattgcttgaatgtgggagataaaggttgcagtgggctgaaatcaagtcattgcactccagcctgggcaacagagcaagccgagactccatttcaaaagagtagtagttggatctaccagcgggaatcttaatagggatgtgagatgtgtttagatctcaaagcctgaccctgagtcttaaaatcccaggtcagatcctaagcagtcccagagagctccacctggtgtgcatctgtgccagtgtcttggggtggggcagctgcatgctcaggtggaatccggggctgagttcaagtttaatccactttatgaagaggaggcagagtgaggcataactcctcatccaggggagtggaagtactgtggaaggaagctctgttttgtacctactacgtgctggccctggcctcactgtgcagaactctccacattggaaaggatccccccagaccagagaggcgtaaggagggggctggtgctttccagtgttgaactgttcatctgtcctcacacccaccatcgggtcctacagcaaatttgtttgattttctgcaaaacacccagaatctatccactccccgtcctcccattgccaccacgctggtcccagccaccccactttctccctgcatccctacaacagctgccacagtggtctcgaggcttttgcccccagccccccacacacacatcagtgtcctcaacctggtggctgtagtgaccttatgaaaacacgcactggccgggcacggtggctcacgcctgtcatcccagcactttgggaggccgaggcaggcagatcacctgaggtcaggagttcgagaccagcctggccaacatggtgaaatcctgtctctactaaaaatacaaaaattagccaggtgtggtggcgagtgcctgtaattccagctacttgggagactgaggcataagaattgcttgaactgggaggtggaggttgcagtgagccaagatcacgccactgcactccagcctgggtgacagagtgagtgactgatggtgaggacacgggctctgaagccacactgcttgggcagagatgccactcattctgtttgttttctcatctgtcaaaagggcctgatggtagtaccttcctcatcaaaacgttccagtaaggggcccagtgaggtggcttcctcctctggtccactgaatgcgtgcgtggcgggcatttaaagcagtgtcaggtatacgtagttacgtgtttgcagtggcgaggtggactgttgagttttaaagagtctactgggcgcaggcactgaccagagaggaagtctgcagccttgatggatgaaattcgtgttccacccaccagccagaccctactggcagcagcccatggcgggggtattaatggcctgggcatcccctctggcgcgtctccagactgccgtggtgtgggcccaacagcagtctcgttagcaggctggcaggtgccggttcccacgtgctggccgcctgtggcccaccctctgctccctggcacacagcctaggaaagagagtctggtggccctgggtcatccccagctgagtttgccaaatgcccacatggcagcccctgcctagggtcactctgcaaggcaggtggctcagctccagccagagaagacaggctgcatctgccgcccttcctttctctaaaggacaaatgtgtcctgtgcaatgactttggtattacacccagaaacagatccccactctgtccttactgactgggtcaacttggcaagtcatgtcaaccccttgagcctcagtttcctcacctgtgaaatggagctaggaataggtagttgtgggtccacagctttgcaggcatgactaggggcaggtcaagaatgcggacttcctgccccactttgaaggtggtagaagctgcagttagaagtttactccaggccaaaaggggcatcacaaaacctgtgaggatgggccatcagaaagtcccatgacctgatgggcggagcaggccctgtgtccttaagaaaaggtggagttcttgccctgccacccctgacaccagcaaagccactgctcaagtatctgtggatgatggatggcagcggggcaggttagaccggggattctcaaccaagtgggtctttttgttttgtgttttttcagacagtcttgctctgtcacccagcctggagtgcagtggtgtgatcttggctcactgcaaccttctctgcctgggttcaggcgattctcctgcctcagccttcagagtagctgggattataggcacctgctaccacacccggctaatttttgtatgtctggtagagccaggggttcaccttgttgtccaggctggtctcgaactcctgacctcaagtgattcacctgcctccgcctcccaaagcactgggattacaggcatgagccactgcacccggcccaactaggtggctttgaccccctgggggattaatggcagtgtcacaagtctggtggcggtagaaggaggatgttattggcatctagtgaagaagaggccaggggcgctgctgaacgtcctacgatgtgcaggacatgtccccacagcacagaactatctggccccacgtgtcaataaggttcagaaagcctgggggattgccttctgtgcttccacgaacacatatccatgtattatgtcattcttgcggcaatgccacgaggtcagtgagactccctgactagcatacataatgttaggatctagggagttgtctaatgtctcacgctgcccttcccagcgatctatgtgtggccttaggcttggctactttagacttagtccctcttttccggtgcctgcagctggtttggtgagtccagtattaatatactgaccgctgtcagaaagaggagtgaggaggctgggcatgatggttcacgcctgtaatcccagcacttttggaggccgaggtgggcagatcacctgaggtcaggagttcaagaccaacctggccaacatggtgaaaccccgtctctagtaaaaatacaaaaataattagccaggtgtggtggtgggtgcctataatcccagctacccggcaggctgtagcaggagaatcgcttgaacctgggaggcagaggttgcagtgagccgagatcttgccactgcactttagcctaggtgacagagtaagactctgtctcaaaaaacaaaaaaagaaatgtgtgaggaatgcaacaagctgtgcattgaccacccttggttacagcaagttctccacgctcagccgggtccagcctttggctgtcagcagcatctggagcggaactgtgaacagaaacactccaggtgttccgacgggtgctggggcgcccccagggagctggaatttggtttttagcaaccacatataggaaatgaacccgccagccacagtatctcacgcctgtaatcccagcactttgggaagctaaggccagcggatcacctgaggtcaggagtttgagaccagcctggccaacatggtgaaaccccgtctctactaaaaatacaaaaatcagctgggcgtggtggtgggcgcctgtaatcccagctgctccagaggctgaggtgggagaatcgcttgagcccgggaggtggaggttgcagtgagtcaagattgcacccctgcactccggcttgggtgacagagtgagactttgtctcggacaaaaaaaaaaaaaaaaaaaaaaagaaccaagtcctcgggcaaattctcccattgagggctgtgaagtcttggctcctctgttgtttgttttggaaaccaaacttgcatatttgactttctcatgcgtggagaggacccatgcttggcatgggggggcacctggtttttgtgtccttggagctcatctctggtgggggaggaggagcagcaggagatgcgagggctgtagttctcagtcctggccgcacattggaatcctatgggggagctttaaaattatacaccaaactcggccaggtgcggtagctcacgcctgttatcccaacactttgggaggccgaggagggtggatcacatgaggccaggagttcaagaccagcctggccaatatgctgaaacctcgtatctaataaaaattacacaagttagccaggcatggtggcgcacgcctgtaatctcagctgcacgggaggctgaggcaggagaattgcttgaacccaggatgtggaggttgcagtgagctgagattgagccactgcactccagcctgagcaacagagtgagactctgtctcaaaaaaaaaaaaaaaaaaaatacacacacacacacacacacacacacacacaactggagaacagagcatggtcactgggggcaggagcgagagtgatgggtgtggtcggaaaatggtggtggctattccgtatcctcaccctggtgtggattcatgagcctacatgtgtgataaaactgcatgggacaaaataaacacacacacacacaggagtacaggtaaaacgggaaatcgagcaagattgttgtgtcaatgtcaacaccctggctgtgatgctttatcctagagttttgcaagatgttaccattgggtgaaatggggtaccaagtacacgaatctctctatattattgtttctttaactgcatgtgagtctgggattatcccaaaataaaagtgttaatttgtaaaaagtacacacagcatggcagttcccagcctcagagattctgatttaagggtctagccgggagcctgggcatgtgcttgaggcccccaggtgagtccagagtacagcggggctgagagtcgctgttgacattggctgcagggtggacagggcgagatgggccctgcccgggcagacctgtgtattgctaggtccttccggctctgatgctctgtgataattggccactttctctgccattttcctcccagagagcaaacacaggtctagactcaatatcgtgtggagctatcgatgaccacgggtcacttccatctccagcactgcaggctgtgcgggctggtccaactggggtacggttgagggtcctggctcagaccaggcctgactcctgggccagtctgtaaaacaggcccttctgggccagcagctgggccgggctgccgctctctgccacctgccccttgtccatgaccagaaccctgtgggggagagggagacagagaggctctttggacaccagcccaggctctcggcagctgtgagagcccagtgtgtctgcgctgaggttttctccatagaagtcctgctttccatgcggctccctggccctcacagctgggttggaagcgtgtgctgggcgcatgtccttgggcagctttcccacttggcatgtgttcccgggcattcctcccgctctggccccattcaggacccctccagctctaacccgaagcccagtggcccaggactgcctccgcctccttcccccaccactgcagggctgctgtgaggtcaggccggggcgggagccttaccgggcacagtccatcacggagcgcaggcggtgggcaatgagcagcacagtgcactgtgcaaaccagctcccgagcatggcctgcatctgcagctccgtgccagggtccacggcagcagtagcctcgtccaggatgaggatctgggtcttccggagaagggcacgtgccagacacaggagctgtttctggcccacgctgggaacgattgggacaattagctgggacgtgcgtttgtcggcacatggtgatgtgtgggtgtgcccagaaacaggtccctgaagcagtgcaggagtgaggtgcctgtgttcaggcatccccacacatggggtctggggtctgtggtctgcagaactgataggaagcctgttcctgccatctttgagcaggctgactgtaggcaggtcattcaaaccctttgtgcctcagtttccccacctgtgaaatggctattttcttttttctgtttatggctctttttttcttcttcgtttttctttttttttttgagacggagtcttgctctgccacccaggctggcgtgcaatggcacaatctcagctcgctgcaacttctgcctcccggttcaagcagttttcctgcctcagcctcccaagtagctggaattacagtcatgcgccaccatgcctggcttttgtatttttaaagtagagatggggtttcaccatgttggtccgacttgtttgaaactctcaggtgatccacctacctcagcctcccaaagtgctgggattacaggcgtgagccactgcgccccggtagttctatttctagtttgttttttgagaaatcatcatactattttccatagtgactgtactaatttatatttcccccaacagcgaaagcacagctttcacttcagtcatgccgttgcaaacaaacctacaatgactgactgctgcttcaagaatcaaatctacagtcttcctaagacattcaaggctggtgtcacgtgggccttaaatacagatgtgtacaacacctgggtgggattccaggcgtgatccaccgtgcctggcctgtttatggctatgtccagttctatttctagtttccaccttgtgccaaacacattctaagtgcttgtatatattcactcaatcctcataatgtccaccaaggtagatattattgttctcttcttttgagagaagaggacacagatacagagaagctcagtggcttgaccaaggtctcaaggctagtggtgggtccataatttgaacccaagtcctctgaccccagagtctgtgctcctaatggatccgtcctcgctgaatcgtgacgacatggcacataaaagtgtgtgggtggcggggcacggcggctcacacctgtaatcccagcactttgggaggctgaggtgggcggatcacgagatcaggagatcgagaccatcctggctaacacggtgaaaccctgtatgtactaaaaatacaaaaaattagccgggcgtggtggcgggcgcttgtagtcccaggtactcaggaggctgaggcagaagaatggtgtgaacccgggaggcagagcttgcaagtgagccaagatcgcgccactgcactccagcctgggcgacagagcaagactctgtctcaaaaaaaaaaaaaaaaaaaaaaagtgtgtaggcttgtcacagaataagcccttggcatggagtagcacccttcgtggagggtggaggagttgagattccaggttgtgagcccagtgagcccctgacccaggtgggaactgacccctggggccccagcatggctgtcttgcacagtaagcccttccatgaaacagcatccttttacatgatcagaacctactatggtcatgcaggcgttagagtgcctgggtcttgtcccaacctcactacttttaagctgtgtgacgtcaggcaagccccaggcctccaattccaactctgtgaaatgatgttatcaggagtgtgactcaggactaaaatgagtatttactctttgctctatgcctgccactgtttcaacaactttgtgcatataattcaatccttgcaaggtaggtaggtgctattattcccaccttacagatgaggaaactgaggcacacaagataagttgcctaagatcctacagctagtaagtggcagggcggggcgggggtgggggtgtggggtggggggcctggatttgagcccaggcagtctgtcacctgtgtatactcttacccaccaagcaacgctgcctctctagtgctggaaattattgcctaccacaagcccttcggacaccctcagggtcagaggggtttataaatccagaacaccttaggtttttttttgttttttttgagacggagtcttactctgtcacccaggctggagtgcagtggcacaatcttggctcactgaaacctctgcctcccgggttcaagcgattctcctgtctcagtgtcttagcctcccacgtaactgggattacaggcgcctgccgccacacccagctaatttttgtatttttagtagagacggggcttcaccatattggtcaggctggtcttgaactcctgacctcaggtgatccacccgcctcggcctcccatagtgctaggattacaggcatgagccaccgcgcccagccactttggtttttctaaaggcatatacctatacacctatgttcatagtggcattattcaaaacggccaagaggtggaaacagcctgggtatctactggcagataaacggataagcaaaatgtggtctatccatgtagtggaaaattattcggccttaaaaaggtagagaatctgacacatgctacgatgtggatgacccttgaagacatcatgctgtgtgaaataagccagtcacaaaaggacagatcctatgattctgcgtctatgcagtgtctagagtagtcacactcagagagacaggagaatgctggtggctgggcgctgggggaggggacaaggagagttagggtttcatgggtacagagttgtagttctgttgtgtaacagtgtgaatgtacctaacactacagaaactatacactgaaaaatgggtgagatgggcccggcgtggctgctcacacctgtaatcccagcactttgggaggcctacgcaagttcgactgtagcctgggcaacatggtgaaaccctgtctctacaaaaaataaaaagattacctggccctggtggctcacacctgtaaccccagctactcgggaggctgaggtgggaggaatgcttgagcctgggaggtggaggttgcagcgagccttgacctcaccactgcactctagcctgaatgacagagccagaccctgtctccaaagaaaaagaaaaaaaaaaaaaaaggttgagatagtaaattttatgtgtatctttccacacagctttttgttgttgagacgaagcccaggatggagtgcagtggtgcaatatcggctcactgcaaccttcgcctccctggctcaagcgttcttcccacctcagcctcccaagtaactaggactacaggtgcatgccaccatacctggctaatactgttgtccacagagatagggtcttgctatgttgcccagactagtctcgaactcctgggctcaagcaatcctcctctctcagcctcctgaagtgctgggattacaggcatgagccactgtgcccagtccacacttgacatttaccaaaaaaaaaaatcctatattatagtcccagtgagtggtgaggttaccacccgatatcaaacaatattttcatagcaaaataaatactgagcaagagcaataaaggctatcagtagccctgtgtcagttgaggttgggttttgccaccaagtaaatatagaagactaactgctaatttaggggggaaaaccttggtattcagagactgtgtcagagcttggaattgcagataagagacatgtggttattaatgtaacagagtgataatcctatcgggggaggcatttcctgaaggcccttggggagggcatggccatcccctcctctcccacctgcaggtcccagccatggtgggacgaccatacctcaggtcctcgcctcggtcagcacacttgtactgcagctggccgggcaggctggccaccaaggctttgagctgcaccgtctccagggctgcccagatagcctcgtccgagtgctcctgcagcaggtcgaggttcatccgcagagagccagggaacaggatggggtcctggcggggaggggcggtgggtcagagccgggtcccaccatgcctcccatctttgcccaccccctccaccagcctcacctgggggatgatgctgatcctggagcgcagtgtgtgcagccccacgtgggcaatggggaccccgtcgatccagatcccaccctcagctgcctcctggagccgcagcagcccactggccagggaggacttccctgccccggtcctgccaacgatgcccacctgcccggggttgggaggaaaggcctgctctgaccagagggtttgtgggcatttattggggagatctttctgctgtacccgagatctgtctatccatccctcattgtgtaaaggtctaccttccatctctctttccatctgtctacctttctatatatccacccatcaatccatccagtcttccatctgtgttcttctctatctttcccttatcctgatatctctctcccatctttctccccacccttcctttagttcctccatctttcctcatccttctatttacacctctccatcatctctcatccttttttctaccccatcccatccatctgtctgtccgtccatccatcccttatccttttttccaccccatcctgccatccatccatccatcatccatcctcaatcccatccctccatctctcttccaccccattccattcatccatccattcatctgtctatccgtctctcgtttcttcttccctattcatccatcaattcactaatcctttcattcatttattttctcccatccatccatccagtccatccttccctcatccatccttccattcatcctccatcttatccatgtgtccattctgttatccatctcccatgctgttatccaccctccatccttatctctcttgctactattgcatcctcagtgtctgacacatggtgtgggttcaacattatttgtttaattaatgatggaaacatgtgggtcaccccactgtatgccaagtacctgtttaggcaccggaagtatagaaattaaagagtccttgctccagtgtgcccatcatccggtctaggaaacagtgcaattgagtaaatgtaatacagtgtgatgaacaatgctttatttatttatttatttatttatttttgagataaagtcttgctctattgcccaggctggagtgcagtggtgcgatctcagctcactgcaacctccacctcccaggttcaagcaattctcctgcctcagcctccctagtagctgggactgcaggtgcctgtcaccatgctcggctaatttttgtatttttagtagacacgggatttcaccatgttggccaggctggtctcaaacttctggcctcaagtgatctgcccaccttggcctcctaaagtgctgggattacaggtataagccacagcacccagccaacaatgctgtttattatcaaggtctggacctctggcaattaagggaagcaaggcagtgctgctcatgctgcctgggatttgacagaggtaataagagaagacctcatggaggaagggatacttgcatggaagcttgaaggatcaataggagttcaaggaaggggaacactccaggtaaaccacaccaagtgggtttccaaaactagaagctcatggagctcacagcaccatgtgcccccctggccgagaggcagctgctccacaatgttggctaagccctggcagagcaatgaatgagagggggaggttggcagggcctgggttgggtagagccttgaatgccaagctcaggaattcacactttaccccaagggaagctggaactagtagaaggttttgagcaggggaatgacatgcagtgtcattcatgctgataaaggtcacaggatggctgggcatggtgggtcatgcctgtagtcccagcactttgggaggccgaggggggtgattgaggtcagaagtttcatagcagcctggccaacatggtgaaaccctgtctctactaaaaatacaaaaattagccgggtgtggtggcaggtgcctgtaatcccagctactcaggaggctgaggcaggagaatcacttgaatctgggaggcggaggttgcagtgatctaaggtcacaccactgcactccagcctgggcaacagagtgagactctgtctcaaaaaaaaaaaaaaaaaaaaatcacaggagagcagattggagctggtgagacaggatccactgctttttaggggacaaggagaggacagggaggaagcctctgtaggttcagagggagggaggaaagggattcagtgaaggggcctgatgaggcatctgtaaaatgggatagtactagcacctcacttaggggttgttgtgagagtgaaaacgcaaataataaaagcattagtaaacatttctggagcactttctatgagctaagcatgttctatgtattaactcaaacttcacaacaactcagagatcagtattaccagtcccaatttacagatgggaaaactgagactgagctatgaagtgcttttcccaatgtctcccagctgaaagcaaatatcccatttgtgcaaactggaaaatgtacctggagcatttaacacactgcccagcacatattaggtgctgggttaatgttaaaggaagaaggaagtcacggagttgcttcctcatctggggacaccaaggtggatgaggaagtcaccagatggaagcaggtttggggaaggtgaggagttcattttagggggtaatgggtctgaaagctaggggacctgaggtggggacactgtggaggtggctggtgcccagggtttagggccttgtccctggagtcctttggcctaaactccatgaagaagacattgtgagagaaccactcaccttctctcctgcgtggatcttgaaggacacgccctgcacagccagcgggagctcaggtcggtatcttagcccaaagtcccggaactcgatctgcccgccctgaggccaggggggctgagctgcacatgtgggcagcctccagggagcctggagcaggaggggaaactgagtcagaggagccttcctctaagacttcacacaagatggcccacctctatcagcttcagttttctcttccgcaaaatggacgtatttattgctgttttacagggttgttatgggaattcaacaagagagggcatggactatgtcaatgctaaaaacagatggtggtggctacttttagtctattttattgttattattagccactgtttattataaaataatctctttttctatagtgggagcagacatttctctttgtctttgtgaaaggacatgactgtgcagtgggaagaccaatactgcctttgctgttcccgtgaccttgaacagatcattctacccccttgagtcttggttttccaatctgggaaatagggctaataagagcagcagacatgtattgagtgtttgcaatggaccaggcactctattaaatcatttctttgcaggatctcatttgatcctcccagtaaactcaacgctgttatgttactgttacattagtgctatgctgctgttcttatcctttcttccacccaatcccatccatccattcatccatccatctcttatcctttatccaccccatcccacccatccatccatccatgcatccatccatccatctccaatcccatccctccatctctcattcttccatcccattccatccattcatctgtccatctctcaccatttcttctaccctattcatcaactaattaattcttccttgttctgttactgtaatgttactgttatattgctaacacattatatcatgttgctgttttgttaccgttgcgttgctatgttgctgttctgtccttataatgctactgttatgttgctggaattttgccatcatgttactataatgttgctgttttcttactgttacattgccatgttgctattccgttactataatttcagttattttgctggaatgttgccatcatgttactataatgttgctgttttgttactgttacattgttatgttgctactctgttactctgttacagtcgtgttgctgggatgttgctgtcatgttatgatgttgctgttgtgttactattgcattgctatgttgctgttttgtttctatcatgttactaaaatgttgctattacgttactattacattgctatgttgtggttgtattgctggaatgttgccatcatgttactataatgtctctattatgttactattacactgctatgttgctattctggtactgcaatattgtggttatgttgctgttacattactgttacattgctgttgcattactctcatgttctggaatattgccattgtgttgctgttgccattatgttactatcatgttgcagctatgttgctgttgcaatgctgttccttgtggttccctgcactcccatgggtgacctgctttcctcaagctcagaagcaaaggaaccaagatttggcctggctccaaaccttatgctcctaaccactgctgccaccctgtctgtgactctgacctatagtggtgggggttgagtgaggggagaagagggtataaactccaaagcctgtagcagatgtcaacagggacccattgcccccccccacaatatgtccttgctgggaccccctccccacctcccgcccatcacctccttgggcgtccaggcatagtcctgcatccgctccactgacacgatgctgttctctaggtctgtccagttgcgaacaacccactgcagtgtctgggtcacctggtgcaagaaagcctctctggctgggtttggcaaggccacttgagggcttgcaacagcccccctggtttcccaaccttttctgggaggccagacccaggggagtaaagaggggaggcaggaatgggacagtctgaggacctgggcccaggggattgggatttggatacaaccaacaggtccctctcttccttcagtagaaccagagcatgcagagcaaaaagaagccctcagacatcagcttgtacaaactggcttgatgcaggtgagtagacaggatcagagagggtgtgtggccctcccaaggacacacagcaggacccaggcccactgattccattctgacggctttctcgcagcgactgggtggccaccaatttcccatgacacttagaaccactccaagctcctccctatgagccattagcagctctagccctgccatcccatccccaaccttgtctcccagcacccctgccttcacccaccctctccagccacacccgtcttcttgctgttcctctaacacaccagggatgaaccttcaactcccaggccttttcttcctgctgttaacctcacttcctcctaagtcacctcctcagagaggcctttctggatgcagtaggaaagttccctcactgccacccaacatgctccagcctcttacttcatccttaagcttagcagccttgactgtaaaatgaggataataacagtgcttctctgatggggttgtgggcagtattaagtgagttaatatttataaaattcttgtgcacagtggctcatgcctataatcccagctttttggaagtctaagcaggaagattgtttgaacccaggaattgaaggctgcagtgagctgtgatcacaccactgcactccagtctgggcaaaagagtgagaccttgtctcaaaacaaaacagctgggcatggtggctcacacctataatctcagcattttgggaggctggggcaggcagaccacttgaacctagagtttgagaccaggttgggcaacatggtgaaactgtttctaccaaaaaaaaaaaaaaaaaaaaaaaaaaaattagccaggcatggtggtgcatgcttgtagtcccagctaattgggaaagtgaggtgggagaatcccttgagcctggagatggaggctgaagtgagccaagatcatgccactgcactcaagcctaggcaacaaaatgagatcctgtctcaaacagcaacaacaacaaaccaaaacgaacaaaaacatataaagctcttagaataatgcctcctccataacaaatgcttatgagtgtatatatatatttttttcatagatgtcatgaactgacattacatactgttaatagttaacaaaaattagccaggcatagtggctcacgcctgtaattccagcaacttgggaggctgaggcataagaatcgcttgaacccaggaggcagagttctcagtgagccgagattgcaccactgcactccagcctgagtaaaagagagagactctgtcttcaaaacaaaacaaaagttaacaatgcactagaaatgtcctccacaggatatgctttgtctcaactagtctttataacatcagaagtagtgggatttctggcctgtctttccaaggagcacactgacactccacaaggaaagactcttgcccaaggttgcaagttcaccttagctgagtctggctcttgtagagctgcgtgtccctccttggtggagggactccacacaccatgttggtttggacacagggtcttcaaaggtcccactagcaggggtccgacagtctctgcctctgtctgtccctcaagcccagtttggggatgtggggagtacctggagggcagcagagacagagaagcccacgaggccagcactgaggtgggctttgctcagcacagcacacgtggcagctgcaaacaccaggccattccccaggagctccacattggccgcaagccacctgcaaagggaagcgacagcagggtgagtggttactctcatctgcagggagatgcttctctgggcacaaggactggtcatcacaccagctttgtacacacaggggtcccagcaatggcctccacatgcaacccaggctcagggagtagaggaagatgacaccgtcctgtctcaactaagcccactttagggtctggggtacactcggtgttctgaagagcatccctgtgtggctgcttttctgtccctggaatttgccaagccatgtccacctgccattcccctggcctgaaccatggcctccatggtttggctctgtgtccccacccaaatctcatctcaaattgtaatccccacatgtggagggagggatctggtgggaggtgactggatcatgggggcagttttccccatattgttctcgagatagtgagttctcacaagatcatatggcgtaaaaggatgcggcagttcccacctcatgctctccctctcctgctgccatgtaagacgtgccttgcttccctttccaccatgattgtaagtttcctgaggcctccccagccacgtggaactgagtcaattaaaccttcctttctttataaattactcagtctcaggtagttctttttagcagtgtgaagatggactaatacacagccccagctggctggggacctgagatgaaaggaaaaaggacttcacatgtattgagcacctagtgtgtacttgaccctctccacactctggtaccagactgcttggattcaaatcctggctctgccagtattagctgtgagaccctggacaagtttccaaacctcactgtgcctaggatttatcatctatagaacagtttcttcctggtgaagctgttagcagaattaaataaattaatctacatagattgctcagaacagtgccaggcatgcagtaagcatgttacaggtcttacctatgagtgtctgtatttaatcctcatatccactccatgagcacgatcccagtttgacaaatgaggctcagagaggttatgtaacttgcctgaaatcaaccagctggtaagtggcagagctgggatttgaacctgtgtctatttgtgcttaaagcttgtgttcttgttcttgcttagtacctaaagatggctgaggatgcttatatggctgctttatcaccaaggcaaaagaggttgatccagttgcctggcaacagaagcttcttcctgtaccccccgcccacctgctgttgagaatctctcggtcatgttccatctgcccacggtgagaactgatagactgcctgtgggatctagcctcaactatgtccctgactctctgggtgacctctctaccatacaatatgacctcaggtctcaccctctaaggatatggatgaattgcaaggtcttctctgccctggctcttcctacctgtcagccaccagtcgcgggaaactgatcctctggctttcatctacgcgagcattgttctgagccacaaagggggcctgggttcggaatgcccggaccactgtgctgccctggaacgtctcagccatgtgggagcagacagacgagtagctggctgactccaagcgtctcagctggcatgagctaaccacatacaggctctgagaaggatggatgggagagggaagaggagaagccacagacatagagaggtagtttccagaagcacagagagccccaagtacaggattccagaccaggatctgttaacagcttactgtgtgaccttgggctagttgcttgccctctctgggttctcatttccttgcagaatcagagttctatggtttttttgaaaatcacctggggagcttcaaaaacctctaatgccccaccccagaatgactgaatcggaatctctggaaatgtcaccttgactttggtgctgtttaaatagccttccagatgattctaagggacagccagggttgagaaaccaccaatttagtttaagtgtctcacttcccagcactgaggccgactacttcatttacggctggtcagtgggagaacaaaactgtaaggggcaatgaaggcagttggccaagtcagtttcactcatgtaacccaagggttacatgccaggtgatgtgcagaaaatattcgttatttggtttgcagctgcaggttgggtgcagctggcagacaggcaggcagggaggaactgaatttgctgaacacccaactgtatgtgccaggcttttcacacagtgtctcattcattgcagagtgagcattcgcgtcattcatcagttagtggtgagaacatccaaggctcgggggattcagcagctgtcctgagtgccacagtaagtgatagagcctggatttaaacccatctttgcttgactctaaagcttgagacagaaacagcccatcctcggagtcaagtgaacttagagaagacctaggacaattgtcggggacagtggtagccatgggttttgttgtttgttttttgagatggagtctctctctgtcacccaggctggagtgcagtggtgcaatctcagctcgctgcaacctctgcctcccgggctcaagcaatcctcccgcctcatcctcccaagaagctgggattacaagcatgcgccaccacactggctaaatttttgtatttttagtagacggagtttcaccatgttgaccaggctggtctcgaactcctgacctcaagtgatctgcccacctcagcctcccaaagtgctgtgattagatgtgtgagccaccatgcctagccctagccatggtttttatctgactaccatgttttctacttctggtttcctgtgggaaagggctgggttggggtgctgtcaatcatgggacctgatcagagaggtggtcacatgatgcagcctagtgtatcagaatctactatccattcagttactgtgacgagttcagagatggacacatgatccacaaagggccaatcagaaccttccctgggattaatatatgactactgagctgaagaaacgttttttgcatgttgagttgctaaggtgagatgatatgatagctagtggccataagacctgccctggaaagagagcgtgtacaaaattagaccagaggtaagccagtggttcctaaacatttgtgtacatcagaattacttggagggttaattaaaacctagattcatgggccgacccacatagtatctgaggcagtagtcctgggctggggcctaagaatgtactttgctaactagtccccaggtgatactactgctggtcctggggtcacactttgagaagcactgagtgaagatatggagagagtcactgtgtcctgatgacaactgggcccatgcccccaaggaaatataagccattaaattctattcttttggttaagctaattttagttggttgctggtcccagcaattgaaagaatctagcttcatataatagcctttgagaccttgcaatgcctttttggcttccagataattggagaggaagaaattacggcaggataaaaacattacgcgtgaaaggctctggcccttaatatttaactgtgccgtggggcacaggggctcatgccctgtaatcccagaactttgggaggccaaggtgggaggatcacttggggccaggaattcgagaccagcctgggcaacacaggaagacacttgtcctacaaaaataaatttaaaaattagccagtcatggtggcacgtgcctgtagtcccagctacttgagaggctgaggtaggaggatcacctgaacccaggagttcaaggctgcagggagctatgatcacctattgcacttcagccttggcaggagagcaagattctgtctctctaaaaaaaagaactttgatgtgaacatttagagacagacactagtggagataccagaaagactgtagtgtccctgtccctgggaattctaggaacagcccctagatgtccagctgggtgaaacctcatatatggagtcttccccagagacaggggactggctgagttgacctcagccggtcccggaagcctccctgacctctccgtacctgaaacccagcgtagaggagaaacagtggcaggatggccacagtggccagtggggtagccactgccaccaccaggctgacctccaggagtccaaaggcgtacatcagcagggaccggagtttgtctggaatgtccacgtcaaccgtgtctgtctccttggagaagcggtttagcaggtgaccaatgggtgtccgctcaaagaagctgatgggagatcgcaccacatcccacaggagcctctggaagagcaacctggatgcccgggccccacctaggagcaccgcagccatggaggcaaacagcccaatggctggggagggagaggaggtaagagcatgagggctggagaccctcaggagcggcccacggggccctgcgcaggtctctcccgctaccccatggtggacatcttatggcttggccaccctgattattatatttttttgagacagggtctcactctgtcacccatgttgaagtgcagtagcatgatgatggctcagtgcagccttgacctcctgcactcaagcgatcctcccgcctcaccctccgagtagctgggaccacaggtgtacgccaccatgccggctaatttggggtatttttgtagagatgggatcttgctatgctgtccaggctggtctcgaactcctgggatcaagtgatctgcctgccttggcctcccaaagtgctgagatgacaggcatgagccactgcgcctgtaccctgcttgtttcttgatgtaatgggttgaagagtgtcccccaaaattcatttgggatgggtcctaaattcagtgactgccatttatataagaatactagaggatactcagagacacagcaggagatatgaagatggcgacacagatgggagggtgtatctacaagccaaggaatgccagcgactgccggcgaccaccagaaaccaggagagaagcctggggcgtattctccatcagaacctccacgaggggccgggcacagtggctcatgcctgtaatcacagcactttgggaggccaaggcgggtggatcacctgaggtcaggagttcgagaccagcctgagcaacacggtgaaaccctactaaaccctactctctactaaaaatacaaaaattagctgggcgtggtggcaggcacctgtagtcctagctactcaggaggctgagtcaggagaaacactggaacccaggaggcagaggttgcagtgagccataagccgagatcgtgctactgcactccagcctggttgacagagcaagactccgtctcagaaaaaacaaacaaacaaacaaaaaaaccaaaaaaacctccacaaagagttaacactgctgacaccttgattttagacttcaggcctcagaactgcgacagaacaaatttcaattgtgctgggctcccaagtttgtggcaacttgtttggcagtagccctgtgagagaaatgcacatccttcctcccagtgctaatctgtatgcctggggtggggctaacttctcctctggggtggggcaaatttcacccatggccaatccaaaccactgcagttggttcagggatgaacacataacccaagtcaggccaatgacagggagacctgggacttcactagaacttttggaaaagtggtacttggttgttggaggtagccaagctggagccgtggaatatcatcttactgccagggggagcagctaagctggacaggaagctgtcacagaggagggaaataaagcgatttcttgtttggacccctacatccagccatacctgaagccagaaatctagggatactggtcccaagagccaatcaattctcttgttgcttaaacactttgaattggagctgaatttgtttattttcagacggagtcctgctctgtcacccaggctggagtgcagtggtgcaatctctgctcactgcaaaccccacctcccaggttcaagcgattctccttcctcagcctcccaagtagctgggattacaaacactgacaccatgcctggctaatttttgtatttttagtagagacggggtttcaccatgttcgccaggctgatcttgaactcctgacctcaagtgatccacccgcctcggcctcccaaagtgctgggattacaggcatgagccaccgtatctggcctggagctgaattttttattctttgtattcgagagtcataaccaatttctctctctcagctcccatctctccatctttaggggagagtaagacttgcccttagctatcaaatgagggatggaagtggaaggattttgaaagggctatttgccacccaaatgaggatttgggttaattccagggctcggctgactctgagaatccctaatttcctcttggttaagtaaccattcgccttgagtattccactgtacatgcagttgtggtgagtaggtgtacaggttcttaggactagaagagtcctcaagttcaggcctggcgccccctattttacaggggaggtcacaggctcacagcattttggtgatgtggccaatgtcacccagtgaatgaggacgaatcaacatgaaaacgaggcaactgtcctttaaagatgaagccaggccgggcgtggtggctcatgcctgtgatcccaacactttgggaggttgaggcggaggattgcctgagcccaggagtttgagaccagcctgggcaacacggcgaaaccgtctctatcaaaaacaaaaattagccagcatggtggcatgtgcatgtagtcccagctactcgggaggctgaggtgggaggattgcttgagcccaggaggcagaggttgcagtgagccgagttcgtgccactgcattccagcctgggtgacaaagccagacccagtctatatatatgtgtgtgtgtgtataaataagaagccaaactcacatgtgcactcctgttactcccttcagccaggccacgtattaaaaggagaagaaccaggggttggggacagggtgggcgaggcaggagaagggtgggtgtggttgcaaaagggcaacacgagagcgcctcgtggtgagggggttgttcagtatctcaactgtcaaccatcgtgatggatgcgagagactgaacaggggatacgactgcacagaggcaaacatgcgcacacccacgtgcaagcaaaactggggaaatcacaatgagatccatagggccgggtgcgggggctcacacctgtaatcccaacactctgggaggccgaggcgggcagatcatttgaggtcaggagttcgagaccagcttggccaacatggtgaaaccccatctctactaaaaatacaaaaattaaccaggctgcacacttgtaatcccagcttccagctactcaggaagctgaggtaggagaactgcttgaacctcggagatgggggttgcagtgagccgagacggcagcactgccctccagcccgggcaacagagcaagactctgtctcaaaataaaataaacaaataaataaataaataaataattgagatccatggattgatgggtgtcaggatcctttgtgtgatactttactatcagtttgcaaaatatcaccaatgggagaaactgggcagactgttcaaggtagctggctgccttatttcctagaactgcatgtgaatctacaattatttcaagaagaagtctttccatttttgaggaggagaagaaggagtgatagcggtgatgcatttgttagggagggtctggctctgtctggaggtttgggggcaggcactgaaagccaccagcaggcaggccttgcagacgccttccgctagtggggagggactgggagaggttctgaagcttccagaaaaggagggatgtgccctgtccttcccgttccctccagcctcatcttaaggacgcagatctttgcctggaccccagacgttttgcacactgttccagggggacagggtgacccagggaggggtggggtaaaggagtcctgagcaccccttggtgcagctgggaggagagggatgaggagggcaggtgaggcgtaccttggagacagccgaggagcccgaagatcccgccacgcagggctgcctgcgtctgctgcccacctactgcagggtcgtccgcccacaggctcagccagtagccccggcagaaggaggccacttgctggcagaggaagaggaagagtgcgtagaggcagaggggggtgcccacggcacgcaggtaggccaggtgcactgtggccttcacctgtagcacacatgagggagagggaggcagagagagcccccagtgggaggggtgggttgaggcaaggccaggcgaggctcccagaaaacatgcccatggcagatgggaccaccacgcagacctcactggttctcccgctgtgcctcccaccagaagcaccatttccccgacaggccccagccagccttagaacccccatctcctatacaatccccagggagctagtattaatattttttcttttgttttttttttgaggacagggtcttgctttgtcgcccatgtcacccaggctggagtacactggcatgatcatggctcactgcagccttgaactcctaggctcaagtaatccccccgcctcagcctcccgagtagtcaggactataggtttgtaccaccatgttttgttaattttcatagttttaaagagatggaatctcgctgtgttgcccaggctagtctcagactcctggcctcaagtgatcctccctcctcggccttccaaagtgcttggattacaggtgtgagccaccacacccagctagaagggttttcttgaacacccaccataggtcaggcatgtgtctctccttataacaacctccatttcacagataaggaaactgaggcacagagaggttcagccactggcttaaggtcctgctcctacaaatctgaagttctctgcacagctgcagccagacgggactgttgaaaacattaatctaattatatcttgtcgttggcctgtccatggctatctcttgctcttagaagaaatcccagccaggaggggtggctcatacctgtaagcactttgggaggccaaggcgggtgtgtcacctgagctcaggagtttgagaccagcctggaccaacgtagtgaaaccccgtctctactaaaaatacaaaaattagccacgtgtggtggcaggcacctgtagtcccagctactcgagaggctaaggcaagagaatcgtttgaagccaggaggtggaggttgcagtgagctgagattgcaccattacactcttctctgggcgacaagagtgaaactctgtctcaaaaaaaaaaaaaaaaaaaaaagaaagaaagaaagaaagaaagaaagaaagaaattccaagcttcttatctcgcccccactcactgcctgccagcctcatgggacccctttctctggcaccctaagctacttcccacctcggagccattgcacctgctgctctctctgcctggagcgctctttctcctgccctttgtatgactggttccttcacacattctttggggaagctcaaatgtcacttctcagagcatcctgtccataccaaccatggtagggtttctcagtggtctctatttcatcattctttcttttaagaggcagggtctcactctgtcacccaggctggattgcagtgacatgatcatagctcactgcagcctcgaactcctggcctcaagcaatcctcctgcctcagcctctgaaagtgttgggattacaggcatgagccactgcgcctgatcattcttattttctttatagcacttattgttattggacatagcttacttattagcataattatttactctccgtctatcctcactagtgtctaatctctaccagacttagcctggcacatagtgggtattgtgtacatgtttgctggatggatgagagggtaggtgggtgaataaatgagcgggtgggtaggtaggtaggtgtgtgaatgagtggatgaatggatggaaagatcaatgaatggatgaacagctgaacagacagatgcataggtgagggaatggttggatgtattgttaggtgggatagatggatgggtaagcgaatgggatggataaatgagtaggtgggtgagtggatgggttggacagataaatgagtgggtgggatagatggataaatgagtggatgggatggacagataaatgagtgggtgggatggatggataaatgagtgggtgggatggataaatgagttggtgggagggatggataaatgagtaggtgggatggatggataaatgaatgggtgggtgggtgggtggataaatgggtgggtgggatggataaatgagtggttgggtgggtgggatggataaataagtggatgggatggataaatgggagggtgggatggataaatgagtaggtgggatgcataaatgagtgggatggataaatgagtgggtgggatggataaatgagtgggtgggatggctaaatgagtgggtgggatggataaatgaatggatgggatgcataaatgagtgagtgggatggataaatgggtgggtgggatggataaatgagtgggtgggatgcataaatgagtgagtgggatggataaatgggtgggtgggatggataaatgggtgggtgggatggataaatgagtgggtgggatgcataaatgagtgagtgggatggataaatgggtatgagtgggtgggatggctaaatgggtgggtgggatggctaaatgagtgggtgggatggctaaatgagtgggtgggatggctaaatgagtgggtgggatggctaaatgagtgggtgggatggataaatgagggggtgggatggatggataaatgagtgggtgggatggataaatgggtgggtgggatggataaatcagtgggtaggtgaatggatgggatggataaatgagtgggtgggatggataggtgggtgggtggatgagcatctaggtggatgatggaatgggtaagtaggtgggtggagatacatagcagtatagaagatgagaaacagtgtaagcttcagactcagattggcctagatttgagtcccaggttgtgtcccaggctagatatgaaaacacaaacaagtctcttaactgtttaagacttcagtttcttggctgggcacagtggctcacacctgtaaccccagcactttgggaggcagaggccagaggatcacttgagcccaggagttccagaccaacctgggcaacatggcaaaacccatctctactgaaaatacaaacattagctgggcatggtggcacacgcctgtagtcccagctacttgagagactgaggtaggaggattgctttagcccaggaggtcgaggctgcagtgagctatgattacatcactgcggtccagcctgggtgagtgagcgagccactttctcaaaatcaaaataaaataaattttaaaagaattcagtttctttatgtctgaaatagacctatcatatctattttttagggtggttgtgaggattaagaaaatgaacatctagaatgctactggcacatagtaggtgctcaagaaaggtgagtatcactgccaagtgctacatttggtgggaagacttgggcccctggaggtggcagcagtgggtggggaggggtgggtgaagctggtggttaccctgccgtattggatgctgtcctttcctgctggccatcctgccctgtcagggtcatccagaggaacctctgtctgggcttctgaagtggtacggtccttctcagggactgacttgatggacctgtcatttagaggaaatgaagacaaagtcagtatctctcccaatggtggggtgtatgtgcctaaccctcaggcccactgacagccactgagctctgggtacactctgtactctttcattcattcatttatctaacagaatactgaccagatatcacacttcccttcttcccatatggtacccagctaaatgccatctattaccccagggtcaagcaagcccattcttctgatgccaattcacaggatgaacttaacttgcccaccattggaactctgttctcagaattttcttttttttttttttttgagatggggtcttgctgcattgcccaggttggtctcaaactcctgagctcaagcaatccacctgcctcagcctcccaaagtgctgggattacaggcatgagccaccatgcccagcctgttctcagaatttttattttggcttaagctttcgtgcaattgttttgttcctactgtataccatcagatttgtcagtccaactggcagaatataaattatgcacaattcagatgctaaagactctttgaatgttttatctgtggatgagtgggctgacttaacctctgtgcctcagtttcctcagctgtaaaaataggaatattatctatctatccatccatccatttatccattcatctacatacctgtatatctacatatacatgtctacctaccttctattaaattgaggttagcccaaagctgcctccttacatattttaagtttggcctaaaggttttccccgtacatagtgaactgtaacctaattggactcaaacagactgcaacctactcctgtgtcaatcactgagtttcagccaatcaaaggcaaccaaccgttcaaaccatgttccaataaagcaaacgctgagctgtaaccaatccggctgtttctgtacctcacttctgttttctgtccttcaccttcctttttctgtctattaatctttgaccccgtggctgtaccagagcctctctggacgtattctggttcagggactgcccgatgtgcggatcattctttgcttagttaacctctgttagccaggtgcagtggctcacgcgtgtaatcccagcactttgggaggctgaggcaggtggaacacctgaagtcaggagtttgagaccatcctggacaacatggcaaaaccctgtctctactaaaaatacaaaaattagccgggcctggtcacatgtgcctgtagtcccagctactcaagagactgaggcatgagaatcgcttgaacctgggagacggggattgcagtgagccgagattgtgccattgcactccagcctgggcgacagagcaagattctgtctcaaaacccccccccgcaaaaaacaaaaaacctcagacacattaaatttgctagaggttaatttggcacaatctcggctcactgcaacctccgcctccgaggttcaagtgattctcgtgcctcagcctcccgagtagctgggactacaggcacatgccaccacgccggctttttttttttaatttacttattttttatttttagtagagacgggttcaccatgttggccaggctggtctcgaactcctgacctctagctagtgatccacccgcttcagtttcccaaagtgctgggattacaggtgtgagccaccatgcccagccttaatgtgtctactggttttcttttaacatgactacctatccatctgatcttacttcagattcttgtgcgctgtgaaggtggtgggatttctcagtgtgtgtgtgattgagaagtgccctcagggtggctagctgggatgggggtcagccccaatggtccctggggactgaggcccctcaagatcgctgccgcccaccacccctgtatagcaggcacttaagctcaggccatctggtatcagtggcctgttgttctgcttcccaagacccctctcattaagaggggagagtatcaggcagcaggtccttctgctgccgacagctccacagtgagcccagctgtgtcctggctggagggagctgagaaaagaggggaccggaggcctcctcctggccccttgcccacgtgttctggccagcgtcaagtgatgctgtgcatacagacccaagccctgtgcatagccagcctgtcaaagcataagtggccaggcctggcatggtggtttacagctatggggaggaaccagtcctgccctactgcagcattcagacaactccagcaagctggcctcggcccacttgaagacatccatcaattggaaggcatattgttcattccatgaactggccttataggggcctaatcatcttggctaactggaccaattttggtaaattatccctcagcagggcaccatgggggggacttcagcaggttctctatccataatggttttggttgcccgcctaactgcccgagatgcgggtggtcccttcagctacttcagcttcagcctgtgcccttctgagtgtggcaccatggtggactcacctctcgcgtctaagctcgggcctcctgcctgcagaggtgcctctggggtccttggtgctggtcccaggttctgtttctgcaaggtcaagagagtcctgtcacgcaacacggcccagatacccactttgacacccactgactatgtggccttaaccgctctgaccatccatttcccctgatctggctcctgccacgtctccagcaacctctctcaacaccccactctgagttcttccaggaacatccttcaggcattcactcactcattcatttcttcaatcagtgataactgagcacctactatgaacttgaggttggaaaaacagcatttaacactgtacaaagtcaagttacctctgtttcccccaacagccttgctcaagcagttccttgtgtctggaatgcttttttctggctaactctcacctaccctcaggtaccatctcccctaggaaggacacctccccaccactatcccccaggtgtggccagtaactgaaagcaaatctgtagtagtttaaccacagacctgtaagcaacaagtaactgctactgtaagctgctaggatttggggggctatttgttacacagcatcatcacagcaaaagctgaccaacacaaacaggcaagttctatcttcaagcttcaggactgtgacattgtgaatcaacacttaaggttttaaccaggttgggccagtgctaagcagatgttctcagaagaagcaaagcctgagattgagggagacctggatgtgaatccttgctttgtcatgaagggatagtgtagagggtagcaattaaaaaacacattctctggaatcaagttgcttgggttcaaatcccagtgctgccacttacaagccatgtaacctgggactagttccttaacttctgggcctcagtttcctcatctgtgaaatggaaatgattctagtaccagcctcacaggggcattatgttgattaaatgagctaacctctgtgatgtgctgttagttgctacttttcagtcattgtgagtgagcttggcttggcaactttacttccagaaccttgccatgtatccagcacactgtttttctggattattagaaaccctagctagcatggtgtagcttgctaggcatcaaagtccttcttgggctgtctccatagcaactgcaagcatagactctggagctggacatactcaagttctaatcttgtgaccttgggcaagtgatttaactctctttgcctcagtttgctcatctgtaaaatgacagcaataacttcacatgcctctggggcatgtgtgagaatcaaatgaaatagtgtattttttacagaagcacttagcacaacccctggctcatggatgatgttatcggctattcttggagaaaggtgacctattaagagagctgtctgcttccaggcctaggcctgcagacagggtgtggccagagcactccattcatgccagtaggacccttcgagccttttcccccaagggtggcaggagccaggcctggagaatcagcaaagcccacctagtacctccttctcctctatctcctggctgtctggcttgatccagaagacacatgagggcccccttcctctgcagaagctcctggtaggaacccatctctgcgatggccccatttgccagcactatgatccaatcagcctggggcaggatgtggagtgcgtgcgtcacgagaatccgtgtctgggcagggaaggggtagaagttacacacatgtggccgggtgcagtggctcatgcctgtaatcccaacactttgggaagccaaagcatgtggatcacttgaggccagaagttcgagaccagcctggctgacacggctaagccccatctctactaaaaatacaaaaattagctaggtgaggtggcgcacacctgtagtctcagctactttggaggctaaggcaagagaatcacttaaacctgggaggtggagcttgcagtgaggcgagattggaccacagcactccatcctgggtgacagagcaagactctgtcaagaaaggaaagaaagaaagagaagaaaagaaagaagaaaagaaaagaaacaaaggaaggaaggaaagagagagagagagaaagaaagaaaaaaaaaatgtacggccgagcgcagtggctcatgcctgtaatcccagcactttgggaggccgaggcagatggatcacctgaggtcaggagttcgagaccagcctggccaacatggtgaaaccctttctctactaaaaatacaaaaaattagctgggcgtggtggcgggcacctgtagtcccagctactcgggaggctgaggcaggagaatggcgtgaacccgggagccggagcttccagtgagcggagatcgcaccactgccctccagactgaaagacagagcgagactccatctcaaaaaaaaaagaaaaagaaaaaagttacacacatgtgcttggccagcctcctgagctgggggttggggtgggggtattgtccctggactcagagtggggacagctccccttcttgtgctcctgccgcctttcttgtaaacagcatatccaaatagagaaacagaggggactcccttagcctgtgtctcaaaacaagaagacaaggagtacatctgaccctggccaatcatccaaggcaaagctgtagtagttaaatcacagatccataaggaagaaacacctgctgttgtaagctgctgggatctgggggttgtttgttacatagcattgtcacagcaaaagctgaccaatacaaagaggaaattggactcaagtggaagggggaggtgagataaacttgggttaggactggatgctaagtgcttcctctgcctttgccctgtactgtctgacacatgttcccaaacttactgttccctggagtagtccaccaggcccaatgacctggttgaagacatgctggccaacgtgggcatccagggccgccagggggtcatccagcaggtacacagctgcctttctgtatacagcccgggccaggctcagccgctgcttctggcctccggagagattcatgccctgtggccacaaaaggaacagtggcctgagtcagcatctacagggtgaaactggggtgcccaggctgtggcaggtcagggcacacctgcccatcagggtgaggtacagctcaacatgcctattccctggggacaggcccagcttccaaggcactcgctctcaagccaacaatgcctccatccttacccgacctcacttctccacttcccaagcacgcttcctggaggagttacctacacttcccaatccactctgtctcctcctgctcactctctctatctctttgagtccaactcttgtttccctttctccactgagaccaccatccatttccctattccctcatccagtggcagcttttcagtcctacttttgtattttaaattttaattgttttcttttagttttcattgatatgtaatagttgtaactattcgaggggcacaagtggtatttggatacctgtagggcagtggtccccagcctttttggcaccagggaccagttttgtagaagacgatttttccatggacctgggggcagggggatggcccgggggatggtttcaggacgattcaagcacattacgttgattgtgcacttctattattattattactgctgttgtcgttgttattattgagatggagttttgctcttgtcacccaggctgggagtgcaatggcatgatcttgactcactgcaacctctgcctcctgggttcaagcaattctcctgcctcagcctcctgagtagctggaattacaggcacccactaccacgcctggctagtttctgtatttttagtagagatggggtttcaccatggtggccaggctggtctcgaactcctgccctcaggtgatccgcccaccttggcctcccaaagtgctgggattacaggcgtgagccactgcgcccggcctacttgtattattattgcattgtaatatataatgactcaccatcatgcagtatcagtgggagccctgagcttgttttcctgaaactagatagtcccttctggggatgatgggaggcagtgacagatcatcaggcattagattctcataagatccctcacatgtgcagtttacagtagggtttgtgctcctatgagaatctaatgctgccactgatctgacaggaggtggagctcaggcggtgatgggaacaataaggaatggctgtaaatacagatgaaacctcactcgcctgccctctgcccacctcctgctgtgctgcctgcccagttcctaacaggccacagactggtgctgatccatggcccgggggttggggacccctgctgtagacaatatgtaatgatcaaatcagggtaactgagatagtcatcacctcaaatatttatcttttgtattgcgaacacaaccatccttctcttctagctatcttgaaatatacaagtaaatgatcattaactataatttcccttgtgcactattgattactttaacttattccttctatctaggccttcttgtctttcattcattcttttaaaacttatttttatttatttttgagatggagttccactctgacacccaggctggagtgcaatggcttgatctcggctcactgcaacctctgcctactgggttcaagcgattctcctgcctcagcctcccaagtagctgggattacaggtacgccaccatgcctggctaatttttgtatttttagtagagatggggcttcaccatgttggccaggctggtctcaaactcctgacctcaagcaaccctcccgccttggcttcccaaagtgctgggattacaggcatgagccaccgtacccagccattcattcattcttacattcagtcattccactaataaccactgcctcgttatcataaaccaggcatggttctaggctctggagaaacagcaatgagcaaaacaaagttgctgctctcttaatggatccatcattctcatgaaggggacagagacaggcaatccataaacaagtaaggcagacagcacatcaggtggaaagtgctatgaagaataaatagtaaagcagggggagccaggttcaggggctcacgcctgtaatcccagcactttgggaggcggagctgggtggatcacttgaggtcagaagttcaagaccagcctggccaacatggtgaaaccccatctctactaaaagtacaaaaaaaaattagccagttgtggtggtacatggctgtaattctagctactcatgaggctgaggtgggaggattgcttgaactactcatgaggctgaggtgggaggaatgcttgaactcaggaggtggaggttacagtgagccaagattgtgccactgcactccagcctgggcaacagagcgagactccgtctcagaaaaaaaaaaaaaaaaaaaaaaaagagaaaaagcaggtgcaggtgtagggtgcactaacaatagtagggtggctgtggtggtagataaggtggtcaggaaaggcctctctgtgaaggtgatagaagtgagggatgagccctggggactcctggggagagctttccagcagagggaacagcagtgcaaaggccctggggccagagtgtgctgtgggggatcagggaatatcacagagactaaggtggctgcagtaaagctgagaggtgatgatgggagatggggctaatggataccagagccaggtcacagggaccttgccagggattgtcatgacttgggctttgtctctgaggtaaatggggagatcacctgaggtccggagtttgagaccagcctggccaacatggtgaaaccctgtctctactaaaaatataaaaattagccaggtatggtggcatgtgcctgtaattccagctactcaggaggctgaggtgtgagaattgcttgaacgtgggaggcggaggttgcagtgagccgagattgcatcactgcatgccagcctgtgcaacagagcaagactctgtctccaaaacaaaacaaaaaacaaaaccacaagtggtgggctggatttggcttggggtcacagtttgccaacccctgcccaatccatagctccagatgcatatatcctgtttcttggacatctctgtccagaccccttggtgaggcccagagaggggaagcaattacaccaacattactcagcaaggcagggcagagtaagacaggagtctaggtcttctcactctcagttgtcagagagctcctcactgccaatccctgccacaactccctgcctctctctttgtgtctatttctgcttatcaattagtgattacgtattgagcacctagcacgtgcttgacgctgagctgagccctttttctccgctacttccctaaccattcctctcatttctccatcatactgcccatgatgagtcggggacccaaatgactcccaactgcaatgtctccctgtcccaaaaagacccccaaactctcacctgctccccaattgaagtgtggattccctcagggaagctgtccacatctggctgcagggcacaggcttctagtactctctccagccagggtgggtccagctcctgcccgaagcacacattctctaccacagaggtgttctgcacccaggcctcctggggcacgtaggccacagcaccctaaaacacaacttactttggtcacaggaggatgatggggacagaggtgggataggttttgaggagcagtgggagctgggctctcagtggtgggtgagaggtggagagaatgagtgaaagtgaacttggctgggatggggagggtgggaaggcagcgaggaagtgggactttcaggatggggacatcctagcagacaggctgggggtggcctcacctcgatgctcacgaacccctccacctttgacagctccccaaggagggcggacagcagggaggacttccctgcccccactggaccgacaacagccagcagacagccctggggcaccgtgaggtttattctggacacgcaagaggggagacatgaccttggttagggttcagcccgcctctgtgaggaaggatgagccccagacggagctgagctttcctgctctgggagtctccaagaggacctgtggggctgttctttttcccagtccttgtctagctatttgaggaactatcctgtgcacatctgtgcatgtacacatgcacacaaagcgtgcacacatgcatgcacatttgcacactcatacaagcatgctagcatgcacagcaacacaatgtgggcacgcatccacacacacacaagtgcatgcacatacccaatcaatccatgctcacacgcatacatgtgtgcacacatgcacaccacgcacacacacacagggttgactatagcctgagggtttcaccagcctggcctcctgccttggctcttgcgataaataggctctttcctccctccctcccgctactcttggtcccgccccactcctgtccacgtcccacagcccatcctccacccagtgaccagagggatctgttaaaacccaagtcagatcgtgacacttcccagctaaacccgccagcactcccatttcactcagggtcaaagctaaagtcctgacgatcaggaatgacatctcccgcctccttccgctctgtgcctcagctgctcggccctggccttgctgacctccttgctgtttcttgaacacaaaaggccagtggttctcaccagggggtgactgcatcccccaggagtcatttggcaagatctagagatatttttggatgtcacaaccagtagggggtgctgctggcatctagtgggtagagactggggtcagctaaacatcccacaatgcacacgacagcccccaacaaaggagtttcagcccaaaatatcaaccgtgctgaggttgagaaacccaggtccaggcactctcctgccccaggacctttgctgatgccattcccaccgcctagaaggttcttctcccaggccgggcacggtggctcatgcctgtaatcctagtcctttgggaactgaggcaggtggatcacttgaggtcaggagttggagaccagcctgacgaacatggtaaaacccatctctactaaaaatacaaaaattagctgggtgtggtagcatgcgcctgtaatcccagctactcgggaggctgaggcaggagaattgcttgaatccggaaggtggaggttgcagtgagccgagatcatgccattgcactccagcccgcgtgatagagcaagactccgtttcaaaaaaaaaaaaaaaaaaaaaaaaaaaaagaacagctcttctcccagacactccttccttatgatctcggcttgaatgcaaagccttccctcgctagacatgccatcgtactctgttcccttgctctggttttctgtttgggcctcacctctatcagcatgtcaccccacgagagcagggcccttgtctgtttccttcgccctatccccaatacctagaacagagcgtggcccatacctagtgctctatcgatgaagtgagtgaatgacaaccaatacaaatactacctggggcatattccttctcttcttagggagtttcagggctgtctgagatttttggccacaaagaccaagcgatagagttggagactatagatgatcatgacctcggactgatacaggaggcacagaagtgagcacagctgatagggctgaaccttggggctcctctcagccagccctcccttggcatcgtcttggccagcctgggagcacaggggtgtctccccctaatgggggaggctcagatgccctggtccccgtctgcaggagatactggtctatgctgtgcaggtccccaccttcaggaggtagagatgtatcctgagaacctccccggcagagccccagcccagccaaacccaccctccagtcccaggctggaaacctacaccacctctcaggtgggaggcagcaggagccccatgcatcttctccctaaaaacatgaggctggttactacgggtgtcgttctgtacctgtggaggcagggagggctttcctgggaccaggcgaaggtggcactgtgtatggtgatgcaatccttcccggcagctgcagggcacaagaggccatttacaggagacccctgacctggccggcctctgcatcggagaggcccccaggcaccatcccccgccccccccaggggcagaggctgcaggaagaaatctctcccactgaacaaattgccctgctactcactggcttgtgggtgaccccgcagggttcttgttctgtccgtgtcccatggctacataatccagggggaggcaaactgtggcccagagaccaaatcctgcctgctgccttttcttataaataaagttttattggaacacggccacatccattcatttctctatttcatgctttgagcagttgtgacagagactgtgtggcccacaggcctaaaatatgcacaatctggtcatttatggaaaaagttagtgaatttctgaaataaattatcatcaaatcccagccttcccagagtgaagggggtgttattaatttcactgtggccggcacagtgtctcatgcctgtaatcccagcactttaggaagcagaggtggtaggatcacttgaggtcaggagtttgagaccagcctggccaacatggcaaaaccctgcctctaccaaaaaatacaaaaattagccaggcgtggtggtgggcgcctgtaatcacagctacttgagaggctaaggcaggagaattgcttgaacccaggaggcggaggttgcagtgaaccaagattgcaccactgcactccagcctggatgacggagtaagactgtgtctcaaaaatactactgctactactactaattattattattatttcactgtgataacaagtgtaattagattagtggttcttgatccttaagacgtagttagaattgcctgaaagattttctaaaaatcaaagctctcatggcttagcccagatcaattaaattcatcgtcacaattagctgctataacgattaacatgcccattttggagatgggaacacggaagctcagagagatgatctacttgtcaggatcacccagctagtcagtgctggggctgggatttggacctgggcagttgaatgccacaggctcggcttcttaccactatgtgggtgttttccaggtacacagtttgcccaggttcttcagtgcaacaagggggagggtgtcttggcccgtggcataaaagaaggatggggtggagggggaagcccaggtaacttgagcttggtaagtctcatcgtgcaatggtgcttgaaatgctgctattttccagcttgatcaaaatgctgtcatgcttattacctgggactttctgcatgaggacaaggacctggtctgttagagcaggagtcctcaacccccaggccacagactggtaccagtctgcagcctcttaggaactgggccatacagcaggaggtgagcgcagggcaggtgagcagagtgtcatctgtgtttatagccactccccatcactcccatcaccgcctgagctccacctcctgccaaatcagcagcagcaatagattctcaaaggagcacgaacacttgtgaactgtgcatgtgaggaatctgggttgcgtgttccttataagaatctaatgcctgatgatctctgtctcccatcacccgctttggggccatctagttgacggaaagcaagctcagggctcccactggttctacgttatggtgagttgtataattatttcattatatagtacaatgtaataataataaagggcacaataaatggaatgtgtttgaatcatcccaaaaccacgcgcctctccccggtccgtgggaaaactgtcttccacaaaaccagtccctggtgccaaaaagcttggggaccactgtgttagagtgttccctgttgtacacccaggatggtacaaagtgggcgctcagtgagtggtcgctgaatggctagcagaaagaagagcagcacggtgccagtttccaagtgacacgcagatggcgtgatctgcacgtgtcatccattgcccgcagcccccatctccccccagtactgatgctggcttgccattatgggctggggtggcccccacatcccccatccctcccacacccctcctgccagactcagcactcaccgcttccagaggaacttgagtctacgacaccagggtcaacttcttccaggcagaggaaggtgaccagacggtcaaaggacacccgggcctaggaaaaccgaagccgcaggtcacccagcaagaagagcaaagaactcaggttttgggtgtcggtgtctcaagatgtgtggcaacagcttcctgtctaccaagctctgtgcataggaggcgtgaggacaaagctttctagttcatgggaaacgatgcaacccgagtggtgaccttgatggtggtgatctcccacctctgcgatcctacaaatcagtgacaccgaagcaagccagctgccattctgcagacaagatctgggaagaggatggtggcttttccaataaggttatcaagccattgtgtggaacaatttcaaatgttgtccacctgggggcgctctctcccagtcacaaacccatctttggggaagaaagagaccagtcgttaaaatagagattaggccaggtgcagcggctcatgccggtaatcccagcactttgggaagccaagtgcaggaggatcacttgaggccaggagttggagacctggggaacatagcaagactctttgtttctacaaaaaattaaaaaaattagccggatgtggtggcccatgcctgtagtcccagctactcaggaggctgggaggtagaagcatcacttgagtccaggagtttgagcatgcagtgagctgagatcgtgccactgcactccagcctgggtgacagagtgagacactgtctcaataaataaattaaataaataaataaataaataaataaataaataaataaggcggccaggcgcggtggctcatgcctgtaatcctagcactttgggaggctgaggcgggcttattacatgaggtcgggggttcaagaccagcctggcctggccaacatggtgaaaccctgtctctactaaaaacacaataaataaataaataagactgggtgcagtggctcatgtctgtaatcagcactttgggaggccaaggtgggcagatcacctgaggtcagcggttcaagacctgcctggccaacatggtgaaatctcatctctactaaaaatacaaaaaaaaaaaaaaaaattagctgggcatggttgtgcatgcctgtggtcccagctacttggcaggctggggcaggagaatcacttgaatctgcgaggtagatcttgcagtgagccgagattgcaccactgcactccagcctgggtgacagagtgagactccatctcaaataaataaataaataaaaataaaaaataaaaaacatggagatggctcaggtatgccgccgtttcttgttttcaccatgctgaaaggactagagatagcaaaggaagagaaacaaaatcgctttgtataaaaaagggaactgacatgattgcttgtatgtggaattgctgggcagatggacaagtatgcatgttctgaggtgtgtgtggaaaggtctgcacattgccctccaaaggctgaccccttccagatgtatttgctgtactctctgcccgcctctgttcttgcccctacccgcctcttttccagctccacaccatccctctccctcccactctgtcttccctctcctctgcaaatggcaggggtagggaagctggagccaggtgtagcccacgcactctcccaggatggctccagcccttgcacccacctcacctggacgagggagtggatggagaagggcaggaaagcctgggccttgttgaggatgttgagaactgtgagagtcacaaaggctttctctgcattcatagcattctcggccaccagagtgtggacagcaaacaccaccagtgcgacctggggggtgggggggacacgtggggcaacagtgagacacgcaagcatggatagggcagcctgggcaagctgtggtgcctgcacggtccatgtggcccacccgccatgtccgcatgtgcttccctccgtagatcccactcccagtcctgctaacacatgtcctctccgcagtcataagctacataaggctctctctaaagacacagcgcattgctaatggtgatgagtgcgcagccccacggctctaggcatcactagaacctaggggagaacctaatgcctctaggttccaggcatcgggggacagcagagtttttgatcttggtagccctgttgttctagacgtggtggaacttgtgattctagagtcccttggaagatgactctaaagttgcaggcaggagcagcacttgagggctctaggtgttggtgccatttgtggtgcttttttttttttttttgagatgaagtcttgctctgtcgcccaggctggagtacagtggcatgatctcggctcactgcaacctctgcctcctgggttcaagtgattctcctgcctcagactcccaagtagctgggattacaggcgcccgccactgcaaccagctaatttttgtatttttagtagagacagggtttcgccatgttggccaggctggtcttgaactcctgacctcaggtgatccacccacctcggcctcccaaagtattgggacgacaggcatgagccaccacacccagcctacgtatcaaattttttaaaactgtggtttaggaaggttgttctgacagcaatatgaaataaattacagaatggcaggacaaggatcacgtccagtgacagggtggctatggacatctgctggccaggatcagggaagtcactctgacccaggattctacctctgccacccccctgcatctgtaccctcctccccacatcggtagaagcctggaactctctctgagagttcagcagactttatcagccactgccacctttgctagaataatatgattaattagttcttgtagaagacagcagggacccagagagaacaggatccagaatgagtgggttttgatggacggggtggtaggatctggggggctccacctacctcaccctgcccccacccccgcactccttccccagtgctgctcagcatagagactagagtgacgtcaccagaaatgtagacacttggaaggacaccagcgacacagagaagaggaggccggaggtccgcaaggcgcccagctcctggcctcggatgcccaggactctgtccagaaaggctccctcccagccatggaacttgatggtcttcgagttcctgaggatagagctggtgagccgtgcccgtgagtccttctgcctcatttgctcctcctgggatcggagggaaaaagagagatgaagacagggacagttgagaactcttccctgcaccctgacagccacccttcagcaaatcccattcatctcaccaaactgcgtcccaaacctgtctgcctctcagcacctctgaccctcactcctggtccaaccaccatcatcctgtacctggacttctgcaggagtgcccctgggataatgtgccccatggaggaagcctctgatgcccggagaacagaggcagcctgagcccacctgggtatgacaccatcaggaaggctacctggaggtggttgatgcctgagctacgtctttttttttttttaccttttacattttttgtggagttggggtctcactatgttgcccaggttggcctcgagctcctgggctcaagtgatcctctgccctcagcctcctaaaatgctgggattacagcctgagctaaatcttaaatgaccaggaagtgcgtgctgagcaggcagaggatggggggatggagctggagaagagggaggggaggggcttgagatgggggtggggggtgggggctggggggtaggggggtggcgggggcacctaaaacccaggcacagggaatagcatgactcagaggacactcagtgtgaccagaggagcgtgtgggcagggtcacttggcactttaaagtcaggcagaagaattcagggtctcctgtgcttcaccatggggcggggggcatcatcagaggggcagctgcctggagaaggttttactttttgagaccgagtcttcctctgtcgcccaggctggagtgcagtggtgtggtctcggctcactgtaacctccgcctcctgggttcaagcgattctcctgcctgagcttcccgagtagctgggattacaggcgcccgccaccacgcccggctaaattttgtattttttgtggaggcagggttatgccatgttggccaggctggttttgaactcctgacctcaggtgatctgcctgcctcggcctcccaaagtgctgggattacaggtgtggcctcccaaagtgctgggattacaggtgtcagccactgtgcccagcctagaatgttttagaggagtccacgcaggaggctgaagaaacagcccaggtgacagacggacactgggacagctgggccaagagaggaaataagttccttccctccatcccccatctctccctctctctttcccgccttttctttccttccttccctatctcctttcttcctctttcctttgctttcttccctctttccttttatttccttccctccctcccccctttcttccttctctccctcattccttctcttccgccctcaattctttccttccctccttccctctgtccttcctcccctttcctatctttccttccctccctccttttctctccttcccctccctccttcctctcctcctttccttcttccctccctcctttcttccatagttcacaaacacttactgagaaccttctgcctgccaagcactaactagatgccgagttggccacaatcagtggcctgtgctgttgcaaagcttccagttaaggaaaacaaggcaatcaaccctgccgggtgcttcctgtaggaccctgtaggttgtgggaagtgctgtggggggaaaaaagcaaaaacaatcccagggcaggcaaaggagaggctgctgctgggaggggagggatggacgtgccatttccttgctggagggtggtgagggaagccgccctgactgcagggaggtgacagaggatcttcgggagtgagggtgatccaggtggagggaacagctaaagcgaaggcctgcagggatgtgtgagatcgggcaggtttgaggatgggagatgtgtggggaaaggcagggaaggaggggagatgggtagaaggtgaggttggaagcaataaggccagctcagggcgggcctggtgggccactgtggggtctttggctcagtctgaggaaaatggggccgctgtgggtctgagtagaggaggggtacaacgtatttggtttgcataggtctcctctggctgggagtggagagaggctgagggcagaggcggggagtgagccaggggcttgctgctgtgacctgggttagagatcatggggttcggagagcctatgctgggaagtgtgacattttggatgcattttgaaggtgatgccaagcaaatctgctgacagatgggatgtgagagaaaaaggcattgaactgacccagggcctgtggcctgaacattggagggacggagccactgtccattgagaggatagggggagggggtgcaggtctgagtgatgggcagctcacagacgacaagaacaaagccagacccgtgggctcgcactcagctctcccctccgcatctcccacaccaggacctgtggcttcctccctacttcctgcctggtccgtccctttcccaaaagccaaacctgatggtggttccttttcttggagatgaagaaattcagagggaggaggctcaggaagacagcgatggcagtgagggcggagggccccaggagctggggatagaaggggcaggatgtcaggagatcccgaggagcccagctctcagaggcacgtgaaccagagcaactccatcttgaatagggactgggtaaaatgaggctgagacctactgggctgcattcccagacggttagggtattgtaagtcacaggatgagataggaggtcggcacaagatacaggtcacaaagaccttcctgataaaacaggttgcagtaaagaaggcggccaaatcccaccaaaaccaagatggctacgagagtgacctcccgtcatcctcactgctacactccaccagcgccatgacagtttacaaatgccatggcaacatcaggaagttaccctatatggtctaagaaggaaaggcatgaataatccaccccttgtttagcatatcatcaagaaataaccataaaaatgggcaaccagcagccctctgggttgctctctctatggagtagccattcttttagatctttactttactaaaaaacttgcttttggccgggcacggtggatcatgcctgtaataccagcactttgggaggccggaggcgggcagatcacctgaggtcaggagtttgagaccagcctggccaacatagtgaaacacagtctctactaaaaatataaaaactagccaggtgtggtggtgggcacctgtgatcccagctactcgagaggctgaggcaggagaatagcttgaacccaggaggcggagcttacagtgagccacgatcgcaccactgcactccagcctgggtggcagagtgagactccgtctcaaaaaacaaacaaacaaacacttgctttcactttatggactcgccctgaattctttcttgcacgagatccaagaaccctcttttgggatctggatcaggaccccttttctgtaacacagctgcagaccccgaaggtggtcagacttgggtcctaagatggggatgtcagggaatctgataagggcagccaccaggtcccagggatctgtgctcatggggtctgctgtgtcaggagatgcctgctgaaggtggggtccttcaatgtcagggagggaaacagccctcttacacgatagggagagagttatattcaagacagattgtgcacacacacgagtgggactggggggtgttcccagccacaacagtaaagttgagacctatggaatcaggggacctggttcaaatcctgaccctgagagttttgagtgtggccttggggcaagtcatctcccttaggtgcaattctcttgtctgcaaaatgggaatagagttgttctcatttggcattttctcttattgcgtttaattattttcctaatcttcatttcatccctcgcaagggttgtcagatttagtaaatcatcatacagaatgcccagttacatttgaagataaagagtgaataaggttttagtctaagtctcgtgaaatatttgggacatacactgagaaattcttccgtttgtctgaaactcacacttcactgaatgtcctgtgttttctctggcaaccctgctcccccaccaacgtggtgattttgggatggttatcttccccctctcggctttggtttctatatctggaaaatgtggaagtggggggtagaataaatgatttttaagttgctgtgactttctgagatttctgcacaggttatttggacccattctcttgacaagccccaccccaactccagtctgtgtgcctcagtttcccgtctcagtccttaggaacactatgtttatttatttatttatttgtttgtttattttgagatggattcttgttctgtgacccaggctggagtgcagtctcatgatcttggctcactgcaacctctgcttcccaagcgattctcctgtctcagcctcctgagtagctgggattacaggcatgtgtcactcggctaatttttgtatttttagtagagatggggtttcaccacgttgcccaggctggtctcgaactcctggcctcaagtgatccacccacctcagcctcccaaagtgctgatattacaggtttgagccaccccacctggcctgggaacactattttctaacattgggccagtttgtttcatttatgcggcaatggcgctacctagtggctcaatggagaagggcgcagagggtaaacaccagcccacagcagggcttggaaaaacactcaaggaatgtgagcagaagatgaacatctctgtctgggggaaaaatggtatcattaaactgtagcaacctcagtgtccactcctccttcaccaagacctcacggtgatgttaggaactgtctaccaagaggcaggaaaagtacacaagcaaagtaacatggtgcattatctatggatatcttgttggtctcatctaattttttttttttttttttttttttttttagaaggagtctcactctgtcgtccaggctgcagtgcagtgatgtgatctcagctcactgcaacctccacctcccgggttcaagtgattctcctgcctcagcctctctagtagctgggattacaggcacatgccaccatgcccggctaatttttatattttcagtagagacagggttttgccatgttggccaggctggtcttgaactcctgacctcaagtgttctgccggccttcacctcccaaagtgctgggattacaggcgtgagccaccgtgccccgcctggtctcatctgatttttagcaacggtggggtcaacctgatcaattgccctgaattttcccatgttcttcctctctccctctctttcttcctaatgatgacatttatgtactgcacatgaagccctgtctgagtgccttatgttgtaattgctaagcacctgcctattgtttgcaaggccctggaatacaaggtgaagacactggaaaaagtcctggcccctagccttagcaaaaacaatcatatgcatgagcattcgagttttttttggaatattcagcaattacaatcaaaatgccattaacagtttttacaaggccaggcacagtggctcatgcccgtaatcccagcactttgggaggctgaggtgggcagatcacctgaggtcaggagttcaggaccagcccagccaacatggtgaaacccagtttctactaaaaatacaaaaattagccagatgttgtggtgcacgcctgtaatcccagctactcaggaggctgaggctggataattgcttgaacctgggaggtggaggttgcagtgagccgaagttgtgccattgcaccaaagcctgggcaacacagtgagactctgtctcaaaaaaaaaaaaaaaatcaaaaggatactatttcacgacatatgaaaatgatatgcacttcaaatgtcagcatccataaatagagttttattggaggaataccatgcctgtttgcttagtatggtctacagccacttctgcactccaagggcagagatgaatatttgcaggagagatggtgtggcctccagtgtaaaaagcatctactgtcttatcctttatggaaaagtaactaatgataatattacaaatacctacagggtgcagttgtgtgcccggcacccttttaagtgctttctacatatgggctcgtttaatgcctcagcccctctggggcaggagtgctactgttaattatgatcctcacgttggagacaagaacaggaggcacagagagagtagggtccttgcacacagattcacaactgataagtggtcagaaggaggatttgagcctaggcagttcccgatacagagtctaattttatttttacttttatttatttgttggagacagagtctcactctgtcacccaggctggagtgcagtggcattatctcagctcactgcaacttccacctccaaggctcaagcgattctcctgcctcagcctcctgagtggatggggttataggcacccaccactatgcccggctaatttttgtatctttcagtagagacggggttggccaggctggtctggaactcctggcctcaagtgatccacctacctcaccccccaaattgctgagattataggcatgagccactgtgcctggcccagagtctgattttaatttaaaaaaagaaaatcctataccacaacgttaaaggaatgaagttggaaagtaaatgttttgtttgttttgtttggttgtttcctgatggctactttgtgttttttgaacactaagtagcaatttttccccctaaaatgttctcctcttgtgttttgtggacagtggctatggtggtgcctcagggttactggtaacttcaaaacatggttaacttgcctactgggtaccctaatagcacatggggaagtatcaacgtcatcatcatcatctttctacagaggaaactgaggcccagagagggtgaacttcctgcccaaggtcaagtgaaggtcatccttattgaggacttttcccatcgtatcagacaatagtaggcaaattgagacaggattggaggaggaggagaaggaggagatgggggtggaaggggaggagaaaaaggaggagaggaagaagaaagggaagagaaggagagggaagagcagagggaagagagggaggacggtagaggagaagaagggagaagggaagaagtgggagggaagatgacagggagcagaaaggaagaagaaggtggagcaggagagaggaagaggaggaggagggggaaggaggaaaaggaaggggtgcaggaagaggagggggtgcgtgggcagaaggtgggagagatgcaggaggagggagggtgcagggaggggtgcaagaggaggggggcaggaggaggaggctggggcagagggagaggggaggaagccttatgagcttctacaccaggaatggaatccagggtgatgaaggcagaacaagggtaaaacctttcatgtgcctctctgacaccaacctggttctcccacagcctcagacttgccctaaccctggggtcacagcggacctcttccagcctcttgaatgctaagtcaggaggaggaagggtgggagggggaaggaggagggggagaaggagggggtgggggactccgttcaaatcccgtcttcctcctctggcatacctgccagagatagacgaagcagaccacgatccagacgagaggcagccacagcccgttgaggtagaggacgctctcggtcagccgctgcacgtccacggacaccagattgaccacatcacccaccgcactggcctttctggagccgctggacagagccaggacctggcgggtgggcagaaggagagaagtaaagtggggaggccggggcagagggatgccccaggtggcttctccacccactgagccccacctcacacgtctgcgaggtgggtgagtaaagtctcttaggccaacctctcagggctctttgaggatccacagagatgacaaaaatgaaaatcctccaagatccctaaagcacgggaggcataataatgaataacatgcacgaaaacaccagattaacacagataacggtggtcatctgcccagtgctcaccatgtcgcaggcactgtgctaaatgaacagccttatcctttcccggggtgctcacagccatgaatggtaccaagcaggcactaccatattcattccctctaatgccaggccaggtgcagtggcctctgcctgtaatcccgccactctgggaggctgaggtgggaggattgcttgatcccaggagttcgaaaccagcccgcgcgacatagtaagacccaagctctacaaaatactttaaaaaattagccagggggccgggtgcggtgcctcacgtctataatcccagcactttgggaggccgaggtggacagatcacctgaggtcaggaggtggagaccagcctggccaacatggtgaaaccctgtctctaccaaaaatacaaaaattagctgggcatggtggcaggcacctgtaatcccagctacttgggaggctgaggcaagagaatcgcttaaacccaggaggcagaggttgcagtgagcccagatcaagccattgcattccagtctgggcaacaagagcaaaatccatttcgggggggaaaaaagaaaaaattagccaggcatggttgtggtgcgcctgtggtcctagctagctactggggaggctgaggtgggaggattaattgagtacaggaggttgaggctgcagtgagccatgttggtgccactgcactctagcctgggcaacagagcaagaccctgtctttaaaaaaaattctatggataaattgctctctattattctctcaccaaggaaaataccacttccagttaaattaagacatgtaagagacatctcgattttggaagtattagagtgaaaaaaaaatgtgagacgagaatcaatgaaatgaacatttactaaccccattctatggctaaagaaactgaggcagagagaagttgagcaacttgcccaaagtcacaggccttgtaagctcctacacaaggaatggaatccagggtgacgaaggcatgacaagggtgagacctttcatgtgcttctgtgacaccaacctggttctctggcagcctcacatctgccttaaccctggggtcacagtggacctcttccagcctgttgaatgctaaattccaaatgcagccctccctttgtgactgcgtgagggtgtgaagaagtgatccaggaatgactggacatagaaattctccacttagcaagtctttgaagagtgctcactgtgtgactcacactgagctgggaactgaaaatacagctgtgaacaacagagatgaggcttgctctcccgggcctggagtttgaggtggggaacaaggctctataataaagatttatataactggccgggcacagtggctcacacctgtaatcccagcactttgggaggctgaggcgggtggattgcttgaggccgggagttcgagatcagcctggccaatatggcaaaaccccatctctagtaaaaatacaaaaattaactgggcatgctggtgggcacctgtaatcccagctatttgggagggtgaggcaggacaattgcttgaacccaggaggcagaggttgcagtgagccaagattgcaccgctgcactacagcctgggtgacagagtgagactctgtctcaaaaaaataagacaaaacaaaaatatttctaaaactcatgctttaatggcagttatgatgagtaacataaaaaagtagcccaggctgagcgcgttggctcatgtctgtaatcccagcactttgggaggctgaggtgggtggatcacctgaggtcaggagttcgataccagcttggccaacatggtaaaaccctgtctactaaaaatacaaaattagccgggcatggtggcgcacacctgtaatcccagctactcaggaagctgagacaggagaatcacttgaacccagggggcggaggttgtagtgagccgggactgtgccactgcactccagcctgggcaacaagagcgaaactctgtcagaaaaaaaaaaaaaaaaaaaagcccagaggttagagaggagggatctgatctcatcaggagatcaaagaaggcctcctggcgtgtgggtggggaataggaagatcaatgcctgctcaccaggcggccttcctcttaggctcaaggaaatgtggactctcaagacaggatagggcacacctagctctggcatgctcaggggaacaggagcctgggatgcagcactctggcaggaaagcatcaagagctgccctctcggccacctaggagctgtcccctctgtcccctcctcccctaggtgacagctcaggtgtcagggaatgacacttacatgggacgggacctgccctggctcagatgctccataccccacaggagccaatagctcttggggcagcagtccagggacttagcttccagagtcccaggaacggacaagagccactgcacagagagaagtctaaagctatggcctccaaccaggtattcacagtcaatggacagaacttccagcccagatgcaatttgggtttttttgttttgttttttttttgttctgagacgaggtctcgctctcttacccaggctgcgctgtagtggcgtgatctcagttcactgcaacctccacctcccgggttcaagcgattctcctgtgtcagcttcccaagtagctggaattacaggcacatgccaccatgcctggctaatttttgtatttttagtagagatggggtttcgccatgttggccaggctggtcttgaactcctgacctcaagtgatccgcctgtctcagcctcccaaattgctggaattacaggcgtgcaccactgtgcccagcctaggggtcatttttaccccaagcagtattgtctgggaacacagctgacaggccaccttatcagaaggttaatcctttatcctcaagggggaatgagtggaagttaaaatcaggctcaaaaattaaaattagattgggggagtagaagtggtgcctagacagtgagaacagctgcaaaggccccagggtgggtgggggcctggagtgtttgaggaactgaaaggagacctgtgtggctggaggagagtgagcatgggaggaggtgacgggatgaggtcagagacaccctagggacagatcacacaagaccttacaggaataactaaggagctgagacagatcacttgaggctaggagttcgagaccagcctgaccaacatggcaaaaccttgtctctaccaaaaatataaaaattagctgggcgtggtgacacgtgtctatagtcccagttactcaggaggctgaggcaggagaatcacttgaacccgggaggcggaggttgcagtgagccgagattgcaccactgcactccagcctgggtgacagagcaagactccatctcaaaaaaataaatacatataatacagagaaataactaaggaagtgagaatgtatggtgagtgactctaataagcaaggactgaatgcgttctcagctgctgataacattactgcccgctcagtgatactgcttttcctggctgggaagacctgcccttgtcccccagggctcacctttctgtacaccaggccagtgatggccgaccgcaacctcatctgcagcaccttgagcctgtacatgttctgctgctcaaacagcgtttgcaggcaggctgagaggaacatcagcacggcgaggaggtagcccttccaggctggaggcttgggatcaccaataaactccaggaaaaggcttgcaggggaaggagggagaaggtacagctggtgagaggaggtgcctaagggtgttgcctttgcccaaaccagtccagatgtggaggatcagtcggcccaaactagtccaggtgtggaggatcagtcagtgtggttttttttgcaataatggtctccgttatttcccccactgtccatactccttttcaatctgactgcagctcctcaagatcaagaggtggagtttttgttcccacttgttataggctaaattgtgtcctcacaaagtttatatgttgaagccccgacccccagtacctctgaatgtgactgtatttggaaatagggcctttaaagaggcaatgaagttaaaaatgaggtcattaggctgggccctaatccaatctgatggggtccttttaagaagaggaaatgtagacacacaaggagacaccagggggcgcaaacagaggaaagaccatatggggacacagggaggaggtggccaactgcaagccaaggacagaggcctcagatggaaccaccttgcagatactaatctcgaacttccagctttgagaatcatgataaaatacatttctgttgttcaagccactcagtctcagtctgtgatgctttgttatgtcagctgagcagacaccacttgaatctgggctggctacaaaaccggctttggccaacagagtacagtggaggtaaagccatgctggctctgagcctaggcctcaagagaaaatgtggtttttggtctatttcttagaaccctcccaagcacccacatgaacaagtctgagctagccttttggaggatggggacccacatggagcagagacagccatcccagtctcagatacacaactgcaggcacatgagaaaacccagccaagaaaagaaccaccacccagctgagcccagcccacattactgacccacattaccatgaactaaataaaagaatgtttgtcattttaagccactcacttttggggcattttacagcaaaaactaattgatgcagtcaggtaagagcttgcttatttgcccttctgggggtcagtcactttctcattaatccatttcccttcctcagtgtccttctcacccaccatccagtgtcccgagcaccagacgtataggcagaggcaggagagctgaagccccctggccctggaaggatgccactaagagaccacccaccttagcagggcacttgaggtctgggactcacctgagcagcttggggacagtgaacctgaagacatcactgatgatgaggctgagggtccccaggaggaaggtagaatggaacacctgccagatggccttcagcagtgggcgccactggctcccttcttgccgtaggaagggctcggtctctggagccttcatgccactgccgcctttccttttaaatgctattgccttgttgtgcctgaggggaagggagagattagctctgggtcccattttatactctcagccgccagcggcagggccaggcattaaagggttgttttcccaacagtggagatgggtgggtgtggatctagcctggctccctcacctgttcctccttatcaccctgagtacccacttaagaggcaatcatgggagttggggggcagggcaggagggcactctgaggcctcttagatggccatgggaaagcacacctgttgagcacctactatgtgccaggcactccccagtcatcctaagaccccctgagaagccaggtgttgttcccatttcacagatgagaaaactggggctcagagaagcgaacttgcccaagggcacacagctgagaagtaaaagaactggaatttgattccagctctctgcctccagagcccatgcacttttcttttttcttttcctttttttttttttgagacgaagtcttgctctgtcgcccaggctggagtgcagtggtgtgatctcagctcacggcaacctccacttcccagttcaagtgattgtcccacctcagcctctcgagtagctgggattacaggcaagtgccaccatacccagctaatttttgtattttcagtagagaaggggttatgccatgttggccaggttggttttgaactcctgacctgaggtgatctgctcgccttggcctcccaaagtgctgggattacagatgtgagccaccacacctggcctctcatgtacttttcaacctatcgtgttgtcaacctggaggaagaacagcaccccgtccccaacacacacaatcagccagcccttaggtggttttgaactggtggagaatcacggctgatgggcatggggcctggtgctctagctctgggtgaaagtgcagacagaagctcaggctgcctcaaactaataagatccccagcctttggctataaccaggggccacagagaagagctaaggtgagggagggagaggaggagatgggggaggcccgagggcccctgtgaggcaggtcagaagccctgggccagaaaggagaggctggggcgatgcagctgctgacagtccggttgctgtgtggtcctgggcggggacactgctcctctctctgtgtgtgagaggatgggtgtggtcccctgctgagtcccctgtggctctgacaacctataaggttatcagtaatttctttttctttttcttttctttttttttttttttgagacagagtttcgctcttgtcgcccaggctggagtgcagtgtagcaatctcggctcaccgcaacctctgcctcctgggttcaagcaattctcctgcctcagcctcccaagtagctgggattacaggcacacaccaccatgcctggctaatttttgtatttttggtagagacagggtttcacaacgttagccaggctggtcttaaactcctgacctcaggtgatccacctgcctcggcctcccaaagtgctgggattacaggtgtgagccaccatgcccggccacttatcagtaatttcaatccccattacagatctgtgacccggggccacgtgctgggatcagctctttacacgaaggagctcactgactcccctggatccccttgccaggtgagcattattaggttttccattttacagaaggggaagctgaggctctgagagatggcgacagccgcccgaggtcacacagcaagggcagagcagggatttgagcctagatcttgatttatggtttgtaaagggtttcttgtgcactaaggacccccaacctcaccataataaaataataataaaaaaagaagcataagaaaaacctctggtgagctcaggtggccagacccttcaaggccaaggtctctgtcccacattattggtctgatctggtgtttggtttggcatctatggagggttgtggttcagctctgttactgagtgggtgtggcctgctgctcacaaatattttggcatttggatctcaaagccaagaagatgccccttccatacagagagcatccctgcccaccctttcctgtttgatcctgccatttaattcattgccttcacagccatgtccatggctccaaccctctctttgtctcgttagaaccccaggtgggtagactttgcctgtgttttccaccaagatgtccctagtatagagtccagctcctgcacacagtaggagctcaataaacacttgtcaaatgaatgggaaaaacagattgagtgatgtgtgcaaagggcctaataagagtgccccctgcacatactgttataaaaatttatagaaggaaggaaggagcttggctgggtggacagaacttggctttggagccaggagactgtggttccaatgcctgctctgtctcctctcctctgagccttagtgtttccatctgcaaaatggggtcggggaagagttcactggaaagttttctttctggctgaggttctgctcagttctatttgagctgtttaacccagagagtcagtgtgttcagcctgcaggctccatagcaagtgttttcctctcctgcaggtctcacctcccatcaaggaagatgtccagattgctgtctgacgtctggtctctggactgaaggccatttagtgcagatctcacaaatgatggtggggcaaggcagggggtatgcatgagtggcatgggcaaggtgtgagttgggggatacaaaagggagtggtggaggccgggcacggtggctcacacctgtaatcccagcactttgggaggccaatgcgggcgaatcacctgaggtcaggagttcagggccagtctgatagcctgagcaacatggagaaaccccgcctctaataaaaaatacaaaaattagtgaagccgactggaccagcaggtggctgttgtgtggcctctcaggaggacgccctctcccttcccccagtggttgcaaaatacttcagaaagaaaaccaaagttctctgtgggtgcagtcggttgtttcagaagctgacggagcctggtctttgtataaccccatctttcccctttctttctgtcaactgtttatgggaggattctcaaactgttctggagaatgtttctaccctttagttctagtgttgggtgacctgtaattttcatgttggctggggatgccaggagttggcagaggctccttccagagcccctgtggactggattctgccacttccgtaaaatcattcaaaagtagagggtgagtcaggtgcagtagctcacatctgtaatcccagcaccttgagaggccaaggcaggcagatcccctgaggtcaggagttcaagatcaccctggccaacatggtgagaccctgtctctactaaaaaaaatttaaaaatcagctagatgtggtggcacacgcctgtggtcccagctactcagaaggctgaggcaggagaattgcttgaacccaggaggtggaggttgcagtgagctgagatcataccacaacccagtgaagggggtccagcaagccatgcctggggtgagagagaactgatgttttggttctctcacactacttattctgtttggaaaaacacatgcccttcctttgtgggaacagcccctacccacttctgtggctctgaagggaccaccagtcatggcaccagccccctgggcatgggattggcccctgacaggcacatgacttgagccaggccaattagaggccttccttgggatttactatatggacgttaggagagagatgctctcttattctgctggagtttgctgaacttgcatgggaagggataggccttatggagagaccaacacatagataatagttgggatgggagatgaaaggagagaatcctgacatcatttgagtcccctgatccagcaacacctgaggctagatcctcttagctgtgtgagcctatagtatcagtctctgtctcctctgtctctcttaatgtgtgggattcagccatctgcaacaactaccacaaaatcccggagtatgcagggaacttcccacagagctaacttccttttttgttctgtctcctaaaacaccaagatccggtgaggttaagcaacgtgtccaaggtcatcactatttgaaggcagggcagcatttaacccaattttatctaatcctatgcaggctcatttatctagaccagagtttctcaaatgaggcatcccaggctctaagggctgcagagaagtttccagagatgccactgagggcaggagtggacagagtggataactccaaagatcttaacaccctctggatgactaacagtgcttgagcacttcccatttgcaagacatttgcaagttcttttccataaatcatccttttttttcatccccataagctatgagctggggctaatgacatccccactgaacagatgagaaaactgaggcccaggaaaggaattgctcaggttatatagtaagtgagcagctgcttgtgtgttgagtcacctcccaaccctccaccccggccttaaaatacctcttctgtttgctgcctgtcattctgccatttccccatttgtaggaacctgtttgttccccgtttgtaggaacctgtgatgcgttctgggaggaaccatatcttaagcctgatactacttagtgggatcagctggaaggcaaggtggggaggcggcagtgccgccagagtagcgttgggggctggactgggggtcaaatgatgaggtttttttgtttttgtttttgtttttgtcttgtttgtttgtttttttttttgatacggagtctggccctgtcactcaggctggagtgcaatggtgacatctccactcactgcaacctctgcctcctgggttcaaacgattctcctgcctcaagcctcctgagtagctgggattataggtgcctaccaccacgcccagctaatttttctatttttagcagagatggggtttcactatgttggccagattggtcttgaactcctgaccttgtgatccgcctgcctcggcctcccaaaatgccgggattacagtcgtgagccaccgcacccggccaatgatgagcttttctgaagtagcatcaggtgagttcttgacctccacccacttacctccgggctgcactgcggttcctcatccactccttttcaagccgggaaacaagttcttctgaggagttttctctcccaagcgaccagaggtcttttggtctcagtggcctcctgtatcccctccagaccaggctgcaaaagaggggcaccagggaaagcttttcctgccattcacccctgcaggatcctggccaggcgagtagctgtgtgaccctgggtaagtcactttacctctctgtacctctactggcccctgggtaaaaagaaagcaattcactaaccccacctaatgtctgcagggcatttctcgtttcacaaagattgtctcattaattcttacatgaacccataaggtaggttattattgtttgtttgagatggagtcttgttctgtctcccaggctggagtgcagtggtgcaatctcggctcactgcaacctccacctcccaggttcaagcgattctcccacctcagcctcctgagtagctgggattacaggcacccaccaccatacccggctaatttttgtattttttgtagagatggagtttcaccatgttggccagactggtctcgaactcctgacctcaggtgatccacctgcctcagcctcccaaagtgctgggattacaggcatgagccaccacacccagcctgtaaattgatagtttataattgtataaatgtatgagtatattattatagatctattttacagatggggaaggaaatagaagtgcagagagattcagtggctaaaccaagggatagcccttggcaagggaaacagacatttccctgggaatcagaagtccgttgaccaaaactatcattgtagaagaagcttgaactcctccctcagctttttttttttaattattattattttttttgagatggagtctcactctgttgcctaggctggagtgcactgatgtgatctgggctcactgcaacctccgcctccctggctcaagcgattctcacgcctcagccttctgagtagttgaaattacaagccaccatcacacctggctaatttttgtgtttttggatggtgtatcaccatgctggccaggctggtctcgacctactggcctcaagcaatcctcccacctcagcctcccaaagtgctaggactacaggcgtaagccaccacacctggctaatttttttgtttatagtagagatgggatttcgccatgttggccaggctggtctcgaactcccggcctcaagtgatctgtcagggttggccttccaaagtgttgggattatgggtgtgagccactgtgcctggcctcaggtctctttaatctttctgatgacaccagccagaaggtcttgcctggttctggtctctgactcttctctaagccttaccaagttcccttttcttttttatttttattctttttatttttttgagatggaatctcactctgttgctcaggctggagtgcactggtgtgatctcggctcaccgcaacctccacctcctgggttcaagtgattctcctgcctcagcctcctgagtgactgggattgcaggctcccaccaccacacctggctaatttttatatttttagtagagatggggtttcaccatgttggtcaggctggtctcgaaatcctgacctcaggtgatccacctgcctcagcctcccaaggtgttgggattataggcgtgagccactgcgccaggccaccaagttcccttttctaatgcagagccaacttggggaagcaaccgttctgacatagaaattattaacgtggcttgattttccctgaaattatttttggagttctcctatatggcaagtgatgctatagatttttcctattttagcagtgatagagagtttctttttaaaaacagtttattcgagtaaaaaaagtgactcaatttagtttttgccccagtaggacaaaaaagcatcaagagtggtccataaatgcttaagtttgggaagcaggggctggaccccccagtagagctgtttcgaaaacctctaagctctttctaccagttccacacattcaaagcctgatatttttcatttatttaatagccatttaggccgggtgcggtggcttatgcctgtaatcccagcactttgggaggtcgagtggggtagatcacttgaggtcaggagtttgagaccagcttggccaacgtggtgaaacccggtctctacaaaaaactacaaaaattagctgggcatgatggcaggcgcctgtaatcccagctgctcgggaggctgaggcaggagaattgcttgaacctgggaggtggaggttgcagtgagctgagattgtgccattgcactgcagcctgggcaacaagagtgaaactctgtctcaaaaaaaaaaagagaaaatgaatagcccaggcacagtgggtcacacctgtaatcccagcactttgggaagccgaggcgggcagatcacctgaggtcgggagtttcagatcagcctgaccaacatggagaaacactgtctctactaaaaatacaaaattagccgagcatagtggtgcatgcctgtaatctcagctactcgggaggctgaggcaggagaatcgcttgaacccaggaggcggaggttgcagtgagccaagatagtgccattgtactccagcctgggcaacaagaacggaactccatctcaaaagaaaaaaaaataattaccacttaaactcattatttgccaggccctgttctaagtgctttacagatctcatcttatttaagcttcacaaccctatgagctaagtgctactatcaatcccattttgaaggagtggagactgaggcacagagaggttaagtaactgtccaaagcaacacagctaggaagtggtagggccaggattcaaatccatatgtcaggtgctactgaggtctgaatgccgtgtggttaggagagagcacatcctcaagtgccttgtgagctggccctggagaagcagctgttttctcaatctgcctggaaccctctagaaagtagacacttgctcctttatctcctcacccctggggcttagcacatagtaggtgcctattaaatgttggtggaatgactgaaatcaagtattggagacaattctaattactattaagcacccgctgtgtgcaagcactaagcactttccgtctcatgcaggttgagtcatccccattttacagagggaaaactgagactccggaggtttgcgacatggcctgctaacaggcagagccgggattcaaatcaagatctcactccagtgagtgaatgggaacaggatgcagatggtagacactgaacacgaagaagaaagcactgaggctgggatgaagaaagacttgctggcctttgtaagcacaggggaagggccatggctgggaatcagagcagcaaatgcaggcgggtgaggcaccaccccaacccttccgtgcgactttacttacccagaaacccaccagaacgtggctttggaggggaaggctgccccagtctctggacaggggttctgcaacagacaaaaatggagaagggaagtatgtggcaagggtaggaagacaggacgaactgtgtatttttttttttttcgagacagggtttcgctctgttgcccaggccagagtacagcggtgtgatcttggctcactactacctctgcctcctgggttcaagcgattctcctgcctcagccttccaaagagctgggatgacaggtgtgcgccaccacacacagctaattttttgtgtttttagtagagacagggtttcaccatgttggccaggctggtctcaaactcctaacctcaagtgatctgcctatctcggcctcccaaagtgctgggattacaggcatgagccactacacccagccctgacggtgtatttagtactgaaagtaaacatcgaggtgccctgtctccttgccaggggtgtagaccagtgagcttggtgcttcccagcaggcagcgtaaaaagaggttgggccacaggcctgacaatgtccacaaggtaagaaataacagtggctcagaagaacaactatgattatactgaaaccaaaaccttgctttgcttctcaaaaggaaggacactgcataacgaagaaattagatccttgacaatatccctcggcaaatgttgtgaagacagacctgtcgtgcgatttttgtcaggtgctccaggaagattacaacagtctgtactctttaccaataaggcgtgaaggtgcccatttcaccacgtttttgccatcacagcttattaatttttaaattttgttgctactctggtaggtacaaaaaagattcctatgatagttttaactattctcaagccttcgagcaatttttttttttttttttttgaatacagggtctcgctctgtcacccaggctggagtgcaatggtgcaatcatagctcactgcagcctttatctcttggattcaagcaatcctcctgctttagtctccacagagctactctgtagtgggactacaggcatgcaccaccacactaggctatttttaaaaacctttttgtagagatggggtctcactacattgcctagtctgatctagaacacctgggcacaaacaatcctccttcctcggtctcccaaagtgttgagattacaggcatgatccactgcatctggccccatttgaacatctgtttatatgatgtcagatcagtctcttccacaaaagaattgtttcttgatttcacagactgcttcactgttacctattgtaaatctctcaatctctcatgagcttcttctatggagcacttaccccaagggtaattttctttttccttctttttttttttttttttttttggtggagttccgctcttgttgcccaggctggagtgcaaatgcacagtcttggctccctgcaacctccacatcccggattcaagcaattctcctgcctcagcctcccgagtagctgggattacaggcgtgcaccaccatgcctggctaatttttgtaattttagaagagatgaggctttaccatgttggccaggctggctttgaactctcgacctcaagtgatccacctgccttggcctcccaaagtgttgggattacaggcatgagccactgtgaccatccaattttcaacatatttgtttaattttgtgaccagtgtctggttcccctgcttgaccagtagctacgtgagaacagaaactctatctgcttgttcaccatagatccttatgcccttgctagggcatagcggggtttggcaaactatgaccaaatctggcccactgcctgtttctgcaaatagtgttattgcaacacagccatgcaatttgttgacatattctgcttttgcgttcaatggcagagttgagtaattgccactgagatcactgtatggctcacagagtccaaaatattttctcttggcccatatagaaaaagtctgccaactgtggcatcgagtagaaatgtggtacactttttgctgaatggctaaatgaataaaaaaattaaagacttttggtcacctgggggagactgagacctcaaagtggaacaggaatgaggttggaacttggtgacttacagactgctgggggtcttcagggaagaaggggggttgatccgccaggcaggacagcacaaactgtgccaccaccagagacaggcataggtaggtggacaggtggcggacagggtcgctctggaagccctgtgggagggaaagcagaagataaggaatggagacagaggagggtgctcagaggagagaaaaggtttctgatcttgggtcagtgcccactctggggaccagggcaagagtatttgaaagccagagccctggctttcctagtggttctaattttctttctttcttttttttttaagacaaagtctcacttggtcgcccaggctgaagtgcagtggcatgatctcggctccctgcaacctctgcctcctgggttcaagtgattctcctgcttctgcctccttagtagttgggattacaggtgcccaccaccatgcctggctaacttttttaaaatatttttagtagagatggggttttgccatgttggccaggctgacctcaaactgctgacctaaagtgatctgcctgccttggcctcccaaagtgttgggattacaggcatgagccaccatgcccagcaggtcctaattttcaaatacccaatttataatattctgtctatacaaatggtgggccagggctgcgtctgggttttgtccttagccacatgatgattggccacagctgctgggacaatgagatgaagaaacaatttaccttcttctttgtgccacaaaagaaatcctttctccgttccaccctctaccccaatcttcaaccctgctcccccttggccagggttctctgttttgcagagatgagagctggttttattgagcactgaccctgccctgagcacatgcggcattcttgccatacacagtctcatcagctggagtttacttgcttcctttgactcagggggaaaccaaggctcagagaagtgacagcaccttgttcaaggacacgcagatgatctggtccaaattgtgatgctcctgctgccacaccacaatgatttttgcatctgctgccctgtcatctggtcagaaacaccctaattttctttctttttttaatttaaagcattttttattttttaattttaggtgtgtgtgtgtgtgtgtgtgtgtgtgtgtgtgtgtatactttttttttttttgagacggagtcttgctttgtcacccaggctgatgtgcagtggcatgatcttggctcactgcaccctccgcctcctgggttcaagcgattctcctgccttagcctcctgagtagctgggattacaggcatgtgccacgacccctggctaatttttgtatttttagtagagatggagttttaccatgtaggccaggctggtcttgaactcctgacctcaggtgatccgcctgccttggcctcccaaagtgctgggattacaggcatgagccaccgcgcccggcctgatatatatatttctggatgacgtgagatattttgatacaggcatgcaatgcataataatcacatcaaggtaaatgaggtctccatccccgcaatcatttatcctttctgttacaaatgatccattctactcttgtagttattttattttttagtttattattgagttggagtctcactctgttgcccaggctggagtgcagtggcttgattttggctcactgcaacctccgtctcctggattcaagtgattctcctgccttagcctcctgagtatctgagattacagatgtgtgccagcacgcctggctactttttttgtatttttagtagagacagggtttcaccatgttgcccatgctggtcttgaactcctgacctcagatgatcctcctgccttggcctcccaaagtgctggaattacaggtgtgagccactgtgtccagcctcttttagttattttaaaatgtacaattaaattattattgactatagtcaccctgttgtgctatcaaatagatattattctttctgtttttttgtacccattaaccatccccatttcccccacccactgtccttcctagcctctagtaaccttccatctactctatatgttcatgagttacattgttttaatttttagctttcacaaataagtgagaatatgtaaagtttgtctttctgtgcctggcttatttcacttaacatccatgttgttgaaaatgacagtacctcattcttttttatggctgcatagtacttcattgtgtatatataccacattttctttatcagttcgtctgttgatggacacttaggttgcttccaaatcttgtttattgtgaacagtgctgtaataatcatgggagtgcagagatctcttccatgtactgattttctttcttcctaagttttttgcttgtgttcgggcgtgtgatttgtgcagaactgactctactccgaggctgggtgggtgaatgaggcctggccaacgaatacgttctggtcttttggctaccatggcagggttaggaatgcacatagcaccccatgctgggtacttgagagctggaaccatcgggagattctgctggctttgctacatgctagaatgtaagtgtgaaggtattggtggctcttcttgccactccattggagaatcaagctaacatggcagagccaagaggcagaagtggagatctggtgatggtacctggtcccaggcctggatcagtcatgcctgggagatcccatgggtatgagctaataaatgcatgagctaatgaacccccttgacttacccttttcattaagctagtgtgaactgaggttttatggctttaaaccagagccctagttttaaatcatgattcctctactggattttatactcttctagttttgggtttttgtttgtttgtttgttttttggcagatagcagacaattggatattccaatgacaatatggcccatcttccctaaactcccactgttttccccactgtttctctcagaaagtttgttctgaatttgcctgagatgaactcgggctctgcactcccaagctttgtggccctgaggccgtcattcccttctcctagccttagtctccctcatctttaaaatgggacggctagaattcatcattggctggggcacattggctcaagcctgtaatcccagcactttgggaggcttaggtggaaagatcgcttgagcccaggagtttgagaccagccttgggaacataatgagactttgtttctatttctatttaaaaaaataaagaacccatcactgtgaactcttgtgagaatccagtgaggagacgtgtgtaagtgcctgccacagtgcctggcacatggttggaaccccagaatgtatatggtcccagtattattgtttctatgctgtgtcccaaaaagctgacttatgtcaactgtgggagcccaccatttcagaaattactgaataacctgtggaatttccccttagttacaaaggttactcttttaaaaactctgtcctcggtcaggcgctgtggctcacgcctgtaatcccagcactttgggaggccgaggcgggtgagtcacttgaggtcaggcatttgagatgagcctggccaacatattgaaaccttgtctctactaaaaatacaaaaattagctgggcatggtggcacatgcctgtaatcccagctacttgggaggctgaggtatgggaatcgattgaacccggaggtggaggttgtagtgagccaagatcgtgccactgcactccagcctgggcaatagagcaagactctgtctcagaatgaacaaacaaaaaataaaaactctgtccttaaggacagggtgatgcttctctaccttctcctttaggggcaggatggagtaaccactggactgaagaaatgatctgtgagtccagacgtggtggctcatgcctctaatcccagcattttaggaggctgaggtcagagaattgctcgagccgaggagttcaagatcagcctgggcaacaaagcatgatgttgtctccacaaaaataaaataatgaagtaaaatatctgaaacctgctgcagcctgttcattggtgttaagataactccctctcccagaagccttggctaagcacactgtcgaggccagtgcttctcaataggtgggtgactttgtcctcctcacccccagggacacttggtaatatctggagacattttgggttactgcaattggatggtatgctactggcacctatgggcagaagccagggatgctgtttcacaccctgcagcaaacaagacagccctgtccacccaacaaagaattgtctggccacaacattactaaagctgaggctgagggaagttggtctaggctacatgtttttctctttacagagaaaatgacccatcatgtctcctaatagagaaacgctgcttccggccgaatgacaagagctcacgcctgtaatcccgacactttgggaggccaaggcaggtggatcacttgaggtcaggagctcgagaccagcctggccaacatggtgaaacctcgtctctactaaaaatacaaaaatttttagtagaaatttagtagaaatttttagtagaaatttagtagaaatttagaataagccaggtgtagtggcacacacctgtaatcccagctacacaggaagcagaggcaggagaagtgcttgaacccgagaggcagaaattgcagtgagctgagatcatgccacttcattccagtctgggcgacagagcaagcctctcaaaaaaaaaaaaaaaaaaaaaaaaaaaaaagctgcttcccagattgggcaacagaaatacgagtggtgtgcagaatgagtgtgtaaatataggtgcataggaacatggggagggtgaatccatgacatgaggggaggtgtgcacggaggggtatgtgtgcacacaggtgtgtctgtgcccaggttgtgtgtgtgtgcgtgcatgcatgtacttgtgcgatgtatgaatcagtgcctataagtgtgtgcatcgtgtgcaagtggcacgtgtgatgtgggcctgtaagacaggaaattgtgttgataagaaatgtatgggatgatgggtactgacaggtgcgggagtggattttgtgtctctagagtgtaagtgactggcttgtgtgtgtcactgtatagagaataagttgtatgtggaaacaggaggagaaaggaagggacccaaggcatgagccaccattttggtttcccagggtggcccacgccccgacttaccgctccggaggcctgctgggcagcgttggtagctggcaagacaaagcagagaagccagtaaccaaacagcactccagatgactggactccctttttcctctcggtgtgaatcaggaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatcgtggtgagccacacagtaggatgaatgaggaattctggggcctcaggcgttccctgttggattttccaaagagcgacagccacgctggaggtacacaggactatgagggcgaatccaagcacctgaggatacaggcttagataagcttggggggcaataagagaggtcacagcaaactggtaggcggccccatgtccaactgggagctggttctgcaacatcctggctgatactgagtataccagggtcaccagctagcaacgtgccaatgtgaacaatgtgtaaagggcattgcagatcactcctgacctgtaactgtcatataaataatgcacaggaagggcttgagccaaccgagtgttttccaaaatgcaggaagtgctccaatcgtgcacatatgagatgactgtgggtatggagaaacagcaggaaatgaaatgtactcaccaggtaaaaaactatcctttctccaagtcatttttcaatccctgctatgaaatcaaggagcaactctctgttgggccagtaagtctctagggtctctctaatatattttggtttctctattgaataaaagaaaggaagaaaatgagagaacgtgggcacaccagagggaaggccagagctaggttacgttggaggaactgctcaaagaacctcagtttaaagcagaagttggcaaactatcaatcatcaaagaaaaacaaaaagcatatgtcatgacaggtgaaaattacatgaaatccaaatttcagtgactacaaataaagttttattgaaacgcagtcggccgggggtggtggcttacacctgtaatcccagcactttggcaggccaaggcaggcagatcacctgaggtcaggagttggagaccagcctggccaacatggcgaaaccctgtttctactaaaaatacaaaaaaatagcgaggtgtgggggtgggcacctgtaatcccagctactcgggaagctgaggcaggagaatcacttgaacccaggaggcggaggttgcagtgagccgagatcgcaccattgcactccagcctgggtaacaagagcaaaactgcatctcaaaaaaaaaaaacaaacaaaaaagtaacacagtcatgactattgtctatggttatgactattgcgttcattctggaatggcagagttcagtgttcggaaggaagattacctggctcacaaagtctcaaatactgtgtaccgcttggctctttaagtttgccaacccctgggttggtggcgggtgataatgtaaaaattaatacaatggcagaagaatgaatgaactctgaagaacattctttggaagcctacaagaatggagtagaagaggatggatgagcagaaaggctcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtctgtcgctaagtctctgggcagactgctcggccgcgatcctgccggagaagaggcggggctgggctggtcgggctgggctggtccggctgggattcgagctccgggatcgggaggccccgggcaaggtccagctgcgcggcgggagtgaggccacgggaggtgaaaacaggcgaggtgggggatgggggaagagaggcgctcggggagctgggacgggcaccgggttggggggtcccggaacccctgaaagttcagtgacacctccatagttccctcttccccctgcaacaagaatcactccagacttcctaaacactttggacccagcaatttccaggagttcatcctgatgagagaactgaaaggtgtgcacacgttagtaacaaggaggcctggtgaccgcctaagcgtccaatcgcggggaccaccgggtcgaggccgagaggatggagaccgcgtcacaggcacctcgctgctggaatggagggtggtggggagaacttagaagattatgcaatgggctggcagggctatacccagccgccctggtaagcagaaactcaagaaacctctagggtcctgttttctggtcgtatgatcccaggagtgcacatgggcccctcgggtgtctgaacagaagggcataggagggagggccgcagccctgcagtcttactctgctggtgtagcggtcacctgccaactcccaccccaccctgcaccgcgggctcctgagtcggcagattaagcattttataaattctattttaaatacgtgttttaaacttgtcagatatttgtcttcatttcagtccctgcgcctctacctcttgctgtggtcgcttatttaacactggggggctacgttctgctaagtcccagggagagactgttcctaatatccgagggagatattattcctaatatcacgctgggtgaacaccacgtgtgtacagcctctgatacgattggtaatatccaagggagatattatcctaacatcccagtgggtgaacaccatgtgtgtaaacgctgtggtattattagaaatatccaagggagatattactcctaatatcacagtgggtgtacatcctgtgatattattcgtaatatctgaaggagattttactcctaatatcacagtgggagtacacactgtgatattatttgtaatatccgagggagattttactcctaatatcacagtaggtgtacaacctgtgatattattcataatatgctagagatatattactccaaatctcatggtgggtgtacactctgtcatagaattcgtgatatcctagggagttattaccgctaatatcacagtgagagtacaccctgtgatattattcatactatcctagaaagatattacttttaatatcacagagggtgtacaccctgtgatattattcataatattctatgaagatataactcctgatataaccgtaggtgtataccctgtgatattatttgttatatcctagggagatactacacctaataccacagtgggtgtacaccctgtgatatgatttgtaatatcctagggagatataactcctaatatcacagagggagtacaccctgtaatattattcataatatcctagaaagataatactttcaatatcacagtgggtgtacactctgtgataatattcgtaatttcctagggagatactactcctaatatcaccttgagtgtacactgcgtgatattattcgtaatatcgtagggagctattgcttttaatttcacagtgggtgtataccctatgatattattcataatatcttaagaaggtagtactcctaaaatcacagtgcctgtacacactgtgatattattcataatattctagggagatgttactcctaatctcatagtgggtgtacaccttgtgatactatttgtaatgttctagaaagatattccttttaatatcacagtgggtgtacaccctgtgatatgattcgaaatattctagggcgatattactcctaatatcccagtgaatttacaccatgcgtgtacacgctgtgacctcccagaaagatatgactcctaatatcacagtgggggtacaccctgtgctattatttgtaataccctatggatatcataatatcacaatgaacgtacaccattgtgtacatgctgtgatattatttgtaatatttttgggtgatattacccctaatgtcacagtgcgtgtacatcttttgatattatttgtaatattctgtggagatattgcccctaatatcacagtgggtgtatactctttgatactattcgtaacatcctggaagatattatccatattgtcacggtgggtgtacaccctgtgatattattcgttatattctggggatatactattacccctaatatactgtgggtgtaccccctgtgatattattcactatatcttggagatataatattacccctaatatcacagtgggtgtatactttgtgatattattcattatatcctgaagagatattatttcctttaatatcacagtgcatgtacaccttgtgatattatttgttatatcctggggagatactactatattactcctagtatcacagtggctgtacgccttgtgatactattcattatatcctggggagatattattactcctaatatcacagtaagtgtataccctgtgatattattcataatatcctgggagatattacccatattgtcacagtgggtgtacatcctgtaatattatttgtaatatcctggggagatattattactcctaatagcacagtgggtgtacaccctgtgatattattggttatatcctggggaggtattattattcctaatatcacagtgggtgaacattctgtaatattattcattatattttggggagatattaattcctctaatatcacagtgggtgtacaccctgtgatattattcattatatcctgggaagatattaatccctctaatatcacagtgggtgtacaccctgtaatattattcattatatcctgggaagatattatttcctctaatatcacagtgggtgtacaccctgtgatattatttgttgtatcctggggagatattattatgtctcatatcacaatgggtgaacaccctgtgatagtattcgttatatttggggaagatgttattacccctaatatcacagtggtgtacactctgtgatattattcattatgtagtggggagatagtattacccataatatcacagtggatgtacaccctgtcatattatttgttatatccttgagaaatattattattcctcttatcacagtgggtgtacaccctgtgatattattcgttacatcctagggagatattgttacccataatatcacagtggatgtacaccctgtcatattattcgttatatccttgagagatgttactacccctaatatcacagtgggtgtataccctgtgatattattcatcaaattttctggagatattattacccataatatcacagtgtgtgtacccactgtgacagtattgattatatcttggggcgatattactcttaatttcacagtggctgtatccctgtgtttacaccctgtgatgttattcataatattttagggagatattactcctaatatcacagtcagtgtataccatgtttgtacaccctatgatattatttgtaatattttagggagatattactcctaatatcgttgtgggtgtacagcatgtttgtaaacactgtgatattattcataatatctgagagagatattactgccaatatcacagtgggtgtacaccctgtacaccgtgtgatacgattcataatatccgagggagatattactcccagtatcacagtgggttaacaccctgtggtattattcataatattcgagggagatattactctcaatatcacagtggatgtacaccctgtgatattatttgcaatatccgagggaaacattactgctaatatcacagtgggagtacaccctgtgatattatttgttttatcctggagacatattattcctattatcacagtggttgtacaccctgtgatattcttcgctatattcatggaagatgttattacccctaatatcacagttggtgtacaccctgtgatattattcgttatatcctggggagatattgttacccctagtatcacagtgggtgtacgccctgtcatattatccattacatcatgggaagatattattacatctaatatcactgtgggtgtacaccctgtgatattatttattatatcctggtgagatgttattactgctaatatcacagggtgtgtcaaattttctggagatattattacccttaatatcacagtgggtgtgcaccctgtgtgtacactctgtaatattattcgtaatattttagggagatattactactaatatcacagtgggtgtacaccctgaggagatattacttcctctgatatcacagtgggtgtacaccctctcatattattcgttatgtgctaagtagatattattacccctaatatcacagtgggtgtacaccctgtgatgttattccttatatcccaagaagatattattataactaatatcacagtgggtgtacaccctatgatattatctgttatatactggggggatattatttgtaatattttagggagatactactcctaatatcatagtgggtgtactcatattttacagatatattacttttaatatcacagtgggtgtacaccctgtgtgtacaccctgtaatattattagtaatattttagggagatattactcctaatatcatagtgggtgtacaccatgtttgtaaaccctaggatattattcataatatccgagggagatattactcccaatatcacggtgggtttacaccctatgatattatttgtaatatctgaggcaggtattactctccatatcacagtgagtgtacaccctcctatattattcataacatccgagggagatattacttccaatatcaaagtgggtgtgataatatctgagggagatattattcctaatatccgtgggagatattattcctaatatctcagtggttgtaccgcgtcacagtgggtgtgcactgtgtgatattattcatagtatccaagggagattttactcctgatatcacagtgagtgtacaccctgtgatattattctaatacccaagggagagctttctcctaatatcacagtgggtgtacactctgtgatatttttcataatatccgagggagataggatggagaccacgtcacagtcccctcactgctggaatggacactgtctacccgtggagtggtggggagaacttagtgagattatgcaagcgtttagcacactgccagatatacattaaatgctcagaagacttagcttttattattactgtcataattgaggccatgggttactaaccagtggtttaaaatgccattgcagctgggcacggtggctcatgcctgtaatcccagcactttgggaggctgatgagggcggatcacttgaggtcaggagtttgtgaccagcctggcaaacatagtgaaaccccgtttctactaaaaatacaaaaattagctgggtgttttggtgcgtgcctgtagtttcagcttctcaggaggttgaggcaggagaatcgcttgaacctgggaggcgaaggttgcggtgagccaagattgtgccactgcactccagcctgggtgacagagcgagactctgtctcagaacaagcaaacaaaatgccattgaagacatatatgaatatgaaaaggtgcttgctaaatgatgattgaataaaagagattataatataaaataggctttggtttttttaaagcaaaaaagaaaaggatatgcctaaattagggaacatggagaagaaggccaaggcatttaccttcctctcttgagtctttttctctctccgtctctgttttttttttttttttttttgagtcagggtcttgctctgtcacccaggctggagtgcagtagtgccatcatggctcactgcagccttgacctcctgagctcaagcaaccttccacctcagcctctccggagtatctgggactacaggcacacaccaccaagcctggctaatttttaaatttttttgtggagacttgtctcactttgttgcccaagctgctttggaactcctggcctcaagccatcctcttgcctaggcctcccaaagtgctgcgattacaggcgtgagccaccatgcccagctctctcttgggtcttaaagcaaagtgtcaaagacccagccaccacttcttagaaatgactcgatgtcatactagcataaatgcatcgataaaaagatggaaatgtggtaacacagtgatcttggggaatcctagttttcttttccaatttctttgttgttgcagtgagcaagtacttgtttcaagataggaatgaaatattcggctcttttagacagacaagcacaggtgctcagtttgggagaagaattaaaatcctctgcactctccatgctgccttgctaattcttggggtcctgtcctcatcttctactcttgccttctgcagggaccccacagtgtgttttccccgatctttttgtatcactctaaatccagtattgggcccagggagcaccccctcccctgcccccttcagctgtcctcctgcctgagtcttctggaagcttcgggacagaaagaacccaaggatttgtcatgaagctcagtgtggcaggtctactgtttccatgtaaatcatgtctgcttatctgagctggttttggtggaaactgatggaaattatggggaagctaaatccctgtctctctgcaagccactccccaatcccacccccatgaattggcattgtcacagtcctggtgcttcatttctttctatatttgaagatgaatttgagggaaatagtcagaaagtcaagaagaacacagcagaaatcaattggggtgagtccagaacaaaacttggggatcccacttcctgctttttttttttttttgagatggagtctcactctgtcgcccaggctggagtgcagcggcaagacctcagctcactgcaacctgtggctccctggttcaagtgattctcctgcctcagcctcctgagtagctgggattagaggcatgcgccaccacacctagctaatttttgtatttttagtagagacagggttttgccatgttggccaatttggtctcgaactcctgacctcaaatgatctgcccacctcggactcccaacatgttcatattacagtagtaagccacggcttctggccccaattcctgctctctagctccgggaaaacctgtggctgcatgcagagtcttagacaacttccttttcctctctgggcctcagtttcccattctgtaagatgagaggtttccataggcctacactttctaattggtggctttcaatcctctggtgatttgcataaaaggcatctatttcaattgtggttataaataacaaaccccaataaatagacgaattatttaaatggtttctcattatcactgaatagttgagagtctactgtatttgagtgaaaatgcagcacgagaaactgaaatcagatgcgctcatgattatgaccctgaggtcaatgtgtcattcccttcattccctccttgcccccatgaaggtttgactactgtatggtttgaacctgtgcttcttagttgtttattgcttaagttttagccacaacggcaaattgcagcgggaaattcagtcttactttgtcatttggaaacaaaatacaaaacctatcaaaataaagcactagcttttttttttttgagacaaaatggaagaaatcctaatattaggttagaaaagcaattttttggtgtttttaaaattttatttatttatttttttgagacagagtcttgctctgtcgcccaggctggagtgcagtggtgcgatctcggctaaccgcaagctccgcctcccaggttcacgccattctcctgcctcagcctcccgagtagctggtactacaggcgcccgccaccacgcccggctaagtgtttatatttttagtagagacggggtttcactgtgttagccaggatggtctcgatctcgtggcctcatgatctgccagccttggcctcccaaagtgctgggattacaggcgtgagccactgtgcccggcctctttggtgtgtattttgatgtggtgactggtagttaaattcagtgtacatatgaattcactcttgggacaaaatatgctggatttgagcttgttttcaggcaaatcatgtttcatcttgcagagctaattcaaagtatactgactgcatgcacttcttgcttaggggaagaaaactcatcaaaatttgtttctaggcatatgttattagagctaggattaaaataaatcttacatactttctttaatatgctaacattaacacgtttcgcttaaaaaagtatcgatcatttatcatggaaaaatacaccagcttacacaaattcctaaagcgtttttcgtgtgtgtgtgtgtgtgtgtgtgtgcgtgtgtgtgtgtagagatggggtttcgccatattgcccaggctggtctcgaactcctgggttcaagcgatccacccacctcagcctcccaaagtgctgggattacaggcgtgagccacacacccggccctaaagctttttgtgagattatatattttacctgcgaaatatatgggtcagaaagatttgagaaagttgttagataattccaccaacgaaatctcccgtcctttccagctgtgatggtgaattctaaagtagaattcatctttggagcttctccctgtaggcatgcaccttgcgttgcacctgccagatgtcgcgcggagtcctccaggcctctagaaggcagagatggtctcgtttccttgccgagcatgcgccttagttctctcttctggggctgtgaccgtggggtcgaagcgcgcgtgcgcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgaggtgagcgcccgccccgccgcccggcgccgagtcgccgggccggtggttcagcctctctgggccgcgctggcctcgtctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaacctagagaccacatgtcttatcccccaaactccacagcccagaaccccccgaagttctaatccactgctcctccaaaccccgcggcatgattttaaagagcatcaattcccatcccatagatactgacctagtagatcagtattggcaaccctggggccggaaagctattttttatttctccggctcccctccacttctgaaaatggagagttgccagctgccctgattgccttaatgagtagttaatggaattaccctagagatttgtgctgaaggttttttttttttttttttttaattaagttgtaaagtcctgttaaatgtttatcagcccggtgggattatgacccagaaaggttcccgtaaagaggaaagggatggatggaggtaggggcagaatgtcatttgtcccggtagatgggaggggaccagagcaaggcctgggcctcatttttgggaggggatttatggtggggtaggacaaggaagaggaaaagagcgggtgcctcggaggtaatttaggagaaaacgaaggaagaggctgggaaatgccaaagagagggattggggaataagaccccaaagatcgtctgaaagcacctttgagctgttccagggctggcagtgaagggtgaagctctgtgttctgcaaagcgggctgctgaggattgggggaggggtagggagtcagttccacaccccaccagctctgcgacctgcccttgctctaggtttcagtttttgtacctataggatggtgttgggagagaaacagtggaacccagcagatacatttctttaacaagcggatccgtgatcttcttcaaggcccccttgtttgctgctttttcagactgaagaggtcagaggtcaggcattgaatgaatctacccactggcagcggcagggctcctaggatttcctgggtacatgtttctgggtgcccatgccacctcctaggtctgcactggggacaggacacgttcagggtggtatggctgtagacggcacagggcatttcagaagctgaaatgcaagaggccgctaaggcctcttgcaacttgtagtttccaggggttctggaaggaaggaaaagacaggcacccccctccaccctcaccctcatactaatagtgaccttgagagcagagaacaggttttgtgacccatttcaaagtgtgttccttaagcccaagggctgcctgtccagatggtgtgggacactcattctttcataagtaattcagattctgaaatcagacatttcatactggccatcttgatgtagattacattgccatcctgtgtcctgattgtactttatgaaagatgtagaaacaatcatgatatttcacggttatttcttgattgtgttttttgtgttcctatgcaactgccgccattcttctctagctttctcccatcctgagtgtttttacatcgtgttcattgagtcaacaactatttactgagccccggcacatactgaagccttgtccccagtgtggatatagcagtacagtgaacagaacagacaaaactccatactctcatgagactgacattttgttctctaacagggaccttactgttaaaaaaaaaaaaaattatactggttgctaatactttaacaatcagcaggtttcacattaaaaactgggtgctttatttctctggaaagccagccgatctttaggctgccacacttggcttgggttttgtagtgatctgaatccttttggatgaatgtcccttgatgttgcctccctaaccggtctagtctggtgaatttccagtccctgccttaaatgcatgcatctgaatctctttgtcacctgtagcaaattcactgagtacctagagtaagctagacactgtctcaggcactggggaatgaagttgtcactgacctcagagaactttacatacaggcttaaccttatttcacacgagtcctttcccaaatgttcaaatgttcgttttatgagttagtcactttgtacatcatcttagctggtgagattcgactgtttcatagcggctcgtgtcatggtttgtttcatggtcatagagcattaacattttggaggtgaggcttttaggtgcatcagacccaactgcttccttttacagacatggaaactgagcctcagagtggttgagctgtgcaggtacatttaggaaattttccttgagcccagtatgttccctacgtattacactgtgttgcctttttcttcagagagagatattaaatagtgatacaaactgctttttccattttacttattttattttgttttattttgaggcagggtctcacactgttgctcaggctggagtatagtggcaccatcatagctcaccaaagcctctgactcctggcctcaagcagtcctcctgcctcggcctcctgagtagctgaggctacaggcacgtgccatcatgcctagctaattttttttctagtagggatgaggtgtggctgtgttgtccaggctggtctcctgggctcaagtgatcctccttctttggcctcccaaagtgctgggattacaggcatgagccaccatgcctggccgcaaactgatttttctttgaatccatattctgtagcaggtgcttaatatgcattgatgtgaatctgtacaaccacatgaaaaggagtggctctatgtctgcacctgaagaaaccgaacacgagcttgcccaaggccacgcaacacgtggaagactcagatggcatttgggcatcttactgggttaacacttcgtgtctggtaatgctcagaatgtaagagttttagagagtccttgaagagaggacagatattaaatgtctttttagtctctttttcttcggagaatgaaagtaatgagaaaattaagtttctagatgaatgttgctccaagtatttgaaattattcagagttagtaaggaagatttctggccctcattgcagacctttagttgagaaatagaggtgggccccaggaatttgcaatttattttactttattttattattatttttgagacggagtcttgctctgtctcccaggctggagtgctgtggcatgatcttggctcactgcaacctccgcctcctgagttcaaacaattttcctgcctcagcctcccaagtacctgggactaccggtgcctgccaccatgcctgggtaactttttttgtatttttagtagggacagggtttcaccttgttggccaggctggtctcaaattcctgaccttaagtgatctgcccacctcaccctcctgaagtgctgggagtactggcatgagccaccgtgcccagccaggaatttgcatgttaataagcaccttactaatggcaaagtttgcaaatttgttttagacccggaaacttacacgagcaacctagaggcagccactaaaataaacagaaaagcattgaaaaataaggcattgtaataggctgtaggtggtttctaatctgaaaaacattgagtcacatgatttgggagagagtttgttgatttccctctgtccccagtaatgccccgtgttaaaagctggcatataataggtcctcagtgaatgtatactgactgagtgcattcaggtgtaacatgtgtagttaattcccaaaggcaatgttatgatttctgttttccttccttcctttccagataaagctgtacaccaagcatgggactttgaaataccagacagactgtgcccctaataatggttactttatgatccctttgtatgataaggtaagaggggactgcttgtcacttatgatgggaagtcactagtgtgcctcaccaggctgcattaaccatgtcctttcctacactagcaaatgctcatctgttttgtaaattattagtggaatatgataatcctagccacatttggagggagacaacttacaaactgccttgacgaatacagtggctctctctgtgtttaggaccatttggcaatgtctagagacgtttttgttgtgacatctgtggctgtgcgctacagtcacccagtgagtagtggccaggcgtggagctaaatgtgctacagtgctgcctacgacagcccagatgtcagtagtgccagggctgagaaactctgatttcatggaacccgttacttgcaagcagcttaaagtattgttaaaaaaattgtacaagtaatacatgaattcatgaactttgtgaaaaagaaagtcaaggtctttagaagtatgtgaaataaatttgtacccttttcgctccaattttacctccctctgtagtgataacctctgataatctgataaaggttttttttgttgtttttttttttcttcttttgagttggagtctcgctctgtcgcccaggctggagtgcagtggtgtgatcttgcctcactccaacctccaccccccaggttcaagccattttccttcctcagcctcctgaatagctgggattacaggcatctgccactacacccagctaatgttttgtatttttaatagtgatggggttttgccatgttggctaggctggtctcgaactcctgacctcaagtgaaccacctgcctcagcctcccaaagtgctgggattacaggtgtgagccgatgtttccggccctcttataaaattttgatgtgcatcctaacagattgctttctatttatagttattcagatatccacgggtacacatgcatatgtatatatggaaatacacacaagcacacatgcacatcgatatgtatccacaaacacctctatacaatcccatcctcccacatataaaccttttatttggaaatacagattcataggaagttgcaaaaatagtcaatacacatagttttgattttgatatattttttaatacaaatgaaatcaaacaataggatttattctgcagtttcattttttcccctgtgttaatgctttcaataccagagggacatttggttttttcctcttgcatgctttcaacattagcatagatagatctactgacttttttttttttttttgagacagagtctcactctgtcagccaggctggagtgcagtggcgcgatctcggctcactgcaacctctgcctcctgggttccagtgattcttctgcctcagcctcccaagtagctgggattacaggcacccaccaccatgcccagctaattttttttgtatttttagtagagatggtgtttcaccatgttggccaggctggttttgaactcctgacctcaggtgatccgcccacctcagcctcccagagtgctgggattacaggcatgagccaccatgctcagcctactgacttctttttaatggctgcatagtgtgtcagagtcaaacccaaactgtaatttatttaactacttggacatatagactttccccaattttaaaataatagtaattttaacataacacaccaggaaatattcttgaacttaactcttcatccagaatgcataggattgatttctagagatggactagctgggtctgtcctgaaatctatttaattaatttttaaatagtatcagtatcagtctcaagaaaccaggaggctggacgtggtagctcatgcctgtaatcctagcactttgggaggttgaggtaggtggatcgcctgagctcaggagtgtgagaccagcctgggcaacatggtgcaaccccgtctctactaaaatacaaaaaaattagccgggtgtcacgtggatgcctgtagtcccagctacttgggaggctgaggcaggagaatcgcttgaacccaggagacggaggttgcagtgagccaagatcgcaccacttcactccagcctgggcaacagagcgaggctccatctcaaaaaaaaaaaactaaaacaaaaacagaaaccagggttgataagtaaaatctagttttatttattgaattaatgagttaacgtattgtttagagacaggatccccttccgctgcccatgctggagtgcaggggcacaattatggttcactgcagcactgacctcctgggctcaagtgatctttctgcctcttcctcctaagtagctaagactgtaggcgcctgccaccacacccagctaattttttaagaacattttttgtacagatggggtcttgctatgttgcttaggctggtcttgaactcctggcctcaagtgaccctcctgccttggcctcccacagtgttgggattataggtgtgaggtactgtgcctggccaaatctagttttagggggtgcctttagttcctgaagatacatgctaacttgtgcaactgtaggcatgtgagggcttaatgggagactcaattaatagaattatagtatgtttagtattaaaagacagtgagtggctgaacctagtgtctttagaactcatgaatgggcttcagcactgtcttctgattgtttagatgaaaacttctggtgttcagcttcagcttgtagcttctgaagagaatcagtgctcagtaccatgtagaagaacaaggcttactcttagaatttcatttccggtgtaaaaaaattttagattaaatgataacactaaactaaatttagccagagtcacaattctcatttcttgaaattacattttctttttttccttttagggggatttcattctgaagattgagcctcccctagggtggagttttggtaagttaactgaatcactagacattctttgtaaaagattagatgatatgccgaatattaatttaggctagcagagtgcataaactattaaaatattaaggatcatttccagtatggaagagggtttgtattcctcccctccttgcccccatcactctggtttagttcggatttaccttaatctacctcaagactttctgtcacctttgaaaaatagacatcttttcttctacctttctggaaactcttcccttgcagtttcactcattacgtggccgtggaacagtatagaaatcaagagtggggacttggttcccatcccaggatggcttcttttttagccccctcagttttttaagtttttatggaattaattgaaacatttaaagattgtgagatttgtcataaaaatccagatttatgtcccatgagatgagaagactgtcagccttataccttaccagttaaataactttgggcaagttacttcccccgtgtcagcctggctcctcactgtcgagcaagggtagttatagtccctgccccactgggtacttggaggattaataaaccaatactgagtgttcagaggggctggcacgtaattagcaagtactcagtattcagaaacagcccttctgcacacatcccaacaaaagctccaaactttcctcatataactgccttcaagcatagctggggagttggggatggggttgagatcagaagagagggtctgttttgatgtagtttacatttttgaagaggagagactcttgatgtttcagtagagcaggtgtgggtgaccccagtccatggcttggggagaggagtagggatcaccgttgttgatatcaggcttgctcgtgcattagacaaggaagaatttagcacctgccatcaccaaggctaaaatgaggctcaggcagctgacagctaatttggctctgtgagagcagctcttttatcagtttatagtcaggggtagggtcgggggtgcctggctggtacgttccagaaagctggagaggaatgcagccctgctcatggccaaagcagaagtccagattggtggcctggaggagtgttgtgtttgccaccccccaccctacccccaactggtgctgttgataagctttttaattgaattatactttcagaaaagtgccttggatgaattttcactaagtgaacacacccatgtatccaccatccagataataagatagcacttcaccagcaccccagaagtccccatcctgggtgctcattagccatcccgccccaccctccaggtgaccaccaccctgaccttctacaaattagagatccatttggtctgttttgaactttatacaaatgctatcatgcagggaactttttaatatccggtttctttcactcaacattatgaactttatctgtatcatttgtagctttagttcattctctttgctgttgagaattctgatgcataaatataaaattatttatattttataaaatacttatattttattttatttttttcttttttttgagactgagtctcgctctgttgcccaggctggagtgtgatctcagttcactgcaacttctgcccgggttcaagcaattcttgtgcctcagcctcctcagtagatgagattacaggtgtgcaccaccacacccagctaatttttgtatttttagtagagatggggtttcatcatgttgacccaggctggtctcgaactcctgacctcaagtgatctgcccgctttggcctcccaaagtgttgggattataggcaagagccaccacgcctggcctatatttatattttatattcatattttgtatcagtgatctcttctactgttgatggccatttgagttgcttaccgattttggccactaagagcagtgctcctgtgaacattcttgtatgtatattttgatacatgtgtctgcatttttgctgagtatatcacaggagtaaagtcgctgagccatagagctgatacatgctcagctttaggtgtttgcaaacatccaaagtggatgcaccagtttgtgttctcccagcagtgtacaagggtttccattgctccacatcctaacctacacttgatatcgtcagttttttttaattttagcccttctggtgggggtgtggtattatctcactgtggccttgatttacattccactgatggccaatgaggttgcacactttttcgtatgtttatgtttgtttgccatgggctagctatttttgtaagattcctgttcaagtcttttgcccattttttattggagtctttgtgtgtgtgtgtgtgtgtgtgtgtgtgcatgtacgcgtgcaagcacgtgtgtaattcatcttaactgaaaatctcatctcatggttttccatttttttctctactcattactccatattcttcctaacctttcaaaaactcaaccttaacccctattatgatgaactcttcagttaaaaaatggagttaattgctgatattgaaaaatcaagagatggtatataaaatccagatttccagtttttcggagaagttggaagctctggcaaagcatggtagtggttggcagacttgagtggcagttgtctcctttcaatttgccacagtccccctgaggatgctccgctcacttcgaacccatgaggcccctgtggccctggagtttgtgttcctggtttaacatggctgagctcatgtccttggtcagagaacagatccagagccagacttttagggttgaattggggctctgttactcagaagctctgtgatcttgggagctcctttaacctttctgtgccttaatttacccctcagtaaattgcagctattactgcctgtctcttaagataattgtgaggattaaaggcactcagctcagtgcctggtcggtgatgagcattcaggaaataaaattatttggtgctcactgaattttcactggaactctgagatataacttagctgaaaggcgttgtaaaattattttatactctaaacacgaattccctctggggcaggaaaccaggaggctagggggataggggtgagagggagacttttcccagaatactttttcgtacctttggatttggaaacacaacgagtgtattaagtgttcaaaagtaaaatgaaacctgaataataaaaatacgttctacttaggttcactgtaccccaaaactaagcttgcctttgtgtcttgtgccccggtttcctcccctgcttcgttcctcagagccgacgaccgtggagctccatgtggatggagtcagtgacatctgcacaaagggtggggacatcaactttgtcttcactgggttctctgtgaatggcaaggtttgtctttggaacttgattatttttcctgttcactctataatgtatactaaatccttttttaaaaaaatgcaggatattttaacctggggactttgatcccacaagggacccatggataagtggcaagtgagcctgtgaactctgtacttcatccgtgtagaacacagcaggtgtatttaggaatgagattgaggttgctggtcatcccctctgctcccagagcataggctgttggtgtttttatttttttattttttattttgagacagggtcttcctctattgcccaggctggagtgcagtggtgcaatcttgactcactgcagcctccacctcccaggttcaagtgattctcctgcctcaccctcccgctccttcaccctcccgagtagctaggattacaagtgtgtgccaccatgcctggctaatttttgtattttcagtagagatgggcttttgctgtgttggccaggctggtctcaaactcctgacctcaggtgatccgcctgcctccacctcccatagtgctgggattacaggtgtacgctgtgcacccagccgctgttagcgtttatgtcagggatggccttttacagggatgccgaattggaaggacacactctctaagccttgtggcatcttgctgtccctgtgggtgaattgaagtcagcttctcccagagagagcgtgcatctgcttctgacacttacgtaggaggattcctattatttaagttctgagatttttttggaccgccacggtggtgtgaatttagagtcctaacgggtgtgtgcccagctcccgtgattcagattctcaggggagagtcatttctcctccacccgccctgtgcctgcggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaacctttttttatttttatttttatttatttatttttttgagacagagtctcgctctgtggcctaagctggagtgcagtagcgcagtctctctcaccacaacctccacctcctgggttcgagcaattctcctgcctcagcctccccagtagctgggattacaggcgtgtgccacctgacccagctaatttttatatttttatttttatgtacatttacttttttttttttttttttttttttaagatggagtctccctctgtcgcccaggctggagtgcagtggcgcgattgcagcttactgcaacctccgcctcctgggttcaagtgattctcctgcctcagcctcaggagtagctgggattacaagcatgtgccatgacgcccagctaatttttgtatttttagtagagacagggtttcaccatgttggccaggctggtctcaaactcctgacctcaagtggtctgcctgcctcagcctcccaaagtgctgggattacaggcgtgaaccaccacacccacccagaccaataatggtgaatctataactgatgatgtcttagattcattgaaatagagtcttattttactgttactgttccctctcctacctcatccccaggaaacatatccatgatttatagcatcttttcaatgggattcttgacccaaagagggttcctgggctccacctgggagttgtaagcaggactgccagtgctttgagaggagggtgctttgctgggtgggccctaactttcttctccatggcaggtcctcagcaaagggcagcccctgggtcctgcgggagttcaggtgtctctgagaaacactgggaccgaagcaaagatccagtccacagttacacagcctggcggaaagtgagtagcgtcctgtctcttagtgttgccttagagccgggctctgacaggggtcatggagctgggtttgggagtttggattcagggagttctgggttcagatcctgattcagcctcttaagtttgggtgagttcatgcccgtcagagtgctgagttccccacatgtgaaatggaatccatttgacccatcttgcctagcattgatgagatgattaaatatgagttcatactggccaggcatgttggcttgcgcctataatgccagcactttgggaggccagtatgggaggatcacttgagttcaggagttcgagaccagcctggacaacatagggagactcagtctccacaaataatttaaaaaattatatcaagtagagtcccatgggggaagaaaattagctgggtgtggtggcatgcttctgtggttgcagctactcgggaggctgaggcgggaggattgcttgagcctggaaggttgaggctgcggtgagccgtgatcatgtgccactgtgctccagcctcggcagcagagcaagaccctgtctgaaacaaacaaaaaaagagttaatacccataaagcacctgcttcaaggcctggggcttagtgggtcttcatttagcagctcagcctggctctggagcctgccagcccgggcttgaatcccagctcccccatttgctggctggttgacctagggcaagttccttaacccctctgtgcctcagtttcctcttttgtaaatgaagataattgtggaacctatctcctaaggtactggaaagatgaaattaatattattacttcaagctgcctggcatattagctcaaataggttagctcagttatgattagaaaaaatcattatcattattatatcaaaactgctttgtagttggaacagatgcctagctgaccttgctgagtcagatttaaagcatttatttaatggatgtatatagttgagttgtaaatgttaacagatatgccaagattaataccagaatagttcaaactgataattccgaaagcgttcaaatcattactaactccgttaatatacaaactgagtaaattgcaaaatagaagtttataatgagtctgtcagtaagttattcaattttaaagttattattgttgaaactagttttcatttttgaaataacatttacttctgcttgactggtgcctctccaggcctggtgtgtagcaggaatatggagctgtaattttttttctgggctagtaatttggtgttgaccttactagaaaaaaatagtgtcttgagccttctgaatacctttcatctgcactaactgaaacaatgaaacatgtagcactgggctattatgaaaatgaaatagaacctcaatcttaccaatacttgtagtaatgtgatttccaagacctatccagttattgcaggcaagatttgacacaataaaataccacagaagaagaaatcaaatgcgttttctagttcatttcaccggacttagccttctcatttgtcagttgccttacaaatttgaagggataaacatgttagtatactggcagcagcatttccagctttagctcggctcactctggtgttagtctgtctatggctagtagagtaattttcatcagctgctggtttcttatctcagttgctttgtgcaaaaacccagaatgacttatctgtgtttctctaaagccttttttctgggattcaaagcttatcatagtttaccctgccctgtgtcatttgcatcatcttgggtcagcgtccccctcagcctgtgcatctgttctgttctttttcaccccacttctcccttcccatgtgtttccttggacacttctgtccccttctccttgtcagttcatgcctgtcacctctgtcaaacccagtcgaatgttctgtgactggtccctgctgtgctacaaggattggttttatgccagaaatccttgagattaagggagacgtaagcactcctctttccgatcagcacatggagcacccctcttggcacacagtaagtgctcaataagcgctcttttatgcagatttgtacagtgaaggattgaatttcattcatgctcatttaacaagctaatggaagtttgcgataattccaacattgttttcttgtgctgccaacattagtcatagaattagaaatacttgggttgtttggagaaagttaaatggttattttttatgtcttaggtttgcattttttaaagttctgcctggagattatgaaatcctcgcaactcatccaacctgggcgttgaaagaggtgagtgacagctacgtctatagccatgccaataatatgctggtcttgggacaaatgtagggcttttcaatttaggatatgaaaagaatttatggttcctccaggactagatgaagaaccaatggtgctgttgtttagtttggtagttatttataaggtgtaactcctcactgtagcagatgttgcttgtgttagtttcagttttaggtgacagtgttgtcttcctgctgtgaaatagatctgttttattaactatagctattttaaactaaatcaacaacagaaggccctgacgagatttatttgttgttcttttttcagcctgaaacagaaatctgtaaatatactaaacattctagaaactgtggtacgcgtgaccaaggagaatgtatgagaatgtttattgcagctttgtttgtaatagcaaaatattgtaaacaacctaaatgccttttaagagaagaatggattggggttccatcatacaataggctgctgtatgtcagcagtaatgaatgaaccagagctacatatatcaatgtaactacatttaaaaacagagttgaaggaaatatgattttaaatacttgtgataatcatttatggatacagtcttttttttttttttttttttttaaagacggagtctcgctctgttgccaagactggagtgcagtggcatgattttggcttattgcaacctcggccttctgtgtccaagcgagtctccggcttcagtctcctgagcagctgaattacagggatgtgccaccacgcccagctaatttttgtatttttagtatatatgggattttgccatgttggccaggctggtctcgaactcctagcctcaaatgatccaccagcctcgggctctcaaagtggtgggattacaggtataaaccagtgcactcggccagatacagtctttttttttttttttttttttgcaacagggtcttgctctgttgcccaggctagagtacagtgacatattcatggctcattgcagcctctggttcctggccttaagcgatccttcaccttggcctcccaaggatctggaactgcaggcatgtgccactgcccctagctaaggatacagtcttttttttttgagatgaagtcttgctcttgttgcccaggctggagtgcaatggggcgatctcggctcattgcaacctccgcctcttgggttcaagcgattctcctgcctcagcctcctgagtagctggggttacaggtgcctgccaccatgcccagttaatttttgtatttttagtagggacagggaggatacagtcttatgtagaaaaattataaagacatgtatgggaatagcagacgctgttcaaaatgatactgacttctagagaaagagggaggagggggacttcggggtacgccagcatcttgaattgtatttttttaaatttctttagctggttagaaggtatgtaagtgttctttagcatatctttttttgtttgactgaaatagtttatagtcaaagatcaaaaaaggaactccacctagtaggtgaggttctgtaatagccgtgaaagaccaaattgaaataagacttaagggacatcttgacatgttagcttctgtgttagtattgaagctgtatctcatttttgctaaagaagcattggaatcagtatttcagcttctactctatctgttttattattatttttactctgtaggttttacgcacttataattgatgatagtttcacacctagatgtctcttcttactgtttgtgacttttggttttgggggtttttctcttctgcagcaacatttaaaaatattttattcgaggctgggcgcagttgctcatgctgtaattccagcattttgggaggctgaggtgggtggatcacttgaggtcaggagttcgagaccaacctggccaacatggtgaaaccgcatctctactaaaaatagaaaaaaattagccaggaatggtggcatacacctgtaatcccagctactcgggaggctgaggcaggagaatcgcttgaacctgggaggtggaggtagcagtgagccaagattgcaccactgcacttcagcttgggtgacagagtgagactccatctcaaaaaaaaaaaaaaaaaaatttattcgaaatgaaagagcttacacatttataaatagaagagattttaaggtttacattgtatgttaattgtctgcatagaagaatctgagtttattaatatgagattgggattttcaagtaaagcatgttgttagaagtcaggataatgtttatcttcctggggtgttagtgaccggaagcaagtgtgagggcacttctggcttgctggtgctattctgttgggtaatcagtgcccaatttgtgacaagccctgtgctgcgtgcttagaatctgtacacttttctctgtgtttattgtaccttaacaaaaatgtttaaaaatatacacatattgtgaaaagaacaacttaaggcaaattaaacagagtttaattgagcatagaacaatttgtcaattgggcagctccctgagccagaataggtttacagcgactgtggcactgttgcgtgattggaaagggtttatggacagaaaaagaaagtgacggacagaaagtggaagtgaggtacagaaacagttggattggttacagctggacgtttgtcttatttgcacatggtttgaacagttggctgcctgtgagtagttgaagggtggctgcttgaattgggtgagacttggcaacacgtaagagaaacctttaggccaaacttaaaatatgtaaggaggcagctttaggctaatcttcagttaacactatatatcattaaaaatagaaaaaaaggcaaaatatgctcattaaaaaaattggaacatatagaggaatataaagcagtggaaacaaattttggaagctggaaaagtatacaagtaaaatagcaccatatagacaaaatcattattgtttacattttgccacatttcctttcacttcattttgggcattaaaaaataatgataagccaggcacggtggctcacacctgtaatcccagcactttgggaggctgaggcgggcggatcacctgaggtcaggagttcgagaccagcctggccaacacggtgaaaccctgtctctactaaaaatacaaaaattagccgggcgtggtggcgagcgcttgtaatccccgctacttgggaggctgaggcaggagaatctcttgaacccaggaggcagaggttgcagtgagccgaggttgcaccattgcactcaagcctgtgtgacatactgagactccgtctcaagaaaagaagtgatcatactgaataagcaattttatagattacgtttcccagttaatattttagcttcagcgtgtcctcatgttgttaggcactttgcaagtgtttatttttttacaggttaaaatctttttctgttacaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggtaagcaaagaaaagaacaaaagagatggtgtgaagggtaggagggtgggggattatagaccagaacgtactgttttaaaaaatgcaggtctgagttgatttatcattttaacacttaagaatatcgtctgtctcaggccgggtgtggtagctcatgcctgtaatcccagcactttgggaggccaaggtgggtggatcacttgaggtcaggagttttagaccagcctggccaacattatgaaaccccatctctactaaaaatacaaaaacattagccgggcatgttggcacgtgcctgtagtcccagctgcgtgggaggctgaggcagtagaatcgcttgaacccaggaggtggaggttgcagtgagccaagatcacgccactgcactccagcctgggtgacagagtgagactctcaaaaaaaaaaaaaaaattcaagaatatcatgtgtctctgttgactcacaagacattgcacatctacactgggaggcagtggtatgtgatggaaagtacacaggctttgaaatcagacctgggtttaaacaaatctcagatttaaacaaattcctcttcctagctatgcgaccctgggccggtcacattaccttcctgagcttccgtttccttatttggagaatggtgacccatgataaggaaggacagtcatgtcatctttcccgggaagactgtgccagtttttaactttgcaacttgaatgtcaagatttttgttccttttatctgtattaatgtttcttagatttcagaaatacatatattgacatgaaacttaaaaaaattttcctataatgtggctaattgatggtattcagaacatgtaaatggaaaaggaagtcttgtcttttttaccccctggcataggatgtcctgggctgcaatgtctcaccagtgcctgggttccagccccaagacgagagtctggtgtatttgtgctacacggtctccagagaagatggctcgttctctttctattccttgccaagtgggggctacactgtggtgagtgaagcagatttccgttctgtttatgtctgggactctcatgacacagtaaaagccaatgctgtttgggtgttaaaggaaaagatggttggcctgcagttctctgaacatgctgttaagcagtaacttacttaagatgagacactcaccccttcgtaatagctacaaaaagggcaaggcttcctcttttcaaatctgcaacagttatgatgaatgtttctcttggtctgtctgaaccccttgtcatttgtgggctgctagatcgattattaatattgctgattgatcatgttagtggttcttagtgattaagagactcttccttccagattccgttctatcgaggggagaggattacctttgatgtggcgccttccagacttgacttcacagtggagcatgacagcttgaaaatcgaggtaaggcttttctgtcttctggagggacaggtgtttgagttcccatccctaggcacaggtattgcaaacatgttttaaaaaaaaatcaattattttatctggaagggctgttggaaaaaatgccatctggtattatattcttacccatgatgtccttatcgtagagagctggattcctagttaaatctactcattcaatgaaatatatttattgattgccagtgacatgcatttcaggcaccattccaggactggggatatagcagtgaccaaaagaggcaaaaattcttgtccctgtggacctcatttttttttttttttttttttttaagacagggtctcactgtgtggctcaagctggagtgcagtggtacgatctcatctcactgcagccattgcctccagggttcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtagtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagggtttggggcatcccaaggaggccagggtggctggagtggagggaatgagcaaggaaggaggaggcggaaagagggtcagggaggtgacagggcagattgtgcagggcttggtgggctactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtgatggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcctctcctaagtggaccacccaatgttagagttatcgaagcaattatattttaatcattttcttttaataattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtactgtgtcttattctttactgttttcctaacatgtgatttagtgcctggcacatagtaggtgcccagcaaaaatatttgttgcgtacatatgtgaattaataagtaggtaatgcatggaatgaaacatgtctttttggaaagatcaataaggactacctgtcatgtgagaccatcactaagaaaccatttgctgaaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaagtccctgtctccatgaggtaacatgctagtgggagggagacaactaagaaatcgaacgaggacatttcagatactggtaagtttgatgaagatattaaaataggttagcagtggtgaccttggggatacacagatcagggctggaactcagtaactgcagagaaagcacagctgtgctgctcacaggcgagtggggcacagacacagacacagacacatggagcacgggaccacgtgtgagccagtgatggtggtggaggagggtggtctaggtggatttctttttttttctttgagacagagtcttgctgcttcacacaggctggcactatcttggctcactgcaacctctgcatcccgagttgaagtgattctcctgcctcagcctcccgagtagctgggattacaggcgcccgccaccacacctggctaatttttgtatttttagtggagacagggcttcaccatgttggccaggctggtcttggactgctgacctcaagtgatctgcctgcctcggcctcccaaagtgctgggattacaggcgtgaaccactgcgcctggcctaggtggatttcataaggacctgtgttcaggtcgtggtggaaagacaggaggggacacgtgagaccttgcagaggtggaatccacaggactgatcgatgctggaggagcggggcgggtcatccaaagtgatgccggggtgtgcatgggagactggaggaagacgtggttcaccaaaatgggggcatctggaggggaggagatggcacaggggtaagggtggggggcttctagaagcttgagtcagtgaccttttaacgagggaagtaagtctctagacttttcttttctgttgtttgacactcagcagtgtgttgggaacacaacagagaagacagatgtgggtaaagtgagagggagcccggctggcacacaggaccggggcactgagtgttgggaggtgggcggcaggagcagacatggtaggtggtggccggcgcagcagaaggaggctttgtggctctggcacaggagcaccttcgagcaccttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggtaagcttatcgtgtggatttggaagcaccagtaaatatgctggcagccagtgtagaaccaaatgacctgtgatctgtgtgtctttgccgagcttaagaacttaagaaagattagtactttttttttttttttgagagacagagtcttgccctgttgcccaggctgtagtgcagtggtgccatctcgactcactgcaacctctgcctcccaggttcaagtgattctcctgcctcagcttcccaagtagctgggactacaggcgtgccccaccacacccagctaatttttgtattttttagtagagacagggtttcactatatgttgtccaggctagtctcaaaactcctaacctcaggctgtctgcctgctttggcctcccaaagtgctgggattataggtgtgagacactgcacccggccaagaaagattagttctaaatcttacaaactgaaggtactgacatgtcggatgcttaatgaaaagtcccttgcttcaaattaaaatgggcttgtgaaattaaaaaatctttcatgtctgactttcacgatctttcacaggacccctctttgcttaatctttgaggatttttggaagatggtattgttggttgagaaagcttattggaagatgcttcaggtcattggtgtagttcttcctgcttgtagttactcattatactataagtacaggcagggacatcttgtggttgaattcatgtggttttaccatcatctgaagcaagattgtgtagtgccaagaacttgggctttggagtcagatcccagatccacctgtatgtaacctgcagaacagctttagacataacaggtgctcacaaaacagtagcttagaaggagactgcagggtctgcttgggagaagcgcggcatgagcaaagtcaggcagtctcacagcagcatgaggtggctgcgggtgtaaagctgggtgctactggagcagaatatactggcaggtgaaggtgatgatgaggccaaccccatagcacctcctcacaccccaccagggcgtaggggctttctcccactggggccaacgggccatgagtggttttgagcattaatataacaagctttgatcattgttttcaatagggcattctgaaaacaatggcatggagtagagtggctttgaaggggacaggacttgggcacaggaggtctgaaagcagagacgacaagggcttgccttgtagggaagtcagggacagactggtgagatatttagggtgcccagcttgagaggtgtgatggctggggacagaaagagaagccagttaggtgatgaggtttcagatttggccacattggtctgtaggaccactaggtggagctcttcaataggtacttggatggatggtaaatcctgaagatttggccgcaggtggcagccaggacctcaaatatgtatgtgcaagtagaattagaagaacagtaggccaaaaacagagtgccaggtggcccagggggggacctagggagcctgaggtcataggagctaagaaagtaagtttggggtaggaggtagggcccaacagggaggtgcagggagctgggccctggtgaacacagtcccctggcttgatcactgaggaggccacagtgactcttttctgtagacagatggaggtcaaggtcaaggagtccagtggtgaatggaagacagggaagcaaattaccctcagaaagtaattcttggatttaagtctttcccaccttccataaacactttgtgcaattactctagatgaggcactgaaaaatgcttcatacctaataattaatcaaactagtgttccagagatggggctttcaccctaccagggagacagactgaagacaaatacatctgtggccaggcttaatgcctcacacctgtaatccatcccagcactttgggaggcagaggtgggcggatcgcttgagcccaggagtttgagaccagcctgggcaacttggcaaaacaccatctctaccaaaaatgcaaaaattagctagtttcataacctggtctaaaaataaataaagagataaaaattaaaaaataacaagatttttaaaaaagacaaaaaagacaaatacatttatgctgctaaattatggcaaatgttgtgcagggaagagatcagggtgctgcaagaagagctaatttagagtgggagctctgcaaggctctctgggttgcagagaccttagtaaagactaaaagttagctaaagaaagatcttccctagtagagaagcagcatgctcagaggcctgcataggataggaaggacctgaaaggcagtctgcgcagctggaggaggtgggtgaggtcagggagctctggggccttgtagccttgctttgggattgggctttgctccctaatgcagtggaaacccgttaggagttgtctgttggttggccgggcacggtggctcacgcctatgatctcagcactttgggaggctgaggtgggcggatcatgaggtcaggagttcaagcgcagcctggccagcatggtgaaacccggtctgtactaaagatacaaaaggttggcggggcatggtgatgcgcgcctataatcccagcaactcaggaggctgaggcaggagaatcgcttgaacccgagaggcaggggttgcagtgagctgagattgcaccattgcactccagcctgggcgacagggtgagattccgtctcaaaaaaaaaaaaaagagttatcagttggcaagggagtgatagggatcatggtactttaaaaagtttgtttttcttcctggctgctgtgtggagaatggattggaggaaagccatggtgtgaatggaggggccagatatgaggcagtcatggttgtctggaggagatatggtagtggctgggcccaggcggctggcaggcgagggagcgaggagtagatggatttggtaggtcacatggagaacacacccacaggcctgtgctgttgaggttacaggtttcttatttgagccactgggtagatggaggcggtgctgttcacggagatggaggaaatatatttattttctcctttaaagtagagtatttgggtcaaagaaagaaaaatagcatttgttgaacatttttggaaaaatctcttttttttaattggccgatgtagtacatttgcctttttagcacactgatacttcttactatttcttttcctttttattttttgttgagccagggtcttactccgttgcccaggctggagtacggtggcgccatctcggctcactgcagcctccgcctctcgggttcaagtgattctcctgccccagcctcctgagtagctgggattacaggctaatttttatattttttagtagagatgtggttttgccgtgttggctaggctggtctcgaactcctgacctcaagtgacccacccgcctcggcttcccaaagtgctgggattacaggctgagccatggtgcctagtcttcctttaaagtaaaataaaaaaattactcaatttattgtaaaaacaaactctttggcttctgtccaaatgactgtgaaaatagatttctctcaatatccaccaatattacctgtttctgtccatatatgtatttaaaccctgttgaaagaatttattgatacaaatcaatttttaagggcttcagtataacggaacctttttctaccacccttttggtttatttttccaaactaagccagtatagatttgaggtttagggaaaataggcacttctttttaataagaatgtgggctaaaacagatcttatggttcaaatatttacaacttaaggaggcaaagagatttgataggaaatagacaaggtgatgtgtcctctgacaggtacacaaatcaagagaatatgacaggtccttgggaatgattgtgtcagtgttcgcttcccatccttttattctgaaagttcacagtaggggaatgtgagaaccaaaatgcatatgctaggtcagggactgggacactttctctgtggagagccagagaataactattttaggctgcgtgagccatacggtctctaggacaacagctgagatagacatttgtaaatgaatgggcagagcgcaacacaactacatttttggacaccacagtttgcatttcatgtaatttttacatgtgaaatattatctttcttttgatttttttttttaactttaaccacttaagagtgtaaaattctttttctcggcttgcagttcatacacaaacgggaggggggtccttgggtggtagtttgctgacccatgctggagatagtgagctcatatggctgggcagtcccttcactctgaagaaatggctgtgtttttcataattcctagatttcacatacacaatcttccaccatttccttgtgttttccactgtttttttatttgaggcggagtggtggttccaacatttaatgtacccctaattgtcagaatccaacattcttgattatctttatgtcagaagtaactaatttttatctaaaatgattcttgaagattctttaaaatgaacagttgaaaagacaactgtgacccccagctaggatgtactattacactttaatacaccagctgcttcagaaatgaagaccagcactccaaggatgatggtcgttgtaggggggcctctcgtgtgttattcgagggatgccttgcaacaccttactccttatttagaatctcaaatctgaatcattaccttaatagggcttttcagttataagttacattgtggctcctacctcccaaggagttcaattttagctttgcattttttaacttaattaccttttctgttccaatctcccagtttgctttcatccatgtattatatataatcacaagcaaggaagacgtctttgataatcctgacttatttgatggcctggtaatgccacagtttcttaggcagcttagagctcttgcttttaagggctagcccacattctcagtccaaggccgctctgctgtcaacgatccaattacctgaaacgtttttattatctgcagattttcttaaaattgcctctgcagtgggggattgccagatgtcacccggaacacacaaacagccccactacgggcccctgttctgtagaaagatgcccagtcttgcttctgaaggttgctttttaaaaccagaatgaaggttgctttttaaaaccagaatcatctggattgcattctgtctcttcattaagattagactattctcaggaacaagggctgggagagggctgcatcttttttggtcgataagagcctttcctgttataattgagtcctcgtgctggaatgaatggtcttctctttgcaggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgcgatgcattgttttaaatttaaaatgttttgagaaaaagcagtgatttttagaagggttattaggtcgaatggggttagagaaggagcattccagtttccaacttcttgtttttaagtctttacaatcctgcaccagtagaggagagtcagataggcatccagctaaaaaataatgccatctgcctctcttttttccagtcttgatgtttattagtatcaggctgccagtcactcctctaccttcaggcttctggctgctgtagaatgtcgatgagtccaagaggacaccaaaaatgaactctactaatggccgctcaaaaatggccatagtgcgtggcttctgggaccccaggccaaaatggagcttcccatttcctgctttgccttgacttcaagatggctaggcagggaccacgcgacttatccattcaagcaggccgagaacggggagacggtctggcctgtggtctcatcaccatggtgaaggcccaagccacagctggcccaagcaagcaagagacaggacagagcagaggtcagcccaccatgcctttcagtgcagtggccctgcccttggggagagactgtttccgtgggctgtcacccatcaaatcagcagctgcccttcctccctgtggaagagcaaataacacaaagggagagggccgagaaggttccctgttagactctgctgtcctctagggcaaagtggggtccctccctctgtgggaaacagggtaggagattgcgttctccctgcttccacagaacagcgtggtgtgtgggttgacagctgactttattagatggtagctggcttcttgcgaagatgtccacattgacaagtctttggaagccctttcggaagcatgatggacttctccaaggaagggcagtgtcgtctttactagggatgaaagagttgaccgctgctaccttcacctgttcctcttcttagcccatgaaaggcacgcacaacaataggaggaagaaaatgacttaattccaccaaagtgtcatccacatagtgttgacaggttcagagcttatgctacaagtgatccgaagccgggaaaagtgactgggatgtagtatggtttctagtatgtaagtgaggcgtgtccgcgttgcgggcctgtggggaattaggccagatagacttttgttcatacacatcggtctgttgaggctaatttttcatctgggtagaaccgtgcttacttcacacaagttattcgtggatttgttgtgattgtaaaatcagcctggaaacgaacctttggccttcaaaatctctttagccttggtcccagatgaatgttctagcgccctgtaggtcagggggaagatctccccgaatgcagcctctaacgttccatccacgtttccgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttgggtaagatatcactggaaagtaagaacacatagtttcaaagaagtcagccggtaggagtgggatttgggaaactttttgttttgcctttgttgtttgctactgatcacctgcgtgcgagggaggcttcttggagtcaggtgggtacatgttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccgccaccttgtctgcacagcccactggcggcttctgttaagggagggtgccccgacgtatggcattttatttctaaagcccagagaaaggagtgtgaaatagttccactgatgtgttctactaacttagcagtactggtgctgagtactggccatggcaaggtacttgacctccctgaaactcagttttcccatctgtaaaatagacataatagaacctttctgcagaatataagactaaaagaagtaaagtttataaagcccgttgtgcagagagccagctaagtagctggtgcccacaaatgttacttcccttttccttgcccttcttaagaagccacttcttgcctgtatttctgctttttcagaaatcagcttggggctgctggcagtggatagctcataaaacagactgctttttctggaattatattaatattttctgttatggcagggcttggcagactacaaaaactgccttttataagcgtagtttccttagaatacagccttgcccatttgtttatggattctctatggctgctcgtgtgtaacagtggccaagtcgagtggttgaggctgacaaagcatgtggcctgcaaaactgaaaagagttacagaaaaagtttgtggatccctgaataccttacttgcagcctgatcttacaggccccattagatttctttcttgatgtaatggaaattggttccagtttttctttctttttttttgaaatttagcctcgctctgtcacccaggccggagtgtggtggcgcgaccttggctcactgcaacctctccgccttctgggtgcaggagattctcttgcctcagcttcccgagtagctgggattacaggcatgcaccaccatgcctggataacttttgtatttttagtagagatggggttttgctatgttggtcagactggtcttgaactcctggcttcaagccatccactgccgtcggcctcccagagtgctgggattataggcatgagccaccacgctcgactccaggttttctttagcagtaatttattccaaatactgctagttataaatatatgtatgtgtatatttctatctttatgtctacatacacacctgctttttaaaattagttaattcatgatcattgtttctggtggcgtgcagggaggtggtgtgctccacgcccatgtatccgtttttggtgtttgcttttgcagtaagcatcatgcatgaggattggtgctggaagaacaagagcctggaggtggaagtgctggaggatgacgtgtctgcagttgagttcaggcagacgggctacatgctgagatgttccctgtctcacgccatcactctggtatgtacggcttatggagtctcttatttggaaaagcgcttgccttgtggatgtcaagaaagactaacatcccaggaatattgtaaacgtaggcaagtcagatttccttttctgcctctgcactcacccacctgttacgcaacgcataatcaggaagcatttatactctctcagtggaaggacccctgtatttaggaggtttccttgtcctggccctacactaaatctgactggtgattcggggtgacctttggtacagtgtagagcacactggctttatattattagtaataatagctttgggtaaattcatttactgcttctcagcctcagttttcaccgaaaattgagatcttaatacctacttctcagggttatggcagggcttaagtgaaccctcttaggtatcaaagtgtccttggtgtacaccgctctgtactgccaagtgagtttctctgatatatatatatatatatatatatatatatatattttttttttttttttttttttttttttgagatggagtcttgctctgttgcccaggctggagtgcagtggtgcaatctcggctcactgaaacctccgcctcccgagttcaagcgattctcctgcttcagccccccgagtagctgggactagaggtgcgtgccgccatgcccagctaatttttttcttttttttttgtatttttgttagagacagagttccaccatgttggccagactggtcttaaaactcctgacctcaggggatccacccgcgttggcctcgcagagtgctaggattacaggcgtgagccattgtgccccaccttctctggtgtatttgttccagtgcaggggaagaagctgtaaacaggatcttagcttcttgttgactgtggtctctgtggcctgaaaggcagtgtgaaatgggtttcaggagcacctctgtagatcccttcgtgaattttctataatgttttgatgtcgagcggcggcagatgtcatcgtcaggtcttagtttctctgtagagaaactagaagaattggaactggtgtttcatgtgccaacttactcccctaactgcttaattacaaaaactccacaggtcgatttgttataggagatcgattaatatccggttcataataagtgatagatatttaggaaacctttcccttccagcagtggagtggatttccagctctcttgtaataagatccttttttttttttttttttgacacttccttaaccccttctttatctcctcccactgtcccctcactcgccgggccccagccacagtggtcctctgcagtcccacaccaagctcactccctcctcggggcctttgcacatactctcccctctgcctggagtgctgtgacttctccagaaacacgtgttgttggtttttcctcctcattcaggtgcagccctattgttcaggagagatgtgccctgggaccagcgagctaaagacccctcggtggggattgttcttctcttgctttcctgtttattttcacagcttcgttactgaccagttgagatcactaatttatttgttgttgcgttgattttgtcttcctgtattagaacataagccctgtgagagcaggagccatggtcatgactcccaaggcccagccttgtgtctgtcacatagcaggtgctcaataaatattagttgattgaatgaaaaatagcacacttttgttggaagttttgggaggtttttaattttcctgtggcacccaactgctccaatgattaatgggcaaaacagatgactggtttggaaagagaaatattattaatcatcttggtgtctccatctctcttagtaagtcattgtattggctttgctcccttaggaattttatcaggatggaaatgggcgtgagaatgtggggatttataacctctccaaaggagtcaaccgattctgcctgtccaagcctggtaagtttggaaggattgatgtgccatgaattagaaaaatggaaaggcaccagaggatggttttgaaggcatttttttctaccttggttctgtttgcatcaagctttcaatttctgtgtgttcaacctgctcttgtttttctgtctgtcttgggtttgagttgggtagacaccactgggccctttcacctccaaaaatataccattggccaatggcctctctttatagagctgttttaaaatttgaatcatttcccactttgcttaaaatctttcagtggcttctcgctctttctcattttttttttctctttctttttttgagatggagtcttgctctgtcacccaggctggagtgtagtggctcgatcttggctcactgcagcctccgcctcctgggttcaggcgattcccctgcctcagcctctcgagtagctgggattacaggtgcccaccaccacatccggctaatttttgtatttttagtagggatgggtttcaccacattgtccaggctggtctcaaactcctgacctaaagtgatccgcccgcctcagcctcccaaagtgctgggattacaggtgtgagctgctgcacccaaccctctctctcttttataatggctttttttggaggcagaatttgcatatcataaaactcacctatttaagatgtacaataaaatgatttgtagtaaatttatcaagttgcacaaccatggccagaatccagttttagatttgttcatcacccacaatgtaagatcctctgtgcccgttgacagttaatccctgtttctagccatggccagccactgatctattttctgtccccatggattggctttttttggacgtttatcatacgatgctggtattttgtttggcttcttttatttaacatgtttttgaagtttatctgtgtcatggcacatatcagtagtttgttctgttacattgctgtgtagtattctggtgtgtggttatatcatattttgtgtatccatttatcagttggtggatatttgagtggtttccagtttgacgctgttatgactaatgttacggacattcttatacaagtctttgtgtccgtatgttttcgtttttcttgtttcgatacctaggaatggaattgctgcattgtgtgataagtttatgtttaaccttttaagaaactgtcaaattgttttccacagaggctgtgtcatttgatattcccaccagcaatgcacgagggttccggtttcttcacctccttcgccaacatttgttattgtctgttttattatagtcatcttggtagatgtgaagtcgtgtctcattgtggttttgttttgcattttcctaatgaataattcagtggctcctccgtttggttcccaagataaaatacaaactccttaacctgatcttagctcctgtgtaacccagccctgtctgccactgtctctactccagccactctgtccttctgggtgtcagttcagctgcctttggctacatgtaacaaaatccatacagcagtgccattggcaagtggtagtttatttggctcaataaagaagtgtggcagtgcgtggctgccagcatgggttcagcagctggtagatgttaggggtggtgtctttgtgattctttaggcctttcccttctattttttgccttgtattttcaagatggctgtggttagaaaacttatgtttaaaggaggaagtcaaggagagggcaggcaaacatttccttgcgccccctcctccagtaagctacttgtctgtattattggccagaaccgtgccacatggttacttctagctgcaagggaggctgggacagttggatgtgctacccgaggctgagcacgttgccaccctcaacataaccagggtttgttctcaaggcaggaaggatgcctgttgaggaaacaatgagccagcctgtgaggcagatgctgttctctgtggacatctcctcctgcccctcctagctggggccttcttacccatcagttcagtattgcttcctggggaaggatggcctccagggccacttaggcctgcctcctacactcttgctctcagcactcacttctatccccttcttgcatgtgccacaattgatatgtttgtggctgtcaaatgctccccctctctgtggatggtaaactccatgaagacagggaccactgctctgtcattccccactgtgtaccagtacctagcataatacctggccaggaagagatgctctgtcgatatttgttgaatgaaagaccaaacaaaacaaacagagaaacctgatttttttttttttttttttttgatggtaactactctggggcttgttgagtgcaatgaaaacagcagggtggttttagctaatttcaggtttttgtaggaagtgtggccaaaatactggttaatgatgatttgggggaaatacattgttattccttgtatcttcctgaaattgactgtgttcctctggcaagtgatgaaatgtacccctactcggagtgtcctcccacacagactcacacttttctggggcttcccttactccttacctcctttttaggaatatttataggaagaaattgaggctgtggttatctcttggatccttaatagaatcttttaagtaggaaattatcctcagtccaatttgcagtagaaacgtactttctgttccttctcgtgcatgggtccgttcacctggtctgtgcagatttaactactgtgagttgttaccttatggaaaatgaaaatcatgcgcctgtgatcgggccattgcatggatcgggtcattggtaagacgccttcataggcagtgaaaacgatgcctgcccagtatttctgatcccattattgcagatctgcgatacatttgagttttcacatgcaaagagctgccactcgatttcagatgtcggaattgctcagtgtaatagatgccattctctgaaaattacttttgatttcctgtctgtaggtgtgtacaaagtgacccctcgctcctgccaccggtttgagcaagcgttctacacctatgacacgtaagcctgggaattgaatgctttgtggtgtttgtatacattccgtggaggattcttcatttacttcagagaacaaaaggagtttttctgttttttttctgaaagaggcaaggttaggccttcaacagcatttctagataaggattttaagacacttggattagttactgaggaaccggagacaggatccctttcccaagaattctgtaaccccaggatagagggctgtgtttttgaagtgccttaaatagaagctttgtcaaatctcccagccctcaccgatgggcatctgtcaagttcaagtctgccatttttgtatttttacagacgtgtgtgggtttcactgggaattggaagcataaagttgtggagtggagaattagtttactctttaaaatacttctctggatctccagagttattttaccccagactaaaagcaattttctgtagtatatttagggtgaagaaggatgcccaaaaagggtattgctgatgatcttctgagaatgagtaggttctagcgtttcctctgctttgatttgtaggtcttcacctagtatcttgacattgacagccattcgccaccatgtccttggaactatcaccaccgacaaaatgatggatgtcactgtgactatcaagtaagatgagcgttctgcagtgggccgagagtggcgggagagggtgtggatgaggcctggggagtctctaataggctctctggaaattagttttgatttcttatctctagatgtatatacaaatggccttccctctcttataggacattgccgtcaattcccagcagccttgatcctttccatttctgattcagaaattacctgtgggtgaggaagagcgttgcgacagcttgtttcagtgtcttcaatttctgtttgaactctttgtacttctcatctttgctaaggaaaaaaaaaatctctggggtttgtgcattgtatttcaagtgttttagcaaattcaaattgcctatttttctttagacttttgcttgaaggcttgggaaatagagatggcacctggtataagagaagggtcgtgagagaggaagtatttgaaaggcaagtccctcaccgaaggtcacgttcatgtgaatgtcacctttcagggaatttttgcagtgtggtgaggtacctgtgacgccccaattttcttgagaaatgaaagagttttggcaacatgaccgtctctgtcaagtagaatgggcattgcagtccctgtctccctcctgcccctggttgaagtcacctttccagctatgtttccatctttctgtccaccatctgtttatccatccgtcatccctgcagagtacatgatgactgaaaaactgagagtcttcagtgtttaggcactgggcttatgaggccacagcccctacacttatgggattgacagtctcatggggggaacagtggtcagatactcacatgcagaaccgtaaaatgacaactgttctgagtgctttgagcttgaccttgggggcatgcaggacaggtaggctgcggggggccaggccatgttaaggtccatagtctttgtcccatgatgcaattgacatgttttacatagaggaatgacatttttcttcctgaaggtccccctattggccgagtggagaacagacagaagaggcctgagagtgggaggtggtggaggcagggggaggcaatgggggccccagactagtggctgcggagatggagagcgacggactggtcggagagtcgttgagggactgagttgatgagacatggcactaaagtgaccactgggttagggcgggagaaatgtcagggctggccctggtttctggtgatggggagccaggtttttagctgggggtggatttgccgaaggtctgttgctgtcttttactatcatttactgtctccctgcttggaaagtatgaattactgataggactagcaatctaccttcttaccagtagtaactgcatgttacctcctttcagcttgattacattcatttttgtaacttcacaagggtgtttgtgttgcttgcttgtgccggaggttgtatggaatgcatcttccagctagacagagccactcggattcccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccatcatctagtccctttttaccacttggccctcagccttggtctgacccccctctggggtcactgtagcagcttcccagctggccttcccttcttaccacgtggccctcagccctggtctgaccccctccgggatcactgcagcagcttcccagctgggctttgcttcttaccacgtggccctcagccctagtctgaccccctctgggatcattgcagcagcttcccagctggccttcccttctcaccacgtggccctcagccctggtctgacccccctctgggatcactgcagcagcttctcagctggccttcctgtttccgccattgctttgtgtattttccatgaaggagcaaacgatttcttttatcataccattcctcgactgaaaactccagtggctccaggtcggcaccaagcctgtgaagcctcagtctgacatctgctgccccttggacctctctgttggatatgactcttccgtgggcccctgtgccccaggctggactggtgttgccattgcttgaacatctgagtgagctttctctccaaggactttgcacttggcatcgctttgcccaagctactgtttacccagagagctgcgtggcgcattctctcccttccttcagacctttgctcaatgtcaccttatcagaaaggccttgactgtccctttaatgtaaaacagtgctccgggctctccgtcttcccacactgctttatttttctttattgcacttttcctctggtattatttttctctttattttcagccccttcccactgaaacgtggattccacaggggtaggaagtgtggtctgttttgttgatgctgtatccttggtgcctagttctctatcagagcagttctcagcgaaggtagaatggagaacagaggatggtggtgtggagaaaactccgtgtcctacatggaagctacaagcttatatccagtcgccataaaatcaaccgtatttcattccagcccagatctaccagatactgccaccatcactgcgaagctcagttgttattttttgtgaaactactagtttatttaaaacagaagactccgccactgtggtgtcatgataagatgtccagtttgtaactcgcaagtccatactcgtagaaaggtcaaattcccactgaccacaaggatacgcaaccacgtcctaggggccgccatttctttcttctaggtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtaagctctcttgtgcgtttccctacagtgtcctctgttttgtggggataggacccgccaaactgaagtatattaattattttaggtctggagagaaaatcactgttacaccgtcatctaaagagctgctcttttatcccccttcaatggaagccgttgtcagtggaggtaaatgtcaactcagcgagcgaatgtcacacacacctttgcagttgttcccttgcctgcatttacaagtagatttgtgatgttatagtgaagccatctttgtaagccaccttacatcctctctggcacacagatgttactgttggttggatggatggatggatggatggatggatggttgggttggatggatggatggatggatggatggatggatggatggatgaatgaatgatttagataaataaaagtaacttttgctgttagaattgagttgatctttttggaaaaggacttggttttctttgacattatcaggtcgacaccagaaggtagatgaagcacaaagctgccagtgatgatctttaatgatctttctgttgtttggcagagcatgatgggagggtctttttttggggaatggatgactgaagtgatcacttgtggagtatttgtcttttgccacttattatttttttcccagcactctggcttcgttaagttgtgggtgttatgtggttcgcgtttggaagcagagggtgttgaagagcgtgacttctagcaggcaggctgtttggggcggtctttctcagtgggtcctccagaggctgagcagcacggcctcctgtctgctgtaaagtgttccctcctgatctgtggcctcctgagaacctaggaagagtagtagtaaaaacccagccttcagcgttttttgattctcttgctaaagtccttcacactgagaaaggcctttcagggatggaaagaggcttgggctgtatccgattattgagctccccggggtgttaaataaccgcatttggaactagcttctaagatctgttttagccacttttgtcatgggaaacccccaaccaagaagctcctgtctctgctaccaagccccatccttgtgtttatttcttcccctcttagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacaggtgagcccgggatagagacacatttgcctgggatcagcgtgggagtcctctgaagaaactggggcccacatttccttgggcttggtaaggcttcctgcagggtgtgaacaaagccgttgctagcattctgctctctcctcttcagtgttggccccctgcacagtgacctggagtacacggtgacctcacagaaggagggctatgttctgactgcagtggaaggaaccatcggagacttcaaggcctatgccctggcaggcgtaagctttgaggtaactaacactgtattttcaaaaggcagttatactgaggtataattaacatataataaactgcacaaaaagggtacagtgtggtagtcttgacctaggaatacacccatgaaaacacctccacaattaaaatagcacatctgtggccctcaaggtttcctcctgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacaggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaaaattggtaagaaaaagacaacccactagaaaaaaaatgaacaaagattatgaaaaggaaattcatggaagtaacgcaggtgactaataaacacagaaacacaaagcctctgtagttactgaggaaatgtgctaaggaagttacagtcgaaacactgttttgcagggattagatttgctgtaattaagacaatctctattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagttgcagaactgtacatataacatgccatttttatttcacctcctccacccactcaatgaacttgccagtctgtgaacaataatatgtaatgtttataaaatttgtgtgggcatagaaagagttctgggcggggcacggtggctcatgcctctaatcccagcactttgggaggcccaggcatgtggattgcttgagcccagtagtttgagatcagcctgggcaacgtggcaagacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgagacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacagaatcatgtttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagtgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaagaaaagaaaaattaaatatgacttctacctctctgagtcattgcaggcaggtgataccatcagctgccgttgttagagttgtgattgccactacctgactgtgagtggtgattatagagagagggttactatttttggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagcctattgagttgctaaaagcttttatttattttttattttttgagacggagtttcattcttcttgcccaggctggagtacaatggcgcagccttggctcactgcaacctctgcctcccgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtctcccaaagtgttgggattacaggcgtgagccactgcgcctggccacttttattttttaaaagagtttcaaacctgaattacatcattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaataaaaatacaaaataaaaaagatacacatctatagatagagagatgcatacatatatacatgtatacacacagatacacacatatgtgtattttttgtagacttatacagaatcactttagaggaagagtaattggaaagattgggtttagaaaaatggaccattttctactgaatatatggaatgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttgaaagtgggccggccacaccgagttgcctgggtcattgaggcacagttctcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgtgttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtatgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggggaagacagagtcagggttgccagatccttgaaattttaaaaagagaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagaactgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctaatcagaagtcctcccgtctcctctggctgtctgcctttcatctgtggcggggggaactttcatcctaattaagggtcctcttagaatagtgtcatcttcacaagcagaatcttatgtgggtttttagtgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagcacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaaggcttttctcttactgagtaactctcattgggaagactagagggcttaggtagggcaagaggggctgcctcttagtggctttatttaggtggcttcattatgcatgaagattgtgagggaggatagaacttttgacctaggaagtggattttcttttttttttcttttttttttttttgagatggagtctcaccctgtcacgcaggatggagtgcagtgccgtgatctcggctcactgcaacctcctccttgtgggttcaagtgattttcccacctcagcctgtagctgggactacaggcatacaccatcacacccgactaatttttgtatttttagtagagacggggtttcaccatgttggccagattggtcttgaactcctgacctcaggtgatctgctcgcttcggcctcccaaagtgctgggattacaggcatgagccaccgcaccgggccggaagtggatttccttgacgtctttacggtgttggcattttaaatggctgggatgactgcatctcacaccaaaatgctttgcatgttctcggtgtagtaacttaggccaggatcactagcataatgtggactgtggccgggcaggtatgaaagggaagggggccggccctctgggatctcgcaaactccatgtacagacctcacgcagagggggtgctgtgactctgcccctgctctaacaggcaagagcatccttctcctctttttttttaagagaagctggaaaatctggcttcatatatgaaatttcttaatttttaacatgttggcaagtaattcaaacgtagaaaaaaaatactgtgctttcgaaatgaaatgtgtctatgggccagggatatgcccctgctctaacaggcaagagcatccttctcctttttttttaagagaagctggaaaatctggcttcatatatgaaatttcctaatttttaacatgttggcaagtaattcaaacgtagaaaaaaaatactgtgctttcgaaatgaaatgtgtctatgggccagggatagccatcttctgtcggtttgtgaccttggacgtagggtactcaatgacaaacttagcttccttaatgtaagaagcaaagtttgccatgaagcagctctcaggccatcggacagctggcatagaagttcctccaccagctttctcattactggcattccctctttctctctctaggttgggaataatgacatcgatgatgtaaacatcatagttttccggcagattaatcaatttgatttaagtggaaatgtgatcacttcctctgaataccttcctacgttatgggtaagtccagacttttaagctccaagtattgtgttccctttggctttgagacaagtacgaatgggatgtttttggttttgtgcctgtctcgtgccttaggtgtgacaggtggaggtgctccagagtgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattctaaagaaagcgccttgtaacttaaaattttctctggagtggaggtcgtattaaacgttcttgcattggtttaaagaaatgcctgaggctagataatttataacaaaagaggtttcattggctcctcgttctgtaggttgtacaggaagcatagtggcgtctgcttctggggaggcctcaggaggcttccaatcatggcagaaggtgaagtgggagcaggcatgtcatgtgggagaagctggagcaaaagagagagttggggcatggtgccacacacttttaaatgatcagatctcacaagactcataacgaagacagcaccaagccacgagggatccaccccaaagatccgatcatctcacagcaggccctacctccggcacgggggattacaattcaacatgagatttgggcagggacaaatatccaaacagtatcagaggtggtggacggtgggctggagagcaggtggtctgggctttctcttgtctccagtagtgactcaccttgctgcctgggccagtcacttcatttccacatgcctcgacttcgtcctctgcaaaacctagattttggactcagagacctcttataatcttgttcagctctaacaaaatctccatgttaccattaatgaagaaatgtttataaaataccctgcagaccctctgcggatgttagtgatttgctctgggggtacattgttaagatgcgcttgtaattttataagcagttaagtatttggcatgggtgagaaagtgtgtgtgcgctttagtccactctgtccagggcttgcaggcgtgtgcttgtagggaccaggcaggtaatgtcagagagtgcagagggttgggtagggtggggggcaaactggggaactcctgccccatccatgaggggcacaagggaggggaagaggcagagaggaggggagggcgccactctcttgctcctgagtgttgctgtgctagaattgaggctcagggttggtgtcacttcccagttttccggagaagctggaaattagaattatttgaaatcacctgatttttaaatatagtcggtgaattcagatttacttaagatgttatagaagaaaaaagaacacataagggatcttcaatgcgacccataaccttcagtctgtgactttcattttaggaaaattcccctggtgtgttatgtagaaaggtgccagtgtgggcccagggaggtggtcctggcattctcttgcggcaggtgcactgtggcatcctcacagcctttgccatcagccagggctgcaccttaaccctgctcatgccccatcccgtgtgggagtgagaacaggcaacaaccccagaaataaagccagaaacaaagtactccagtgcctcctgaagcagcgtggagagccacgtacatgatggaatgcgttttgagtttaacagattggtggagttaaggtgacatcatatgatgaggcagtgcaaggcgggaaggaccctcaggagtcgtcagggggttgagtcccaggctctaccatgtgtaagttgtgtgaccttaggtgactttggctctctgggtctccatagggataataacaatacctgttttgtagtcaggattggcgataatgtagataaaatatctggcgcctgcctggcatattacagatgttcaacacgtgttagaagctatttttaatattactattatattaacttatattactattttgagcaagaacatgggtagtcagaatctgatttgaatcttaatttctgtgcatgatacataactggatggagtctcagatgacagagggatgtgtgatgtctatggagggagctttctttttcaaatatccatgtttccaaagacacctacccagagagcggctgtcctgaggatgtctgctatgaaatattgattgtgtttcagtttcaaagcatgtctgactttgtttctccctccaggtcaagctttacaaaagcgaaaacctcgacaatccaatccagacagtttcccttggccagtccctgttcttccatttccccccactgctcagagatggcgaggtaatgcctgtggccggattctaccttctgcctttgttttaataattctgctgtttagtttaaggaagcacagttctctccttttctccctaaataccactctgcagaaatgcgctctctgaatcaaaagaggttgggttctgtagggattattttttcttcattgtttttctgtttacaaaaagaatacatattcatggcaggagattttgggaaaaagaagacataagcccatcatccagaaatagccactgctaacatggtgattggtatcctttgggtcttttttcaggcacgtgtgcgcatgcatgtataaatataaatagacatttattttaataattcaaaactgacactgttttgtacattgttttgtaatccatgctcttcaatgaagaatttatcacaaatctgttcctcatcatcaaatctttcttttttttttttttttgagacggagtctcgccttgtcgcccaggctggagtgcagtggcgcaatctgggctcactgcaagctccgcctcctgggttcacaccattctcctgcctcagcctccgaagtagctgggactacaggcgtgcgccaccacacccggctaatttttttttttgtgtatttttagtagagacggggtttcaccatgttagccaggatggtcttgatctcctgacctcgtgatccacctgcctcggcctcccaaagtgctgagattacaggcgtgagcccccgtgcctggccaaatctttcatactatgatttttatggacagtagtccataaactaggaaacgcgatgatttatttaaccaaggcctactgttgggcatgatcgactcttgcactttgaacatatcaccccatgctttcctgctaagaagtccacttttaaaaatgccttgtaatttttaaaaattcctctattttaacattctgctattgagtttagggaaatacagtttcctcatgatgggggatcccttgaatgagatgagttgcttttctcttgctgctttgaacgttctctctgtctttgataatctgattataacgtgtgtcgtgtagaacacttgcagctccaccttttcagtgtcctttgggttccatgaatctggatgtctccctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcgaaataatgaaacaggctgtcacggaattttctcctcctctttctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcaggaggctgaggtgggaggatcacttgagcctgggaggttgaggcctcgatgagccatgatcatgcccctgcactccagcttgggtaacagagtgagaccctttctccagaagaaacaaaacaaaacaaaacaaaacaaaacaaaacaatccatggggtggcaaaagaaggcatgtccatacaacctgtgctccaggtcgcaggttgcagggcagatatttaaagggctcctggcattgggtcactttctcattctgccttctggattctgggcttccccagattgtttttagcttttctgagcactgatgcctgcgattccctttgaggaggaaactggtaataagagcagtgtaattgtttagatcggtggctcaggaatgattttgggggaggagggacaccactatcgctggtgtggcgtgtgcttctccatgagggagcacatggtacatggccacgcaaacccctagaaccaactgctactttacaggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttgttgcttctaggccttttcagtgggcagaataagaactttattgttttcaaaagatgtaactgtaagtggaacaatatcctccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatacggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcactgtacttctaattgcatttctctcttttcatgtggttaagagccatttgtattttctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctgtgttaaatgtgttgattttttcttattgcttctggattttagagtcataggaaggttttcttcattcccagcttttacaggaatttatcgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaccccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtctcaaaaaaaaaaaaaaaaaagaaagtgccagaaagataagcatatacaagaaccacttacctttgcttggggctgcattgtggcccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccgagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataattaaaaaaaaaaaaaaaagctgtgcctgctggggcttggattcccgagcagggccaagtgttgaatgaagagagcgcccactctgtgccaccccgtacagggccctcacaggttgatcctcacaacaagccttcaagcaggtgtgccattcctcccattttcacagaagcccagaaagattgagtcacttactgagtgttagcagaaccaggactcaagtgaggcagtttgtctcaagccacatggtttccacctcgttctgccctccgcgtgatgagtggctcagcattgcatgttcacgggggctttgtaagcacattggtttccttctttgttgatgtgactgcccacagcctcgcgactggattttactcagtattccatgccctgctgagcatttcacatactcctttcatcaagtttcacagcatccacccccagtgggtgttgttcatatgatctccatgtcatagttgagtaaactgagtctcaacgtggttgcctgagtttacccagtgaggcctgggacctgagcctagactgaatcactcttaattcctgctgaattaaacttttatttatttattcattattatttttttctgagacagagtcttgctttgttgcccctgctggagtgcagtggcacgatcttggcccactgcaacctctgcgtcccgggttcaagtgattctcacctcctgagtagctggaattacaggcatgcaccaccacttctggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccagagatacaggagtaggcagttgttgatggaaatctgttcctgcccttattctttcatttatgaaagggcatcccaggtacagcggcccccacagtcactctctagcccagcagttctcggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggctgaaaatagctgtggcctcgggaacctctgcgagaggagtcccggtatcctacactgagaacactgctctggctcattaacttgtttttatcattattgggaagttctccttccatttatttgcttcctttatgagagtagagtgggccaatgggatataggttcacttgatgctttagaacccagcatttcaggggctttagcaagatggaaatgtctgtctcatgtcaagtgtccaggagtgaccagtgcagagatagtctggtagctccaaggcgtcaggggacccaggccccttctgtctcattgtgctgttccagtgcattgcttttctccaaaatggggcaattggccaaatgctgtctacccagcaaaagggagggcacaccacttccctagggtccagccagggtgtggcacttaccgcttctgttcctgtaccattggccaaaatttagttccagggctgcgcctgctgcagggaaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatacatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttcccggtcgggagggcccgtgaaggcctcaagtccagacttaggtctcctttcaaggctgtaaacttctgtaacatctcctaatccttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatcatagatgtatttcttggatgacatgcacgtaacccccgggagtcttcagttgagccaaatgtagagcaagtcagagtcctgagtgaagctggctggggcaggaaaaacacgagctcagccaacatggtccccagcagcttttggcgtcagtgatagagaaatcggagatagtggaggttgtggcaagttgaagtgtgcccaccacgtctaagggaagcttagggactcagctctggctcacccctgctgtgcagaaatgtgcgttcatttttctagagaagccagaaaaacaaagatttacgtgaaattttcccaattttaaatgttagccacaaatgcagtgtttttttaagaaaaccacacactttggccaaacaaaatgcctacgtcggccgggtgaggcttaaaggttgccggcttgcatcagagatccagaggaagtcacagcattttaacagctaaacttaatcctcacaggaagtcatcaagtgaattaagtgatattgaaggaggggacacatccatccatccgacatttattgagtgccacataggacaggcatgggtatgtgaggatgagtagggtagacaacactctacagcgagctggaagaggccagggaggccccgtctgccttgttcttcgtaccccaatgcttggcacttggtgggcattcagtaaggaatgaatgaacgcacgcacagaggaatgaatagatgggcacacagtgtgtgccctcacagcacatggcccatcactgggtagaaggcaagtcagtaagtagacaggggtaatgcagggagccgagggcctccaggtggaggaacatggaggaccacaggagcacagagcagagttctcatcccactggagagcttagggaactttctggatgtgatgcgtgagcagagtccaaaaggacaaaacagagagagggaaaacaaggtggaagttcttgttaggtgccactgccaccccagggggtcagcttgggggactccctggctcttgggggccaaccgcagagctgccctgttcccacctatcagctagcttggtgttggcaccgtggaaggaaagtgaacagtgttggagatctgggacagatgtgatattaatacaggatccatttcttggagtgttttccaactcttattccaagtggacacccagaaacatcccttttaaatgttaatggggtttttattgacggtataaaggttaagagcttgcgaaagatacaattgtcagtacactccttccagttccggaggccgccagtaagtggcagtctttccctgtcgctggctgcaggtcacccttggcctcggtggaacttgtgtgggtcattctcagtccatttgaaagttgggcctgttcggttgtgtataattttctgttcatcatttttctggcaatctcaggacagaagtcctctgatcctcctgtgagaagtaaacattaatgttattagattctttttttttttttttgagtttcgctcttgtggcccaggctggagtgcagtggcgtgatctcggctcactgcaacctctgcctcccggtttcaagcgatttcctgcctcagcctcccgagtagctgggattacaggtgcccaccaccacgctcgcctaattttttgtatttttagtagatacggggtttcaccatgttgtccaggctggtcttgaactccctacctcaggtgattcatcaaccttggcctcccaaagtgctgggattacaggcgtgagccaccgcacccgggctgttattagacttggaatgggacaaaagtcatatgagacagacttgtttgctgaggtatttaaaaaacaaaatggtctaagatggcagattcttggggaactctgctctgtgcacatttctgcctattaaagtggccgtaaaaacaaccataaatccttgatgaggacacctcaggagctttaggacggtgccattcttttttaattaaaagctttttatttgatttgatttttctgtagagacagggtctcggctatgttgaccaggctggtcttgaactcttggccttaagtgatccttctgcctcaacctcccaaagtgctgagattataggcatgagtcaccacacctggccagggcagtgccattctaaggcaacggcttcaactcggtcttcttttctggggttacaggagatgggaagggccgaaggtagcatgagaacgtgtgtgtgtgtgtgtttgtgtgtgtgtgtgtgtgtttgtgcatgtgtatgtggaaggactggtgagatggctggaggaagaggcagtccttctgcttaactctaatggcctaaatgtgagaaacaaagattcaggaaataaggaaaaagcaaatgagtgattgcctctctggatcaagcacaccagcaggcacaaccagcctttcttgagctactgtgtgccgggcgctgtgccgtgcccttgcatgcatgtggatgcttcatgagttcatgaagtaggtatgcttccagccccatttttcagagaaagaaactgaggctgaacaatcttgcagctgtcaagtggcagagcaggggtttgaacccaggtccaagagttcttaaccaccatgttttcctgcccttgatgtatgaaatgagatgatgtagtcacatgccagcttgtctagggatgactcagaggtttagagatggatgtcacgtggatgttgtacaggagaggcaggtataagctgtagtaaagttaggaaaggcacagtgacgtggagcactgtgtgcagtggacggggtcatggctgggggtgagaatggtggaggaccttcgattatttcatcagcgttgtttctgtaaccaaagagctgcatgaccaaaccctgagatctagttccttaataggaacaattattcggcacgattccctttacttaaaagcaggggccgtcctaagggaggagttggaaagagtttgggggataaggtttgcttggttgccttctgtttaggctgatgttcagtgggggtcaaaggctgtgtgtccagtccctggcatgtggcgggtgtttgtggtacacagccagcctcaggatggcccccagggatgcacactgcctttgtgtgtggtcccctcccacactgaatcaggctggctctgtgcgaccagtgggaagtggtggaagtgagtgatgatgtgtgacttctcgggctaggtcgtaacaggcattgcactttggctctcgggaagccaactgccttgcgtgagggtgctcaggcagcctcgtggggaggggtgaggcccctggcccccagcatgtacagcttgccaccacgtgagtgagccagcttggaagcgaatttccccgccccggtcaagccttctggtgagtgcaactgcagatgacatctgacttccaccactcaagagaccccaggtcagtgctgcccagctgagctcttcccaggttctttatgtcccccgaaaatgagctgttttaagtttagaaaacttaaaaacacagtgacaatgaagcacagatatgcattacatacagtcccaaatcagtaatgacttcaagctgtgtcctctctttccaagaaagacaaagcagagaacaaagttcaacctacagtgtcttcccaaattcttgacccacgggatctgtgaatatcttatacgactgaattaagcctctaagttttggggtaactcatgcaacattaggtaactggaatagtgctcaataaatgtctgtcacatgaatgggcagtgaccatggatgcatttctagttgtgtattagttaaggctctcttggtttcaagtaacagaaatccaactccaactagcttgagcaaaatggggcattcctctggtcaagtaacggagaaatccaagagtctctggcttcatgcatagcgggacccagtctcaatttccacctcctggctctgcttcccttgatgccaactttcaggaatcagctttctgaaagaccactctgctagaaacagacaggcccatcctttcaaccaggtccaggactgtttgctcagtcactgctctcagaggcaggggcagaggcagatgccgggcacacatccacagaagtggagatggcaggaaactgagagtggagtgctggaaagctggcttttgcctatgggttccgcttctgacatcatccggcaatgtcaggctttacattgcccccatctgcagacccagcagaaggacagcttccatcccaccacatcaatatgccagtcctggggcgggggaaggacttatgggcaacctttgcagaatcactggggcctggccgcacatgagccatgcccacgctcatgtgacaggcggcccctgtgcctggggtgctgtattacccagaggaataagtgatcctgggtgggcaaaagcaacagaagagaagtcagctccacttccttccaaaacttgagaaggcctggtcaaaatcaccctccaggcccggtgtggtggctcatgcctgtaatcccagcactttgggaggttgagatgggcagatcatgaggtcaagagatcgagaccatcctggccaatatggtgaaaccccgtctctactaaaactacaaaaattagctaggtgtggtggtgggcgcctgtagtcccagccactcgataggctgacaggagaatcacttgatccagggagtcggaggttgcagtgagccgagatcgcaccattgcactctagcctggcgacagagtgagactaaaaaaaaaaaaaaagaaaaaagaaaaaaatcagcctccatttttggctttctctttcattagaaaaatgaacctgactttatgaccatgacaatgaaatgcctagagaagggagcactcattttccagtgggcctactgtgtgctggggtggcgagactcttcctgccctggaacttggtgaggtcaggagggaagatattatatgactgccttcctctgtactttttcagtgggggcaggtgtttatgcttgatgatgcaatggtgagatcttggttggaatatgaacttttctttctttttttttttttagatgggttcttgttctgttccccaggctggagtacaatggcaccatcacagctcactgcagccttgatctcccagggtcaagggatcatcgtgcctcagcctgctgagtagctgggactacaggagtgcaccaccacacctggctaatttttttaaaaaaaatctttgtagagatgagctctcactaggttgcccaggctggtcttgaactcctgagctcaagcaatcctcccaccttgggctccctaagtgttgggattacaggcaagagtcaccacgcccagccaggatcacagacgtttaaattacactccttctgctgtgccttacagcagtagaaggggtgaaatttaaacgtctgtgatcctggggttgttgaagatgccacccatctacatattctttcagatgcacaatatttcactgtgtgaatgaaacagcagcccttcttacgtgtgctttttggaatttgaagattttgtaagataagatgaatgcattggaacaagtgatcctcaattctgtgcagtctgtgcctccggagactggcggctgcccctccctgtctagtcttgcaagagaggcagctggcaagaggacagaagccggcagctgctgcgttttcatcctgtttctgctcttggagctgagggggagaggtggctagcagccacccagtgatcaaacttgcagcctgcctctcttgcttccttttcacagactggagtgtgcctgggtatggagaaagaacattttgcttcttgcctctcagagtttcaagaacgcctcacctgagtggcatgcattcatggaatgagtaattattacagtggagaactcctcactgtgaattaattacacagatgatattcaagacttagactgggctagtgcaggggttagcaaactatggcccactgttcttgttttataaataaagtgttatgagcacacagccatgcccattcatttgcagattatggctgcttttgcctgacagtgccagatgtaagtagttgtggcaaagaccaggtagcctaaaaagcctaaaatacttgctatctgggtctttacagaagacattttgttgttgttgttgttgtttttgagatggggtctttctctgtcacccaggctggagtgcagtggtgtgatctcagctcactgcaacctccgcctcttgggttcaaatgattatcgtgcctcagcctccctagtagctgggattataggcgcctgccaccaagcctggctaatttttgcatttttagtagaaacagggctttaccatgttggccaggctggtctcaaaccccgacctcagatgatctgcctgcctcagcctcccaaagtgctgggattacaggtgtgagccactgcgcctggcctagaaaatgttttctaacctgttgtctagtgggtgctttgtaaagtttagttttagggggagcatcattaattcattcaacaagtattaactgagcatctcccctgtgctgggtgctgcttggcatactgggggtttagtggtgtgagagagaccgagcctcagctcttaggagcacagtgctgatggaggacgaaaggtaaacacacacattagaagttgttggataatgccaggcgttacgaagaaaagaagcagaacaaggcaatgtgacagaggatgattggtatcatggaaggtctctctgaggaggcagcatctgagctgagacctgaggaggggaagggccagttatgcaaagatctgggggaagagctgcccaggcagaggggaccataattgcaaaggcccccaggaggaaatgagctccctgagtttcaggaatagcaaagaggccagggtggccagagtcaagtgattgagaggaagagatgagaacgatggcagggaccgggtcatgtgggtgccctggaaaggagtttagattttattctaatggcaacagaaggcattggagggtttaagtagggaaaggggagtgatctgatgtatgtttttaaacaattgcttctttaaattttgaggagattggattattgggaagcaagaatgaatttagggagagaagcaaagaggacgttgtgttggtttaggcaaaagacagcaatggcttggattggggtgatggaagtaacagtggcaggaagtggtgagcttggggctatgcttcagagatagagcagaaaggtcttgctgatgtatttaatacaggaggtgagggaagggaggaatcaacgataagtgaatcgtttgtttctagctgaaccactgaaatgtgtaggtaaattgagacttctgttttggccatcgtgagtttgagatgcttatcagacacccgagtctgcagcctgggtgagaaatcacggctggagatgagacgtggtgagctgggagtgtttttggatgacagatgaggccacgggattgaataataggtatccttatgaagactgagaaaaggagagggctgggggccaagccctgggacagtgcaaccttcagaggatgggcgaggagggccctgcccaagagacagagaggaagtggcccgtgaggtagggggaagtccaggagaggacagtgtggtgaatacctaatgctttactcattcactggtgaatgaatggatggatggatggatggatggatggatggatgaatgcatgaatattccttaataatatggttggccatggtccatccatatgactcctacggacaccatgttaccatttcacactcgtcttctatttaggagaaatcagacgaaactgccatcttatatataggtcaaaaatggtttccataaccacccacctcacatgcttactgaaattcattaagtaatagatggggtggggggcgggaggtttacaggtcggcaaaggaggcaaggctagagtgatccatgtggcagtggattagagtggcaggcatcagtatgaacacatgtttagctcaatatagatacagatggctacatagagaaatatttatggatatgtgcatatacacaaattagtaagacacacattactaatcctggctgtcagcgaagagagcctagaagcaaggataccccagtagcaacaaacctctggtgcccaggtctctgttctccaataaacaccattctccagtaaaaggaaccaggcttcttgaacaaatgtcgatcctaggaccgagggaggaaatagataagaagaacctgaagcatcttgtagggtcacagggtgaggaggcgctaaatgaaacaaaatgaaactgctgcagtgatggggcatctcagagggacacaggagccagtggaaaagctcccaggggtcaaagccagaacaatttgagccccaaaaaagtactattggattagaattcaaagaataaatacccatgattccatactgctataaatgatcagataagagagaagagacaaatctcccaggcagaagaattccagattatttatttatttttatttaattttttttttttacacagggtcttgctctgttgcccaggttggagtgcagtgatgtaatcttggcttactgcaacctccacctcccaggttcaagcgattcttgtgcctcagcctcccgagtagctgggatcacaggcatgcgctgccacactcggctaattttttgtatttttagtagaggcggggtttcaccatgttgaccaggttggtctcaaactcctgacctcaagtgatcaccctcctcggcctcccattcaagtgctgggatgacaggtgtgagccaccgtgcccggccccaggtaatttatatagctattccatcgtcaaggaggtggagcggacttcccacatcctaagtgtgggctgtgcatagtgactctcttccaaagagtacagtgtgaaaagagaggagagagtaactttacagtggagaacacggacagactacctcagccaggtgatcaaagtcaacttcaatagcggcaagtcatcttgagagaatgcgtgcctgatacagagtgctgagaatgattcttaagctctgtggtcctcctcctcaaaacacacacaagccaagactaaggatgagaagcatctgccaaatcccagttgaggaacattctacaaaatacctggccagcactcctcaaaatgctccatgtggtatcctggaacagaaaaaggacattaagcaaaaactaaggcaatcagaatcaactatggactttaggtggccaggcacggtggctcgcgcctgtaaccctagcactttgtgaggccgaggccggcggatgggttgagcccaggagttcaagaccagcctgggcgacatggcgaaaccccatctctacaaaaaatacaaaaaattagccaggcttgtggtgtgcacctgtagtcctagctactcgggaggctgagatgggaggatcacttgagtccgggaagtcaaggctgcaagtgacccgtgattgtgccactgtataccagcatgggcaatgagagtgagaccctgtctcaacaaacaaacaacaaacaaacaaacaaaaacaaattctctggggatggtagcaggcacctgtatttccagctacttgggaggctgagatggaggatcgcttgagccaggggaggtggagggttgaggctgccatgaactatgatcacaccaccacactccagcctaggtgacgagcaagaccctgtccccacccccctaaaaaaagtatggactttagttcataatgcatcaagctatggggtacatggaaactctctgtactgctttcaccatttttctaaaactgttctaaaataaaaaatttacttaaacatttatttaaaaaaaaaaacaaaccatttgagtaccaacagtgtcatatgctcaacttagcacatctttttcctggtttggtttgtgggcgtgaatgtgtactgagccatctaaaccttggttgcccgaccttcaccgtagccactgacccaggttaacagacaaaaggcccaggttaaggttatgcccagtggccataaaatagcccagcatccagactgcactccttgatgtacccaaaaaagccaaggaataggacggatgggcggggagtggggggcaaactactgcccattgcccaactctggccagctgtctgttttataaataaagttttattggaacacagtcacacccattcatttattatcatctatggctacatttgcatgacaatggcagtgttgagtagttgcaccagagatcgtgtggcccacaaaatatttattatctagcactttacagaaaaagcttgtcaacctccaggacagtggccacaagttctgccatcatctcatcccttagcaagaagggaaaggaatgcccattaaggcacaaattgttttctgttgttgtttgtttgtttgtttgtttttgagacggagtttcagtcttgtcgcccaggctggagtgcaatggcgtgatcttggctcactgcaacctccgcctcccaggttcaagcgattctcctgcctcaacctcccgagtagctaggattacaggcgccagccaccacatccagcaaatttttgtatttttagtagcgacggggtttcactatgttgaccaggctggtctcgaactcctgaccgcaggtgatccacctgctttggcctcccaaagcgctgggattacaggtgtgagccaccgtgcctggccacaaggtggtcttttaacaacagagcacacagctggacaaagcccaacgctctcttctttggggccgaggtgggtcattaatattgaacatttacaatgtacttgctccaggtgattcagtttaatttctgccgtctcttgtaacagggctcccacgtgcacgggttggggccgtgtgtctgcctctgctttctgaggccccacagcgtattgattctgcgaaacgtacgtttctttgaaaacagcgtctcttgacatgacaggagatcacacatcgcttgttttctgtccctttcattgccctctgaacatgataaaatcatgacctagtgtcaccgagggacctcagcatctcttggaaagaaggacttgccttcttttttatctttgtcaagccagtgaggccaagtagaaaatttttagcagctttggagccagacagatcggagtgcgagttctgcccgttattgactggaccgtgtgaccctgggagagccgcctagtgtctatgagacggaggctgttgggcaagaaaatggggatggtcccagcattatggggcggttgtgagaattcagtgcaatgatgcagtgctcccagaacagctggtctagggcttggctcatgggactgtcccttcgcagaggcagcgtggacattccgctggtatccactggtgtggctgtgcctgtttggtcaccgtgtctgttctgattggtcggtgctcctgcatgtcaagagttcaatgttatgaaaatcatccctgcctagagatgaattcccccttcccctgaggtctagactggtatagctgcttttggagcctcacctgctgagagctcacagctgtccttctctagagaatcaccctcagatgggagccacattgcctgggatgggatgccatgcccagtaatggcccagtgactaactgatacagcaacgtgaatggctggtccctgccccacggtggggacgatcctgtggcgtgctctctgctgctcgtgggataggtcaaggcgggactttaagggaccacattctcactctgctctgtccccttctgcatcctgtagtcctcacctcccttctcctgaaagcccctttcaaaacaaaaacaaaaaccacatccacccaagtccctgtctccagctctgcctccaggaaagccggcggaaggccgccagtctcagctgtgacagatacagatatttctgcatttccaggactgaggtcaatccctggggacccagtgaggcggtatctgaagggccatggagctggcttgatggggtctacaggtaggcagggacctggtggggatgtgactcaaggatttttatcaaatatctttatcccctgacagatgcaaaaaaaaaaaaatgagatcagactccagggtttcctccatgccacactgtggccccattgtttgttgtgctatcagcagaagttgattttgcaaggaatgtacacgtgtatgtgatgtttgaatgcacctatctgtgtgtgcgtgcatttgtgtgtgtgtgtgtgcattcgcttgtgtgtgtgtgtgtgtgtgtgtgtgtgtgtgtgtgtgtgtgtgtgtgctgaggatgtgagccccacttccggcccagtgcccctgcccaggctggctctgccctcctgctgctctgggcccctcaggcagtgactacctggtacatagggaaggcatcagcatcccttattcatggggactgtatactgtctccaccatattgggccttttggcctcttggacatgacttggcctctgctggctttaagggactgccagagatgccatcttctctgggaaatgttctcagcctgggcacagcccactaaccactgcctgcttgtctgagacttctctgtccaggaaaacagcccagcctgaccagagatgggcatagagccatattttgggaaagactggttgggggtcaacttggtttctggaaccagttctgatttcagttgcaggggacagtgagccagttactgcccactggctgcatcctaagccttcctagaggagagctagcctcctcctagggttgcccaggctggaccacttctgcctgggtgatgggttgggagaaagacgttaatatttggagcagtgttatattagtcagccctcccatttgcaaacattagaaaaccagctcaaattagtgataaaagaaaatctcagctgaattaaatttaaagtagtttaattgagcaatgaatgattcgcgaattgggcagaccccagaatcacagcagattcatagagactccagcgcagccacgtggtggaagaagatttatggacaaaagaagggaaatgatgtacagaaatcagaagtgaagtacagaatggctggattgttacaagttggcgtttgccttatttgagtacagtttgaacactcagcagcgtatgagcggttgaactacggcctctgggattggccaagactcagctattgttacaggcgcatactcctaagttaggttttcaatcttgtctacctattaagctaggttgcaatttgtccacaaggactcaactatagaagtacgaagtcccactcaggccatatttagttcactttaacactagcttcggcaactgtctctcagagcccagggcagggcagggatgcaactgggcttcaggaaacttgaattcattgactgtctcttccccatcttagatgcagtgctaagggctttttagtaattttctcatttgactctcaaaacaaactgatgaggaaacggtctgagagtagttaggcagcttttcaaggtcacacagatagtaaatgtcatcactgggacttgaactcaggtctttctgactctcatgtctgtgcaacatgtcatctcagccactgttgacactgtatatgtggattagggttggctaaactgctgtaacaaatagacccaactcgaatggtgcatgtatgtacaataggggtttatttcttatgatatagttcacggtggtcccaggtgaataaggatgggtaggtctgcatttttcataatcatctggatttctgctcaggctcctagagtctctgccaccttccccatgtggcttccaaggccaccttggagacagagcttggtggagcacatgtggtaggattttttttgtttttttgagacggagtctcactgtattgcccagtctggagtgcagtggtgcaatctcggctcactgcaacctctgcctcccaggttcaagctattctcctgtctcagcctccctagtagctgggactacaggcacctgccaccacgcctggctaatttttgtatttttagtagaaatgggatttcaccttgttggtcaggttggtctcaaactcctgacctcaggtgatccacccacctcggcctcccaaagtgctgggattacaggcatgagccaccactcccagccagttctttttttcttttttccattttttttttttcgagacagggtcttactctgttgcccaggctggagtgcagtggcacaatcacggctcagcgcagccactgcctcctgggctcacacgctcctccggcctcagcctctcgagtacctgggactacaagtgtgagccagtttggctaattttggctaatttttgtagaaacggggtctcgccatgttggccaggctggtctccaactcctgggctcaagggatccaccttcctccccctctcaaagttctgggattaccggagtgacccactgtgccctgctggcaaatttcttaaactgtgcctcagtgacctcatttaataaagggaataattgtagcacactttttctagagctgtgaagattcaatggaataaataaggcaataaatgaatggatggggaatgaaggatgtgggtttcctccctcttgtctttcaataagctctcaccatcaacctcccattgcctgttctctctcttccccctctctccctctgtctctctcttagccaggaaacctggggtagggaggcttggagccagcgggtgcgtcgggaggctgcgggtactgactggggacgcgcacggagattgcgggagaaggatccacgccgcgggagaaggatccatgccgcgggagaaggatcagagtggagcctgtggctgctgcaggaggaggaagccgccgcctggcccacaccacaggagaagggcggagccagatggcaccctgcccaccgcttcccgcccacgcactttagcctgcagaggggcggagcgtgaaaaatacctcgtgcgcctcggccgactctacagtgcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcggcacagcggccctgctaaataaggaacgcctggagccgcggttggcacggccccggggagccgaaaaaccccgggtctggagacagacgtccccacccgggggctctgcggacgccagcgggggcggggcgcggaggccgcgctcagctgggaggacaaacagtcgctaattggagaggaattgggattcggcctggggctgcggggtacccggagagatggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggctttctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggaacccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaaggatgctgccgagaggtggtggcttttggaaaagatggcgtactgcaaaacgtgctgctctgcatggctcgaagcttcgtggggagacgtgggcagagccgtggctgactcacagaccccccaccccagagcctgccctgccctccctgccccgacccttcccctcctgacccatgtgttttttgtttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaataccgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagtgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatacttttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtatatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtcttgatctcttgatctcatgatccacccaccttggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctccgctgtgctccctggtagcctggtagtgagcctgcttctcacacagtcatacctggttgtggtcccacagtgggaccaccctgttgggttcagaacaggagatgggggcccctcgagtctgtgtgggggctgtagacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggcccccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgttctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcaggacggcctctcagccccgcacgagcccgtggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagtgcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcctttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccagctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcggcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcagtgccaccatgctgggtacatgggggacagggctgttccatcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccgcgtgggactctccagcccgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagcgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccacacatacgtctgttcccacacgcatccccccaggggccctcagtgagcattgcctgcctcctgccagggtccagctgggtccagtacaccagaacgcacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgctctcaccaccaaggtgcacttcgaatgcatgggtgagtgcaggcctgcgtagggggagcagcgggatcccccgactctgtgaggtcacggagccctcctgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccaggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctcatcccgctgagcccctccactcctcccccagcccctccatcccctcacccctcccctcctccttcctcccctccctctcctctcccccttctctctccttccctctcctctccccccttttctccacttccctctcctctctcccttctgccctcctccttctctcatgtgaagaggtgccttgtgtggtcagtgggctgcatcacgtgttccccaggtggaggccctgggtcatgcagagccacaaaaaatgcttagtgaggaggctgtgggggtccagtcaagtgggctctccagctgcagggctgggggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatcccccttatccccttcccctccctttcaccctgctcctcttcttctcccctttctcttttctctacccttttccttcctttttcctccctctccccatcatccccctcatcttcgtcctcatccccatccccttccccctccccctccaccactctctctccagcttccctcttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcgtcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctacacagtagcgtagccccacaagttacgtgagcatcgctaccactgtgggagaccatgcatccacccgcgatcctgactgcatagctcgtctctcagacggaggcgccagcaccctccccgtggctgtttcttcaatacctccattttcctttctttggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggtgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggtgtggacaggtgtgcagtgcgggtcactggttgtggtgtggactgaggcgtgtgcagccatgtttgcatgttacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcatgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcggagctgtttcactcgcatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcatgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccagcaggggttgctcccgagtccgtggcaggaaccagaggccacatgtggctgctcgtatttaagttaattaaaatggaacgatggccgggtgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactccagcctgggtgacagagcgagactccatctaaaaaaaaaaaaaatgaaatttaaaactctgttccttagctgcaccagtctgctgtcaaccgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgcttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgatatagataaggacatcatcactcggtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggtttgtgaaggttccagagaggacctggccttgggaggagcgtgggggactgagaagggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctcctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatcgggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttatttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtccggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatgacaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggcctggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagtgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctcccgagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatatttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggttatccgcctgcctcggcctcccaaagtgctgggattacaggagtgagccaccatgccagcctcatgtcattcttgtgtgttgtgtgtgtgtgtgtgtgtgtgtgtgtgacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaactgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggtgtgagccaccacacccaggctttttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcagggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccaaattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgctgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgatttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggcgcctgccaccacccccgcctaattttttgtatttttagtagagacggggtttcactgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcctggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagactttgaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattacctcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgcagtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgcgactacaggcatgtgccaccacgcctgggtaatttttgtatttttagtagagacagggtttagtagagaccatggtgaaaccccgtctctattaaacaaatctctactaaccccatctctacaaaaatcagctgggcgtggtagtgcacacctgtaattctagctacttgggaggctgaggcacgagaatcatttgcatcttggaggcagagtttgcagtgagctgacatcgcaccactgcgctccagccgggatgacagaacaagaccctgtctcaaaaaaaagaaaaaggaacaaacaacagcaacgacaacaaaaaaacctctgtgtcaatcacagccttcaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgcacgcgcgtgtgtgtgtgcacgcgcgtgtgtgtgtgtgtttaatatagagacagggtctcactctgttgcctaggctcgtttcaaactcctgggctccagtgattctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatcttagctccctgtagccttgacctctctgggctcaagtgatttttctctcctctacctcccgagtacttgggaccacaggcgcatgccgccatgcctggctaatgtgtatttttttgtagatacggggtctcactgtgttgcccagggtggtttcaaaatcctgggcccaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcctggcttggtttccccagatgagtgttcatttgggtcttccatcagaaaggcccctcctgacctctgggagtggggagctcaagggtgggaggccttagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcactggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggccaccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgtgttggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaacgggcactgctaccgcctggtggtggagaaggcggcctggctgcaggcgcaggagcagtgtcgggcctgggccggggccgccctggcaatggtggacagtcccgccgtgcagcgcttcctggtctcccgggtcaccaggtgcctgcccccaccccccgaggggccataggttgggagatctctgaagcagtggggcagagcctgtggctggggagtctcaggaggagggaggtgggagctgggccggccctggtgagcaggtggcgccggccggtggggccgttcctgtcagctctgcagatgcagaggtggacacgagctgggggcagcctccggacactcctgggcacgccatacgggaggtggcctgcacggggatccctgccagtgcccacaggcctcgtgggtgggtgctgctgtgagcctgggctggtgggccctgctctccgggctctgagcctcagtttccccatctggaaagggggacagtgacggggctcccagtgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgctgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgcagggacccctgatgcctctggcacggcagtacggcctctcagccccgcatgagcccgtggaggtagtcggccccccacgttctaaaacctgccctcctgcctgcccctggaggcctcgcctgccctgcccactgtgggtctccccaaaaaacttgggggccttaatgttgcttgtgcccagtgaagatggttgggaaaatccagagtgcagagaggaaagcgtttactcacattacccccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccgtgggcgaatgagggccccaacaccctcccctcctcgcagggaccccggagaacggcagcgagcctgagagcaggtccccggacaacaggacccagctggcccccgcgtgcatgccagggggacgctggtgccctggagccaacatctgcttgccgctggacgcctcctgccaccccaggcctgcgccaatggctgcacgtcaggggccagggctactcggggccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgccaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcatgaaatgaatttaaaactctgctccctgacctcacacgagcccccgtgagtctctcacgccctctgctgtgttctcacctggctaaagcgagtggcttttgaggtggagtctgaacccctgatgggaaactgcgggctgcccgcggtgccaccatgctgggtacatgggggacagggctgtctccgtcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctcccatggcatgcagagccccggccacctcctctcctctgtgccccgcgtgggactctccagcctgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggggtggggaggggaggggatggggtggggcggggcgggctccaccttcacctctgcttcatgctgcccgaggacgctgccatggctgtgggtgagtggagggagggacgctaagcagggccaggcctctcacctgccacctgggcccactgatgcctatccctgcagctgacggcctccaaccacgtgagcaacgtcaccgtgaactacaacatcaccgtggagcggatgaacaggatgcagggcctgcgggtctccacagtgccggccgtgctgtcccccaatgccacgctggcactgacggcgggcgtgctggtggactcggccgtggaggtggccttcctgtgagtgactcgggggccggtttggggtgggcaccaggctcttgtcccggccccagcctcagccgagggaccccacatcagggggttgcttttctgagcctcggtttccctatctgttgggaggtactgggtgcacaggagccctgaggctgcacgggagccgggagaggcctcagcacagccgggtgggccctgaatggaggcctggggcgtgactgcagagtggagcctcagctgggtcccaagcaccccctgcccccccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacgcacacctacgctgccccaggtgagggatgagggggtgagggggccactgcctttcaggctctgagcacggggcacccccagtcccccagtcaagctgccccccttcctccccaacagccctcactgtgacctcacctgggctgatggcttaggtccctactggggtgagggaggggccaggcgtggggggagtggacagggaagctgggccccctgaactgccccccgccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccgtgctggcatctaatgccttcgagaaccggacgcagcaggtgcctgtgagcgtgcgcgcctccctgccctccgaggctgtgggtgtgagtgacggcgtcctggtggccggccggcccgtcaccttctacccgcatctgctgccctcgcctgggggtgttctttacacgtgggacttcggggacggctcccctgtcctgacccagagccagccggctgccaaccacacctatccctcgaggggcatctaccacgtgcgcctggaggtcaacaacacggtgagcggtgcggcggcccaggcggatgtgcgcgtctttgaggagctccgcgggctcagcgtggacatgagcctggccgtggagcagggcgcccccgtggtggtcagtgccgcggtgcagacgggcgacaacatcacgtggaccttcgacatgggggacggcaccgtgctgtcgggcccagaggccacagtggagcatgtgtacctgcgggcacagaactgcacagtgaccgtgggtgcggccagccccgccggccacctggcccggagcctgcacgtgctggtcttcgtcctggaggtgctgcgcgtcgagcccgccgcctgcatccccactcagcctgacgcgcggctcacggcctacgtcaccgggaacccggcccgctacctcttcgactggacctttggggatggctcctccaacacgaccatgcgggggtgcccgacggtgacacacaacttcacgcgtagcggcacgttccccctggcgctggtgctgtccagccgcgtgaacagggcgcgttacttcaccagcatctgcgtggagccagaggtgggcaacgtcaccctgcagccagagaggcagtttgtgcagctcggggacgaggcccggctggtggcatgtgcctggcccccgttcccctaccgctacacctgggactttggcaccgaagaagccgtccccgcccgtgtcgggggccctgaggtgacgttcatctaccgagacccaggctcctatcttgtgacagtcaccgcgtccaacaacatctccgctgccaatgactcagccctggtggaggtgcaggagcccgtgctggtcaccagcatcaaggtcaatggctcccttgggctggagctgcagtagccgtacctgttctctgctgtgggccgtgggcgccccgccagctacctgtgggatctgggggacggtgggcggctcgagggtccggaggtcacccacgcttacaacagcacaggtgacttcaccgttagggtggccggctgcaatgaggtgagccgcagcgaggcctggctcaatgtgacggtgaagcggcgcgtgcgggggctcatcgtcaatgccagctgcacggtggtgcccctgaatgggagcatgagcttcagcacctcgctggaggccggcagtgatgtgcgctattcctgggtgctctgtgaccgctgcacgcccatctctgggggtcctgccatctctttacaccttccgctccgtgggcaccttcaatatcatcgtcacagctgagaacgaggtgggctccgcccaggacagcatcttcgtctatgtcctgcagctcatagaggggctgcaggtggtgggcggtggccgctacttccccaccaaccacacggtacagctgcaggccgtggtcagggatggcaccaacatctacagctggactgcctggagggacaggggcccggccctggccggcagcggcaaaggcttctcgctcactgcgctcgaggccggcacctaccatgtgcagctgcgggccaccaacatgctgggcagcgcctgggctgactgcaccgtggacttcgtggagcctgtggggtggctgatggtggccgcctccccgaacccagctgccgtcaacacaagtgtcaccctcagtgccgagctggctggtggcagtggtgtcgtatacacttggtccttggaggaggggctgagctgggagacccccgagccatttaccacccacagcttccccacacccggcctgcacttggtcaccatgacggcagggaacccgctgggctcagccaacgccaccgtggaagtggatgtgcaggtgcctgtgagtggcctcagcatcagggccagcgagccgggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttcaacatccggctcaatgcctccaacgcagtcagctgggtctcagccacgtacaacctcacggtggaggagcccatcgtgggcctggtgctgtgggccagcagcaaggtggtggcgcccgggcagcttgtccattttcagatcctgctggctgccggctcagctgtcaccttccgcctgcaggtcggcggggccagccccgaagtgctccctgggccccgtttctcccacagcttcccccgcatcggagaccacgtggtgagcgtgcagggcaaaaaccacgtgagctgggcccaggcgcaggtgcgcatcgtggtgctggaggccgtgagcgggctgcaggtgcccaactgctgtgagcctggcatcgccatgggcactgagaggaacttcacagcccgcgtgcagcgcggctctcgggtcgcctacgcctggtacttctcgctgcagaaggtccggggcgactctctgttcatcctgtcgggccgcgacgtcacctacacgccgtggccgcggggctgttggagatccaggtgcgtgccttcaacgccctgggcagtgagaaccgcacgctggtgctggaggttcaggacgccgtccagtatgtggccctgcggagcggcccctgcttcaccaaccgcttggcgcagtttgaggccgccaccagccccagcccccggcgcgtggcctaccactgggactttggggatgggtccccagggcaggacacagataagcccagggccgagcactcctacctgaggcctggggactaccgcgtgcaggtgaacgcctccaacctggtgagctttttcgtggcgcaggccacggtgaccgtccaggtgctggcctgccgggagccggaggtggacgtggtcctgcccctgcaggtgctgatgcgacgatcacagcgcaactgcctggatgcctacgttgacctgcgcgactgtgtcacctaccagactgagtaccgctgggaggtgtaccgcaccgccagctgccagcggccggggtgcccggcgcgtgtggccctgcccggcgtggacgtgagccggcctcagctggtgctgccgcggctggcgctgcctgtggggcactactgctttgtgtttgtcgtgtcatttggggacacgccactggcacggagcatccaggccaatgtgacggtggcccccgagcgcctggtgcccatcactgagggtggctcctaccgcgtgtggtcagacacacaggacctggtgctggatgggagcgagtcctacgaccccaacctggaggacggcgaccagacgccgctcagtttccagtgggcctgtgtggcttcgacacaggtcagtgcgtggcagggccgtcctccctgcccctcacccgtccacacccatgagcccagagaacacccagcttgccaccagggctggcccgtcctcagtgcctggtgggccccgtcccagcatggggagggggtctcccgcgctgtctcctgggccgggctctgctttaaaactggatggggttctcgggccacgtcgccccttgttctcggcctgcagagggaggctggcgggtgtgcgctgaactttgggccccgcgggagcagcacggtcaccattccacgggaacggctggcagctggcgtggagtacaccttcagcctcaccgtgtggaaggccggccacaaggaggaggccaccaaccagacggtgggtgccgcccgcccctcggccacttgccttggacagcccagcctccctgctcatctactgttttccgtgttttagtgctggtggaggccgcgcgctctcccctctctgtttctgatgcaaattctatgtaacacgacagcctgcttcagctttgcttccttccaaacctgccacagttccacatacagtcttcaagccacatatgctctagtgacaaaagctacacagtcccccagcaataccaacagtgaggaagagccccttcccaccccagaggcagccactgtccccagcccatgtccctgttgctggatgtggtgggccggttctcaccctcatgctccccactctggaccggccaggaggcttggtgaccctgagcccgtggtggctgctcctgctgctgtcaggcggggcctgctggtgccccagagtgggtgtctgttccccagtccctgctttcctcaacgggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgccagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgccctcaccaccaaggtgcacttcaaatgcacgggtgagtgcaggcctgcgtagggggagcagcgggatcccccgactctgtgaggtcacggagccctcccgtgatgctgtggggaccatccctcaggctggcatgacgcggaggatgctggcgccccgctggtgtatgccctgctgctgcagcgctgttgccagggccactgcaaagagttctgtgtctacaagagcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcaccggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctcaccccgccccgcatgcctgccagggtactgggttcagccccccagggcagacgggcagcttggccgaggagctgagcctccagcctgggctccttcctgccgtggcgttcctcggtctctgacctgcttcagtagcctcagcctttctgctgtcctgtgtgaacgcagggtgcctctcgggggacccagggtgtaaagaggggcccagatgtggggagggactaagaagatgctgctctgtgccctccactctcccctcccctcccccttccctcccctttctccatctctctccccttttctccatttcccccccgatcctccccgtccttttgtccattcccctcatctttcttatcccccttatcctccttcccctcccttatcctccttcccctcccttatcccccttatcccccttcccctccctttccccctgctcctcctcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagcccccaccctccagctccccctttttgcctgcccccaccctccctctgcctccctgtctctgcactgacctcacgcctgtctgcaggagacctcatccacctggccagctcagacgtgcgggcaccgcagcgctcagagctgggagccgagtcaccattgcggatggtggcgtcccaggcctacaacctgacctctgccctcatgcgcatcctcacgcgctcccgcgtgctcaacgaggagcccgtgacgctggcgggcgaggagatcatggcccagggcaagcgctcggacccgcggagcctgctgtgctatggcggcgccccagggcctggctgccacctctccatcccctaggctttcagcagggccccggccaacctcagtgacgtggtgcagctcgtctttctggtggactccaatccctttctctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccactgcagctccgccaactccgttgtggtccagccccaggcctccgtcggtgctgtggtcaccctggacagcagcaaccctgtggccgtgctgcatctgcagctcaactatacgctgctggacggtgtgtgcagcgggtggggcacacgcggccccctggccttgttcttggggggaaggcgtttctcgtagggcttccatgggtgtctctggtgaaatttgctgtttcatgggctgttgggggcctggccggagaggagctgggggccacggagaagcaggtgccagctctggtgcagaggctcctatggcctttcaggcccgtggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgtgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggatgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcccggcggctgtgtcttcacaggagccgacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcagacggaggtgccagcaccctccccgtggctgtttcttcaatacctccattttcctttattggaattgcccttctggcattccctttttgttttcatttttctttttttggagacggagtctcactctgttgcccaggctggagtgcaatggcgtgatcttggctcacagcaacttccagctcctgggtttaagcgattccccttaagcgattctcctgagtagctgggagtacaggtgcacgccaccacacccagttaatttttcaccatgtcagccaggcgaactcctgacctcaggtgatccgcctgcctcggcctgccagagtgctgggatgacaggtgtgagccaccacacctggctgtgttcccattttttatttccgtgttgctttcatcttcatttcccagttcttttgattacctacttttaaaaactgtcggccgggcgcggtggctcacacctgtaatccgagcactttgggaggccgaggcaggcaaatcacggggtcaggagaccgagaccatcctggctaacggtgaaaccctgtctctactaaaaaatacaaaaaaattagcccggcgtggtggcaggcacctgtagtcccagctcctcgggagactgaggcaggagaatggcgtgagcccgggaggcggagcttgcagtgagctgagattgcgccactgcactccagcctgggtgacacagcaagactccatctcaaaaaaaaaaagaaaaaaaatactgtcacctgggtctgtcactgggagaggaggtgacacagcttcacgcttcgcagtctgtgcatgaactgagggacgggtgtgtggtgcgggtcactggttgtggcgtgactgaggcgtggacaggtgtgcagcgcgggtcactggttgtggtgtggactgaggcgtgtgcagccatgtttgcatgtcacaagttacagttctttccgtgtaacttaatcatgtccttgaggtcctgctgtttattggacaaattgcagtaaccgcagctcctcgtgtatggcagagccgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagtggccaccggcacctggacggcgacagagccttccaccgcaacagtctggacatcttccggatcgccaccccgcacagcctgggtagcgtgtggaagatccgagtgtggcacgacaacaaaggtctgtgcggaccctgccaagctctgcccctctgcccccgcattggggcgccctgcgagcctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggctgcgagtaaggcctcgttccatgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccacctcgtagctgtttcactcgcatccagagggccacctgctgcgttctcctcatctgcctcttcctgggcgccaacgccgtgtggtacggggctgttggtgactctgcctacaggtgggtgccgtaggggtcgggacagcctcttcctgcccagcccttcctgcccctcagcctcacctgtgtggcctcctctcctccacacagcacggggcatgtgtccaggctgagcccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacttagctgggcatggtggcgggcgcctgtagtcccagctactcgagaggctgaggcaggagaatggcatgaacccaggaggcggagcttgcagtgagccgagattgcgccactgcactccatcctgggcaatggagcaagactccatctccaaaaaaaagaaaaaaaaaatcccacaaagaaaagcttgggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactcaggaggctgagccaggacaatcgcctgaacgcgggaggtggaggttgcagtgagctgagattgcgccagtgcactcctgcctgggtgacagagcgagactccatcttaaaaaaaaaaaaaaaatgaaattcaaaactctgttccttagctgcaccagtctgctgtcaagtgttcagtggcacatgtcgcgaggggctgccatcacggacggtgcagatgtcccatatatccagcattctaggacattctgttagatggcaccgggctctgtcctgtctgctgaggaggtggcttctcatccctgtcctgagcaggtctgagctgccgcccgctgaccactgccgtcgtcctgcaggtggctgggagcctgagccccacacctgccgggcagtaggtgctggacatcgacagctgcctggactcgtccgtgctggacagctccttcctcacgttctcaggcctccacgctgaggtgagggctctactgggggtcctgggctgggctgggggtcctgccgccttggcgcagcttggactccagacactgtgcacctctcagcaggcctttgctggacaggtgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacgtgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacaacccccacttactgggtctctccttttacaaccaacacaaccgaaatctagggcttctttttttttttttttttttttgagacagagtctcattccattctgtcacccaggctggagtgcaatggtacgatctcggctcactgcaacctccgcctcccgggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacaggcgtgagccaccatgcccagccaaatctagggctggaacatggctgcagcatataaatagaattgaattccatagttttgttaatcctgttttttgtttgtttgtagttgttgctgtttttgagacagagtctcgctctgtcgtctaggctggagtgcagtggtgtaatctcggctcactgcagactctgcctcccgggttcaaactgttctcctgcctcagcctcccaagtaggtgggactacaggtgcccaccaccacacccggctaatttttgtattttattagagacagggtttcaccatattggccaggctggtctggaactcctgaccttgtgatctgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagagagtttgggcacactctgtgtgatcgggcagaaggcctgtgggaagtttagctgaggacagggccaggaaaggtgatggacagtgggggtctgtcctggtcaccaggcccctgggtcctgcccgcctgcttggagctccccacccatcacacatgatgcggccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgacatagataaggacatcatcactcagtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtacaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaagtcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccctcccctccccctcccctccccctccccaactcagatccggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggcgctgttgcactcttgtctccaacagacaaaacggaccaaaacaaagtgaaatgtcatttgatttgtgtcatctggtttgatgacttttttttgtttgtttgttttttagacagagtctcactctgttgcccaggctggagtgcagtggcaagatctcggctcactgcaacctccgcttccggggttcaagcaattgtcctgcctcagcctcctgagtagctcagattaccacgcctggctaatgtttgtatttttagtagaccaccacgcctggctactttttgtatttttagtagagactgggtttcaccatgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaatttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtatttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccacagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattacttccttttcaagttgtgaaacatgttaacctgtggtaaaatacttacaagatgataattaccatctaaccgtgttgaagtgtacagttcagttgtgtgaagtatattcatgtcatttttttttttttttttttttgagacagagtctcactctgtcaccaggctggagtgcagtggtgggatcttggctcactgcaccctctgcctcctgggttcaagcagttctcctgcctcagcctcccgagtagctgggactacaggcgtgggccaccatgctcagctaatttttgtatttttagtagagacggggtttcaccatgttgcccaggatgatctccatctcttgaccttgtgattcacccgcctcggcctcccaaagtgctgggattacaggcgtgagctacagcacctggcctatttttttttttttttttgagacagagtttgaattttgttgcccaggttggagtgcaatggcacaatctcagctcaccacaaccttttcctgctggattcaagtgattctcctgcctcagcctcgcgactagctgggattacaggcatgcaccaccatgcctggctaattttgaatttttagcagagacagcgtttctccatgttggtgaggctggtctcaaactcccgacctcaggtgatccgcctgcctcggcctcccaaagtactgggattacaggagtgagccaccctgccagcctcatgtcattctttgtgtgtgtgtgtgtgtgtgtgtgtgtgtgtgtgtgacagagtctcattctgtcgctcaggctggagtgcagtggtgtgatctcggctcactgcaaactccgcctcccagcttcaaacggttctctgcctcagcctcccgagtagctcggattacaggcgcccactgccatgcccggctaatttttgtatttttagtagagacggggtttcaccatcttggccaggctggtcttgaactcctgaccccgtgatccacctgcctcggcctcccaaagtactgggattatacgcatgagccaccgtgcccagccgtcattcttatattattatttcctaggtgtctttcctgaagactatcttcccatctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaagtccatttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttcgacaatatttgtggcaaattcagtgggttcaaaattgagtttgtcctttctgcttcattagtttaagctgtataattcctttcccttcctacattcttgtttgtcattttttcaggggaagaggagttgctagtactgcattggttttcctttctctctcttttttttttttttttttcctgagatggggctttgctcttgttgcccaggctgcagttcaatggcacaatctcaactcactgccttttgggttcaagcaattctcctgcctcagcctcccaagtagctgggattacaggtgcccaccaccatgcccagctaatttttgtatttttactagatatggggtttcaccatgttgtccaggctgatctcgaacttctgacctcaggtaatccacccgcctcagcctcccaaagtgctgggattagaggcgtgagccaccacacccagcacccagcctttttttttttttttttaattttgagatagagtctcgctctgtcgcccaggctggagtgctgtggtgcaatcttggctcactgcaacctctgcctcccagtttgaagcaattctgcctcagcttcccgagtagcttggattacaggtgtgtgccgccacattcggccaattttttttttttttttttttttttttgagacggagtctcactctgtcacccaggctagagtgcggtggcatgatcttggctcactgcaacttccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacacctcggcctcccagtgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatggtttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacactccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaattgaaccttgttaaagtcagtcaacaccagggtggatggtttgccgttgtcacctattttcaggacataacaccctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgattttttttatccctcaatgggaggtgtccattctcccttcagttgtgagaatcagttggttcatttgtgggaaggttgcaggggggatctttgaatcacagccttcagatgccagaagggcagagggaatcccacacgggctggtggatcatgtgtgtgcatttctctcccttctagtctgaggaaactaagcatgaaagaacgtgagcacagagaagaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttaagagacagggtctttctctgtcgcccaggctggactgcagaggcacaatcatagctcacggcagccttgaactcctgggctcaagcgatcctcccacttcagcgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagtcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgctgtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgggactacaggcatgtgccaccacgcctgggtaatttttgtatttttagtagagacagggtttagtagagaccatggtgaaaccccgtctctattaaacaaatctctactaaccccatctctacaaaaaacagctgggcgtggtagtgcacacctgtaattctagctacttgggaggctgaggcacgagaatcatttgcatcttggaggcagagtttgcagtgagctgacatcgcaccactgcgctccagccgggatgacagagcaagaccctgtctcaaaaaaaagaaaaaggaacaaacaacagcaacgacaacaaaaaaacctctgtgtcaatcacagcctacaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgtgtgcacgcgtgtgtgtgtgtgtgtttaatatagagacagggtttcactctgttgcctaggctcgtttcaaactcctgggctccagtgatcctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgctcctggccaattttttaaggcaacgttttcagcccatggccagggtaaggcacagctagtaccaagatctggcttcactggccatgttatccaagaggcctctgcctgcctgcaaagtagtactgcacactgggatctccctggaccaaaccccagcttcagttttgggtacttcctcataagccttgactaccccagagtgtgagggattttgcagcctggtcccaggcatgcactcaccagtcaatggcatcgcggggctggccatggcctcccaagccacaaaagcaaccatatttcacataggcgatgggagttcagggaccaacacaacccacaattcctgccagttccaggatcccacgccggtgcacacataatatcctggaggctggggggtaaacaaaggtgacaggctgcaggtcagggcttcccagacccctgggaagggcatgagcctgagaggagcctaggtgttacagcctggctgtctgggtttgaatcctacttcctggctgtgtgaccttggacaaattcctaacctctctgggccttggtttcctcatctgtgaaatgggggataagctgacttcaactcatatgaatgaaatgagataatgagtataaagcccctggtgcatgaaaaggctattataatccggctgggctcagtggcttacacctgtaatcccaagattttgggaggcccaggcgggcagatcacctgaggtcagcagttcaagatcagcctggccaacatggtgaaaccccatctgtagtaaaaatacaaaaattagccgagcatagtggtgcacgcctgtaatcccagctactagggaggctgaggaaggagagtcacttgaacctgagaggcgaagattgcagtgagccaagattttgccactgcattccaacctgggcgacagagcaagagtctcaaaaaaagaaaaaaaaaaaaaggctaactattataatcaaggtcctcaaggtagccaaggagggaaaagagtcgtgcatgaaacctttgtccagttccctgtgttgggcactcggcatcatatgagcctacaggtgtctgtcaccaaggtgggctcctctgtggcagctcccaggccctggcactgccctgtgctcatgacttttcctccagactcaggctcagggcccttggtatctcctcttattttcactgccagataggaaggccccttggactgagcccagccatttatctagatcctggcacagcttggacatgtaatggtgcccaatgcatgtgactggaacccctgcattggacatgtaggaaacgaggccagccgggaaaggtaaccccacattcccacagccagcaggaactcaagcagaggcttcaacccaggcttctgacttgcaaaccagtgctccttcctccttacacagtaacaacaggggaaggtggccttccaggttgccagagccgagtggtaccagcaatagagtggaaactcacacacaggcttgcctgcttcctggtttaggtttagggtttatacggctccgggaggttgatgcattgtgtttgatcatccccttttttttttttttgagacagagtctcattcctgttgcccaggctggagcacagtggtgtcatcttgctcacaacagctccgggaggttgacgcattgtgtttgatcatcccttttttttttttttttttttttttgtttgagacagagtctcattcctgttgcccaggctggagcacagtggtgtcatcttgctcacagcaacttctgcctcccaggttcaagcaattgtccagcctcagtctcccgagtagctgggatcacaggcgtgccccaccacacccagctgatttttttatttctagtagaaacggggtttcaccatctaggctgggccggtctcaaactcctgacctcatgtgatccacctgctttggcctcccaaagtgctgggattataggcgtgagccactgcgctcatcctgatcatcttgtctctctttttttaaatagagacagggtctcactctgtcacccacactggagtgcagtggcacaatcatagctcactgcagcctccaaatcctgggctcaagcgatcctcctgcctcagcctccagatcctgggctcaagcgatcctcctgcctcagcctccagacatacgggcatgcaccaccatgcccagctaatttttaaatttttagtagatctgcggtctcactatgttgcccaggctggtcacaaactcctggcctcaagtgattctccttccttggcctcccaaggtgctgggattccaggcatgagccaccatgcccagtctcatttctgttttatctagaacatgttttcatcacactgacttttttgagaagtccaggccaattttaaattccattttgtctttttatcagtggaaaagtagcatatttatgttgcacgacaaagatgaatcaaataggaagaaaatgtaaaacacatttggggccgggcacagtggctcatgcctgtaatcccagcactttgggaggccaaggcgggtggatcacctgaagccaggagttccagaccagcctgaccaacacggagaaaccctgtttctactaaaaatataaaattagccacgcatggtggcacatgcctgtaatcccagctacttgggagggtgaggcaggagaatcgcttgaacccgggaggcagaggttgcagtgagccgagctcgtgctatcacactccagcctgggcaataagagtgaaactccgtctcaaaaaaaaaaaaaacacacgaaaataaaacggcatttagagttgaaagcttcaccttcctctctggatggtgagtcctcactctcccagcagcccacacctctgcctcaaacctccatggctcccatgagtctggttaaagctaaggagtctcactgcacctcaagtcctgggggtagtcagcccctctcacccctccctcatcctctcacacaagagtcatttactgtccctccagttatgcccggtcacgcagacactctgctgctcaaatgccctcaccccatcctcagcctgctcccaggccacctccctccagaatccaccctgcctgccaggtggtcatagggaccctcgccatactgtctgcttgtggcagtgccctccagcctggggggtcttccagagcagatctctggccaagcgcagtggctcatgactgtaatctcagcaccttcagaggccaaggcaggtggatcacctgaggtcaggagatcgagaccagccttgctcacatggtgaaaccccgtctctactaaaaatacaaaaattagccaggtgtggtggtggtgcatgcctgtagtcccagctactcaggaggctgaggcaggagaatctcttggacccgggaggtggaggttgcagtgagccaaaatggtgccactgcactccagcctgggcaacagtgagactctgtcttaaaaaaaaaaaagaaaaagaaaaagagcggagctctgatataagctgccctggcacacagtgagcttccagaaatggtcccttgacctctaaatccaccaagacccagggaacatgccctctctgagcactctgacaatgatttgcatttctctaatgaccagtgatgatgagcttttcttcacatgtttgttggccacataaatgtcttcttttgagaagtgtctgttcatatcctccggccacttttggatggggttgtttttttcttataaatatgtttaagttccttgtggattctggatattagcccgatggatagattgcaaaacttttctcccattctgtaagttgcctgttcactctgatgatagtttgttttgctgtgcagaagctctttagtttaattagatcccatttgtcaattttggcttttgttgccattgcttttggtgtttcagtcatgaagcctttgcccatgcctatgtcctgaatggtattgcctaggttttcttcttgggtttttatggttttaggtctaacatttaagactttaatcaatcttgagttaatttttgtatcaggtgtaaggaaggggcccagtttcagttttctgcatatggctagccagttttcccaacaccattttaaatagggaatcctttcccattcttgttttttattacaactttttacctaaacattcaataattttcactaactttttggcaatgaggcagctgagtctaagtaggttaaatcacttatctgaggtcacacggcaggacagtgcttgttctgcaaagttaagtgtgtttctttttgtggaccatgagaacatctccaactgccctttttgacttggccaccagggaactcagcgccatgttctcaaatccagtttagtaactggccttctggcctgtatatctttattctaccttccatcctgctctgttctgcttttacctcttattctagattatctttctttagtcctaattttaaatttatatctataatcttgttatatatatttcttggcatctactgtaagtgggtagtgaacgaataaacaaaatgtgatgaattttagaggactaagaggggcctaagtcacaccaagattcatgctggataatttgtcatcgacccagactgtggttctgcactcgccagtaaccagtttttttttttttttttttttgctttttgccaaccatacattttgctttcatggtatcgaagtggtttaagcttatggcttccagcctgcagtggctatgaggggtcagtctctcatcaggaggggttggcagactctgttctcagataggcagcaaggatggaggtggggcaggagcaatttcactacctgcctggcgtctgggtcttgcttagagaaataattccaggctctgctgctttcgactctgtctctcatggttccactgattcctgcagagatctagagagaaaatttccagcgaggagtttctggctcgtttgattttgaacacgttttgagtattccaccccttacccccccgcccccactcactactctgtagtttttttttttttaagaaaacagtttgaaagcacaaataaataaataattcaaaacagaggggccatttttatttactttggttgtttcaggagagggaagggagcttacactttttttgaactcttattctatgccagccgatgtgctgcattcttagcttaaaagcctgcttctctttgatttcagaataacttggaaataaatgatcagaccctgcatgctctgatcctggctgtctgctctaactaaatctcctcttccttgcttcctccagcgagttgttctcccttcacctcccagcacaagctttgcacgtgttgccgtctgtcctacaaaggtctgtcccttcccagtctccgtgtgactccctccttcacacccatggttctccactgaaatgtcctttgagcacgtctcagatgcctcagtctaaagtagatgattctgggctgggtgcagtggctcacgcctgtaatcccagcactttgggaggctgaggcaggcagatcacctgacatcaggagttcaagaccagcctggccaacatagtaaaaccccgtgtctactaaaaatacaaaaataagccaggcatggtggcgggtgcctgtaatcccagctacttgggaggctgaggcaggagaatcgcttgaacctgggaggtggaggttgcagtgagctgagatcacgccactgcactccagcctgggtgacagagcaaaactctgtctcaaaataaataaataaataaataaataaagtagatgattcacagaaacctctgttcttttagagcactcttcaacactttttatgctttttatgtttgatttctaataaatatgtttctttcactataccataagtatattccttcttctaagtttcattaaggtagaatcacgtatgtcttatttcctgttatatccctaagtacctagcatgtagtaggcattcaataaaaattgattgaatgattgaacactcaatcccatgatttgagtgttttttttgtttttgtttgtttgtttgttttgagacaaagtcttgctctatcacccaggctggagtgcagtggtactatcttggctcactgcaatctctgcatcctgggttcaagtgattttcttgcctcagcctctcaagaagctgagactaactacaggcatgtgccaccatgcccagtgatttgttttgcatgtgtgtgtatttttagcagagatggggtttcactgtgttggccatgctggtcttaaactcctgacctcaggccatccaccctccttggcctctgaaagtgttgggattacaggtgtgagccaccacgcctggccttttgtaattattctaacagctactacttattaggtgctgactatatgccaggcactgtgccaattgatttatttattttcagggattgggtcttgttctgtcaccatggctggagttcagtggcacaatcatagctcgctgaagcttcaaactcctggggtcaagcagtccccctgcttcagcttcccaagtagctgggattacagagatataccattacactcagctaattttaaaaaatggctaattttttttttcagagatggaaaaaaaacaaaaaacaaaaaacagctactacttattaggtgctgactgtatgccaggcactgtgctgatttttttttaatgttttttatttttttagagttggggtctagttctgtcaccatggctggagttcagtggcatgatcatagctcactacagctttgaactcctgggcttaagcaatcttcctgtctcagcttcccaagtagctgggattacaggcatgggctatcacacccagctaattaaaaagacattttattgtatagataggggtctggctgtgttgcccaggttagtctcaaactcctggcttcaagcgattctcctgcctccacctcccaatgtgctggtgttacaggtgtgagccatggcacctggccctgtgttgatgttttacatacagcatctcatttaatccccaccaggatcctgtggggatggattggattatcccccactccttggaagagcttaaggatacccaaccagttggtgattgagctgggatttgaactcaggcattctaatggcaaagctgtgccccttccactctaccatcgtgttcctctccaggggaggtgtccctgcagtgctgtgactttgtcgtcgaacatgtgctgaggtacgtgaatcctctggagaagaagggcaaaggaacaggctttccaggcaggaagcccctgcaggcgagggaggaaggctgcaagggacatggtaggaggtatcttgctccccatagctgggctgggaggatgagatggctgagagccaggagccgggctggggttaggctcatatcagcctgcagagggctttggggaacccaggctttggggccagacaaacatagcttctcacccacctgatcatttcctctctgttgtatcctatgtttctgggtctcagtttccttatctatgaaatggggataccatgacctgttctgcctgcttcatagagtgctaaggagcagatgacataacgtgtgcaaaagcagctgttcttatttctatcacttattttcattatcgctattctcaagcaggcagacggtaattttttacctctttcttttttttcacccttgagttgtttggaagttatttttaaaagtctttgaagtgtccttttccatatttggcaaaagcaaaatggaaattgatagcattgtcaccgtcggcatcccctcactccggccgcctggctgggggacagctctgggaaaatgtggagatgtctgttgtgggcgactggtttgttattgcgtgaacttttctggcgagacctgaccagctcccttttaaggcaattcctcgtgttcttgttcctcctcttttcttttcctgccaatgtcaggtcctttgtgccatctccaggctcagaaatccgtacagccagagtcggtccccagtttggccacttccagctgaaaagctttcccatgccttccctttaacttagaatagcatccaaatccttcattgtgaccaaggccctgtgcagtctgctcctgtcactttcctctccattactcagctccaaaagtgtcacctcccttgactcctccaatgccccacatggtttccagccccagggtctttgtggggtctttgccaggaatcctgttccccgtttttttgttatgggtagctctttctcatctttgacatctctgctccagagtcaacttcacacatggctcttccctaacccacactaaaaaataagcctccttaaagaaaaaaaagaggctggacgtggtggctcatgcctgtaattccagtgctttgggagactgaggtaggaggatcacttgagaccgggagtttgagatcagcctgggcaacacattgagaccccatctctacaaaaaaaaaaaaaaaaaaaaaaaaaatagcgaggcgtggtgctgtatacccatagttctagctactctggtggctgaggcaagaggattgcttgagcccaggagttcaaggctgcagtgagccgtgattgcaccactgaacaccagacgcagtgtcatgtacttgtagtcccggctgcttgggaggctgaggtgggaccatctcttaagcctgggagtttgaggctacagtgagccctgatcatccctgtgaatagccattgcactgcagcctgagttacacagatacgtctcttaaaaaataaatgaaaagaaaagccttttaaattcagtgtcttcgcatagttagtccaaccttaaggagtgttaccagatacaaacaggatgcccagttacatttttttttttttttttttttttgagacagagtctcactctatcccccaggctggagtgcagtggcatgatcttggctcactgcaacctctgcctcccaggttcaagtgatgctgatgcctcagcctcccgagtagctggaattacagacgtgcaccaccaggcctggctaatgtttgtatttttagtagagatgggtttttgccctgttggccaggttggtctcgaactcctgatctcaggtgatctgcccaccttggcctcccaaagtgctggggtgacaggcgtgagccaccatgcctggcaaaactttgtagcccagtttgttctatttttttttttttttttttgagacagagtctcgctctgtcgcccaggctgtagtgcagtggcatgatcttggctcactgcaatttctgcctcccgggttcaagtgatttccctgcctcagccttccaagtagctgggaatataagggcgtgccattgcacccaaatttgaaccttagataaacattgaataattttccagtattacatcagatacataacttgtatttaaaaaatcattccttatttcactggatttaaaattgaattgggtgtcgtatatttttacttgttaagtctggcaaccctaccctctagagagaggtgttgaatgaatgagtgtgaagtccttagcttagggcctggcactcagtaggtgctaagtaaatgtcacctgtcagcatcttcctcctcctcttcttcctcctctagttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagtgagttatcacagagcgttccctccagcactgggtcatgcaaatatttattgcgagcgttaaataataaatggagcagcctgcccaatggtaaatctgtcatgtttggtttcagccaggagttgtgatggctctggaatcgctgcccgtttcaccgcatccacctgccctctagaggagcaaggcaaacagccgagttctctggggtggcatcagtgggctggtgtggaagccagaggggcggtggggggagtcagccaggcatggaaactggcaggtaaggcagccctgtggcccaggaacctgagccgcagccacaccgagcaggcctggacctttgagtcccgctgccaccacagttctcaggggacacggtctcattgtccacatctggatttatctttccgtatttccctcattgctcttgtcagcttcactctggctgactggctggagctggcaagcttctgaaagtggagtcaaccttccgaccctttttctaggctgagtggtgggtggaggaatgagaccgtgtgttggactcaaactcgatgcaataacgtttcccagcccctgtggtgtgctggggctcctagcacacatcctcttgtttaacctcagcattgcaacctgaaacacagacacatgggttcttgagccagatgcctctgagttggaatcctatctctgcacttaacaagcggtatgaccttgagtgagccacagtttttcagagcccctgtttcctgatctgtaaggtgggggagatggtggcactcaccttatggggctgttatgtattagtccattgaggtgtcttagcctgttttgcgttgccataaaggaatacttgagggtgagtaatttataagaaaagaggtttgtttagctcacgttctgcagactgtacaagaagcatgatgccagcatctgcttctggtgagacctcaggaagcttttcttcactgtggaggatgaaaggggagcaggtgtgtcacatggtgagaagaggggtgagagagagacaggaagggtgccaaacacttttttaacaatcagacctcgccgtgaactaaaagagtgagaactcactcattactcagggagggcaccaagctattcatgagggatctgctcccaccacccaaatacctctcgccaagccccgcctccaacattggggatcacatttcaacatgaggtttggaggggacacacatccaaactatcttatgaggtagtaggataatgtaggtgaagacttgcacagtgcccgggacctggggacaaatgctagctctaatggttaataatggtccagagaagaaaataactgctcagatgcacagacatgactgcactagtcaaccatgcaggtatgagtccccatcctagagtatggggtgcatagagctctagcccaccattattgagttgtagaactaaggctccaatctggggctttatggatccctaaatcatgccctttcaccttccccatatctgctttattcctcatagggtggcagggagggtggagctcatgcctggccttaatcatcatggcctaagtttggtagtgtccaaacagtggtgaggggtgaagttgtagggttgccaggtaggttgtgtttggcttcaaatcactgagaacccaactggaagtggtgtagatgctaatggaagttattgtttctctgcagggggccatgtggttaattgattcagtggctccattgtggaatggtgggccttgtttccttccacttttccactattccattcttagcagctggctcttgccctcagccacaccccatcatggtctcaagataatatggacaagagagaagagagccttcttccacttgttccccgcttgtttttgagacagggtctcgctctgtcacccagactggagtgtagtggtgcaatcatagctcgctgcagccttgaacttctaggctcaagtgatcctccttcagtttcctgagtagctgggactataggtgcatgctaccatacccagctaacttcagagttttttctagagatgaggtctccctctgttgcccaggctggtctcgaactctgggcctcaagtgatcctcttgcctcaacctcccaaagcactagggttacagatgtgagccaccacgcccagcccatctgtccctttttatgatcattttctcattttctcagaagctgccagctgacttctccttcatcgcattggtcagaaatgtatcacgtgcccttttctaagccagttgctggcaagggaatggaattcccaaggttgccttagaccagtgcttcttaaagtgagatccccaggccagcagcatctgccatgtctaggcaattttaagaactgcaaattctcagaccccagttcagacctactaaatcagaaactctgggggtgggatctatgtttttatttatttatttactagaatcggggtctctgttgcccaggcaggagtacagtgacactatcatagcgcattgcagcctccaactcctgggctcgagcgatcctcctgcctcagcctcccatgtagccaggactagaggtgtgcacccccacacccagctaatttttttattttttgtagagacagggtcttgctatgttgtccagtctggtctcaaactcttggcttaaacaatgctctggtctcaaactctcagcctcccaaagtgttagaattacaggcgtgagccactgcgcccggcccatagtctatgtttaaacgtgccctccgggggtttctgatggacactgagtttgagaacctctggtttcctaagatcttttcctctgaagagccagagaataaatatttcaggcttgtggccacacagtttctgtagcaaccactctgttctgctgttgcagtgtgaaagcagctatagatgataataaataagtgaatgggtttatttatggagactgagatttgaatttcacctaatttttatgtgttaggagatattattacacttttgatcttttctaactacttaaaaatgtaaaagccatttccagctcctgagccgtacaaaagcaggtggtgggccgggtttaggcaatggtttgccagccctccatcagactgctcaagattcatcccctgaaactggggagagtctaatagtcttaaaacacagagagccccagattctttagaaaattggaatttgggctgggtgtggtggctcacatctgtaatcccagcactttgggaggctgaggtgggaggatggcttgagcccaggaatttgaggccagcctgggcaacataatgagaccccatctttacaaaaaataaaaataatagtcggacgtggtggcatgtacctgtagtcccagctactcaggaggctgaggcaggaggatctcttgagcccaggagtttgaggctgcagtgagctatgatcacgccactgattgcagcctgggtgacagagcaagacactgtctctgtctaaaaaaaaaaaatgaaatttgggccaggcgcggtggctcatgtctctaatcccagcactttgggaggccaaagtgggtggatcacctgaagtcaggagttcaagaccagcctggccaacatggtgaaaccccatctctactaaaaatgcaaaaattagctgggcgtggtgacacgtgcctgtactcccagctactcgagaggctgaggcaggagaattgcttgaacctgggaggtggaggttgcagtgagccaagattgcaccattgcactccagcctgggtgacagagcgagaccctgtttcaaaaaaaaaaaaaaaacaaaaagggctgggcgtggtggctcacgcctgtaatcccagcgctttgggaggccgaggcgggcggatcacaaggtcaggagtttgagaccagcctggccaatatggtgaaaccctgtctctactaaaaatacaaaaattagccgggcgtggtggcaggcgcctgtactcccagctacttgggatgctgaggcaggagaattgcttgaacctgggaggcggaggttgcagtgagccgagagtgcaccactgtactccagcctgagtgacagagcgagactccgtcaaaaaaaaaaaaatactgataatgacagtgctaacagcaataatagatagctaacaagtgtggagtgcttatccatcttctagtccccaccttcctttagcccaggagttcgaggctgcagtgagctatgattgtggcactgtactctagcctgggcaacagagcaaggtcctgtctctaaaaaaataaaagcataaaaataaaataaccaaactttttattaaccttctacccccagagggccccctccctcaaatagctcattaactagacctggtttgcatgcccaccccctctagggactgagcccaacttctgagatagggacccttgaaagaactggggttctgttagcaagaagaattaagacaagaggatgacttttggtgttgacagtgtctgcccctgttttttgtttgtttttttgagatggtgtctcgctctgtcacccaggctggagtgcagtggcgtgatctcagctcactgcaacctctgcctcctgagttcaagcgattctcctgcctcagcctcccgggtagctgggattacaggcgtgtggcaccacacctggctgatttttgtatttttagtagagacaggatttcaccatgttggccaggctggtctcgaactcctgacctcaggtgatccacccgccttggcctcctaaagtgctgggattacacgtgtgagccaccgtgcccagcctgccacagttctttacacatttgatctttagctcacccaacaaccttgtaaaaatatgattgctacccataattttcaaataatctacgtatgcgtaagagagagaagtgattccccaaagatcacgcagctaataaagtggaagggagaacccaggcccacctggctccgaagctcacactctttccactaagctgcctgcttctttcattggaatagaggttctcaatcgtgaatggtaggagtggggtgcggtgaattttgaccctcgggtgaaatttgaaaatgcttggagacatttttggttgtcataattgggagaaagggtgtgatattggaatctagtggatagaggccatggatgctgctaaagtttttatagtgggccgggcgtggtggctcatgcccataatcccaatattttgggaggccgaggtgggtggatcacctgaggtcaggagttcgagacgaccctggccaacacggtgaaaccgcgtttctactaaaaatacaaaaattagccaggcgtggtggttggtgcctgtaatctcagctacccgggaggctgaggcaggagaatcacttgaacccaggagacagaggttgcagtgagctgagatagcgccactgcactccagcctgggcgacagagcgagactctgtctcaaaaaaaaaaaaaattatagtacataggacagccccacaacaaagaattattcagcccacaatggtgccaaagttgagaaaccctatatactaaaacaagctctttgagggcagggatcatactaccttgactaccttgttcaattctcaatcctttataccctgcctgtcctggcacattgtaagtgctcagtaagtaatgactgagcaactgagcagatgtgctacaccagattccagagtcaaataatcatagacttggagaagtgcagggttatgggggctgcagtataacactctacctcacagtgggtgcatccaagccaccagcttcccctggttccagaaggcctgttagagacatgtcttgcatttgcacttggtccagcacagcccatgcctcccacttgtgaaaagaggctgactgatgggtggtgatcagggttggctgccttttcatttttgagatcatgggaacagagggaccggatgaagaaacacttctctgaatctacccatttctaaatggatgaatcaccaaggaggaaactcaaagattaatttctcactgcccttcttcccttgctctgctctttgtagacagttactggtgctccagggcaaaagataatgaaagttcttccttgcatcaaactattttcttcaggagatagagccagcattagccaaagagatggtctgggctctgggagcttggcttggaggcccaggacattcaaacagtccttcccggagaacaggctggacctgcagtgatgaataattattttgcaattgacagttcaatacccaccagattcttcattgtatgtttctgtatcgtgtcaagttatgagaaaacgcaatattctttaacagctaggcaagaacaatggtttttgctcatttgtttgtttgtttccaccccgcagaggtcagtttttgcagtaagaagagtctcattctttttttattttattttatttgtattttgagacagtctctctctgtcatccaggctggctggactgcagcggctgcaacctccatctctcaggttcaagggattgtcctgcctcaaacttctgagtagctgggactacaggcatgcctacgccctgctaatttattgtatttttagtagagacaaggtttcaacatgttgtccaggctggtcttgagctcctgacctcaagtgatccacccgcctcaccctcccaaagtgctgggattactgccatgggccactgtgctcgtgactcttcaagaagagtcttgaatttactctgaatgtgtccttggttggcacaaccacgagcagaatatgcatcctatctatcctcacaaacactgcgtttattatccccaatttgcctttgaggaaatggaggctcagagaggttaaataacttgctcaaggtcacgtgggcaatgagtggtggagtggagatttgaactcaggactgtctgtgaccctcccagccctgcagtctccaagtctccagtactatctggctctaaaatccgtactattccctctgctatgtttttgtggcgacttgaactcttccttcaaagtcttggctgctgctatgaactgaacgtgtaccttgtgaagttgtattttttccatattgtaattccatccttcaaaagtaagtcttgttactgaaagactgtttcaaccgtcctggggtaggagtggctaacaggttggcttgggtcccacagtgaaatctgttctgagccagaccctcccgaggggacaggggacgagcaggagagattgtagctgaagtagacatctcctgggttcccagaaatgtggaagaaccttgtgcaaaaacagcttcctgcagagctgcaagatgggatccaggttattggtatttgagcactgtgtttaggggctatgagagaaacctaacatgaaccggctgaaggaaaaaagtggaggattacatgaaaatgaattcagggagcttgcaggtgtactgaagggaagtgtgagctctaaaagctggaaaaggtctaaacgtgtagattacaaaaatatctgcagcttagcatggcaatgacggataaagcgtcagatatgtgtttgtcatccagttgtctatggctgtgcaacaaaccacccaacatgtagtagcttaaaacatgacagtcatttattttgctcacacatccacaatttgggcaggatgttgaggggacagttcgttcctgctccacgtggcatcagctggagctcaccagggggctgcagaattcatttctgagatggctcctctagcggttgctaagttggcgctttctggttggctgggagctcagctaggctgtggtccaggggacttggttcctttgtttgggcctctcctctcttcagctacttgggcttcctcatcgtatggtggctgggctctaagacaaggagaacccagtggaagctctgtcacattttatgatgtagccttggatgtcgcataacgtttcttctatattctattggtcaagcaatcgcacagtctggattcaacggtagatgacataggttctaccttttgatgaatcaaaaaattctgggatcatggtttgaaactaccaaaaagtagcggctgtattgtttgttattattacaaagtaggccgtgtgcagtggctcacacctgtaatcctagcactttgggaggccagcctgggcaacataatgagacccggtctctaaaaaaaaaaaaaaaaaaaaaaaggagagagattagccaagtgtggtggtgtgtgcctgtagtcccagctacttgggaggctgaggtgggaggatcacttaagcccaggagatcgaggtggcagtgaactatgatcacactaggctgggagacagagtgagaccttatctcaaaaaaaagttaatgataattactacaaagcaaggccaatagtacaaaaacagtgatctttcacagtctatgatatagcaggacagtgctagatgttccccatctgctatgccatttattcctccccaaaatttgggaagctcagggaggcatataaactgcctaaacagggccgtgaagctaggaagtgctaaagccaggatttaaacccagaagtcaaatgctaaagactctgctagactgactacctgattctagaggctggggtgtgtgctaggtatctgaaagattggagagatgcagacagaaatgtgtgaatgtgagtgtgcaaatttgcacaaggccagtagcacctaagggggcccatgtgggagatgggagggtccctgccatctgcttccttctcctcatccatttcaccctggtcttctcagccctcccctctcctccatgcccctccttggtctcttcccatggaccctgtgagagcccctctccagctgtttatgggagatgttgaaggagaagcaagggctcctcacgaccctgtctctgcctctttcctgtgctctgggacatctgaactgtcacatagtcagctggcagggaagcccaattttcctttggctctccaaagggcctgattcatgggttaggctgagatcagatagagcccttgggtcaggtgggtgggattctggctcccagggctgctggcaggtgccatctggttgttctggagggagttgaggggaatggttcccacctggacagtgtctgaggggtgagctggtgaagcactgggcgggtggggagctggcagggacgggacagatacagagagtgccaggaggtgtggacagctgctcgcagggctcttggtgactttgccaggaaactgtgtctagacagcctctgtctgatctctcttctcatcccacatcatctccccggttcctccctggcctgaggccgtcctgccaggttggtgcagggatatgttgaacaaagttcagatgtgctgtgtgcacagtaccaggctcagcatagtctgagaatgaaaagcagcttctgaaactcagccctgcctcaggtgcagggagctgctggtcttgccaggaggcttaatgcctggatcaaatatgagggggctggctgggcatgatggctcacactcgtgatcccagcactttgggaggctgaggtggtgggaggattgcttggggtcaggagttcgagatcagcctgggcaacatggtgagactctgtctctacaaaaaaactaaaataaaaaaatagtcggatgtggtagtgcacatctgtggtcctagctactggggaggctgagataggaggatcacttgagcccaggagttcaaagctgcagtgagctgtgattgtgccattgcactccagcctgaatgacagaggcagaacttgcctccaaaaaaaaaaaaaaaaaaaaaaagacaaatatttgggggcttccccagatagacgtctggtgctatggtctgaatgtcattgttccccttgaattcatatgttggaacttaatacccaatgtgatagtagtaagaggggccccttaggaagtgactaattcatgaggaatccaccttcatgaatgggattagtgcccccttttataaaaggggcttgagcaagcgcctttgcctcttttgccatataaggacacggcaacaaggtaccacctatgatgcagagtgagccctcctcaccaggcactgaatctgcaggtgccttgatctgggacatcccagcctccagaactgtgagcaacacacttctgtcatttataaattacccagtctaaggtattttgtgataatagccccaaaatatgacacccagagagtgtgggccctctagaggtcatttcttccaggcccctgccagatgctgagctcagcctgcaaccccaggctgttgaaaatccgaggaggctgaggtcagggagggaggcaggaggccagcaggccatcagggaagggaccccagtgggctcttgaggaatggggaaggggcattaaagggcccaggtagaggcctggagtggtggtggtggccgtgggggtgtgagaagctggtttgggtgaagatgcagggagacaaacagagacccattgggcacggacaggtgctcacatgtttccttgcacctggcatgcttcccctggtgaacactgccaatgtccacccacctgttcttcacccaggtgggcctcgggtctgcagggacacagcaaaggaatgaaagccaggggcaggggtttaaatcctggctctgtctcttttcctccgtgtgacctggggcaaggaaatggtctttatagctcatgcggtctttatgcagttgtcttaggtgatgggggatgagaaagtgccttgtaatcaataaagacagatttattacgataatacaaatttattgatttgtaatcagtaaaggcagattaaccataccatttttttttttttaaatagggtcttgctgcgtctcccaggctggagtgtagtgtcatgatcgtagctcactgcagcctcgaactcctggctcagactatccttccacctcagtctcccgagtagctggagctacaggcgcacaccatcatgctcagctaatttttatttttatagagatggggatctcactatgttgcccaggctggtcttgaactcctggcctccagcaatcctcccatcccagcctcgcaaagtgctgggtttacaggcgtgagccactgcacccagacaggatcaaccgtatcttttgagcatccgttctgtgcctggcaccaggaccagttgctgtgggtcaacagaacagtttcaggtgggtggtggatggaatggctggtgggctcagagctagagcttaggcccctcagctactcctctgggcaggagtgagcagtgctcaccctaccccaggcttaggccacttgcgatgtggggttcctcttcgcgcacatctactgaccctggaactattgaagctattttgtgagtgctgtgccctctctgctgagacacaatccctgtctggcacacccccaacacatcatttgcccctggagtttaactgtactttggtgaagagtggcagaggccagagggaccccaggggtggacatgtgattagcttgatgggcaaccccaggacagagaacagggatggggaaggagatgcttcccactgaagaccccatgcactctgcagcttacaatgctcctaaaaccccgatgctggtttataaactctcttgtccaattgctggggttcaactgggagccttggtgtgtcccgcccctcccccaggctgtcccgttgtcaggcgagaatgaggcttatttctgctcatccaccaagcttgtctgtttccaactgtccattttttttccatccatctatctgcccgtccatccatctttccatcacctcctgtccttaggcttaggggatttcctcttgggaggggaactctttttgcagaaaaggacgctgagccccaaaagctgagtatttcccagcataaatgtctgagccctgttccctgggcaggtcctgtattggggattcagagttgaattggagttgtctcagcctgtgaaggaaagagacctgtcaacagggggtgacaaggagagtttgtagccaggtgtggtggtgcacacctgtagttctagctaattgggaagctgagcagggaggaatgcttgagcccaggagtttgagaccagcctgggcaacatagtgagatggccccatttctacaaacattgtgaaaactagccacgcatggtgacagatgcctgtagtttgagctaatcggtagtctgaggcaggaggatctttggagcctaggggttcgaggctgcagtgagctaggattgtgccactgccttacagcctgggagacagagttgcaagactcccagttgcgatcatttaaaaactgggagactgacatagcatctggcttttagcttctcttaatttattagaagctctgacagcattgggcccatgttcccacgtggagacagttggtggatacaagataggcagctacctccgtctttcaatggggcatgcactccaattcaccacagaccccaccattccctactgcttctcattcctccctttcttcacttatgttatctgcctggactctctacaaggattttcatttgtggttcctgtttcaggaacaggccatggtgtggcctttcctgaccttgtcaagcctcaggttcccagaggggaccaaaatagatactgcacattgtagagggatcagctgaggtaatataggtgaaagctctcaggaagcctaaagctctctgcaatcacaaagctacacaaatagaaattattatcatcattatttataaccattgaaaggacaggagacaaagaagtcagtccccaccatacccctcccaaccccaagcccacaagggtatttgtgccattatgatggcattgatcattgacattgacagttattattaaacgatgtcaacttccaaatgcaaaatgtttaccagatgaactcaaatgggctggcagaaataatgtccaggtgccatctaccttcaactcctcttctcatgaatttctgtggcatttctccagggcccagagtcaataagggagagagaaatgactcctctggtttactgaaggtgtgacttgtgattccagccaatgtcctgttggtcccattgtctcccctgccactacccatgtggagtcttagatcttggagactgtactatgtgggccaactctctcctcaagacacatttattaaaaggtgggtgaagtatcttctcctttgcctgtgtcttttgcccaaagggaagttgattgatgacaatgctcctttttcaagctctgattgccggtggaggttggataaagcatcttgctgtgatctctaagtgggctgtgccttgaaaacatgattgttgtgtctaatcatgtgtgtctgtggctcccttgccactcctggttgccgtgtcactgtgactctatttaacatactttcaggacccactgtatctgtcccgcctctctctggatcttcccaactctgtggttgcctccctgctatattcatggcccctaggggatgccacgtgtgttcggttcttcatgctgttcctctgtctaaaatgttctcttctgtggcagcttcctgcaaacatcttcttctctttccagactttctttgatgattaagaagcttgcacgacctaagtcttataattctgaaaatcatctcctagtttccaggaccccagatgcaccagcatggcttagggaaaggaaaatgacctttggagagagaatctttggagggatttgagcctcggcattgccacttactagctacaccatttgggacatgttacaagcccccctgaacctcagtttcctcatctgtgaaatgggcataatgataggccctaaatcttgtggtgaggcttacatgtgccaatggatataaagtatacatcatcacaatgcctggcacatgatgaaagattaataggggcaattaatatagtgtttgtgatagacccaaagatagactgacccgaggccgaccctgggcaccttttcaactgaaatcccaccaccttatattttgacttctaggtttcctttccctaaaagagaagtttggagaaggatctagaattgttggttaatcaagggcttgctaccttctaatcacttcatgttgatactaggataaagagcaaacatccttcatggggtttacaaggccctccatggccaggaccgtgtttatgtccccagcctcatagtccacttctcctctctccctgggtggtgacacattacacagtaccctcgcacatgctcttttgcccacttaatgcctgctcattcttcaaagcccaggcacttcctctggaagccttccgcagctccctgtgttccttctcgacagagtgtaaccgcccattgggtccaccttgcccgctgcctagacagagctgatttatcaagacagggggattggaatacagagagagtaattcatgcagaggggcattgtgggagactggagtttgattatcactcaaatcagtctccacaagcatttggggagcagagtttttaagaacagcctggtaggggtggttagttgaagccagtgagccaggagtgcagattggtcagggaagaaatcatagggagtcgaagctgtcctcttgcgctgagtcagttcctgggttggggccacaagatcagatgagccagttgatcgatctgggtggtgccacctgacccgtcacgtgcagggtctgcaaattatctcaagcactgatcttaggaacagtttagggagggtcagaatcttgtaacctccagccgcctgactcctaaaccatagtttctaatcttgtggctgattttagtcctaacaaaggcaatctagtccccaggcaagaaggaggtctgctttgggaaagggctgttatcatctttgctttaaactacaaactatgaaccatgaactcagtttctcccaaagttaggtcagcctacacccaagaatgaataaggacagcttggaggttagaagcaagatggaattgatcaagttaaatctctttcactgtctcagtcataattttgctaaggcagtttcaagagcacttactctagtttctggttttacattcatgactgtgttttatttggttcatgtctaattcctccactggaccgagagctccatgatggcaggaaccaagtccgtgggtggccccctgtggtgtccccagcattgaacacagcagcacgtccctcatgggtgttcactacataataatttgttggatgcacaggtggatacatgacttactactttaagaatgtgtgcatttgagatgtttacttggaacaacgaaggcttattcttgaagaaacaacaagtgataagtcaccagaagacagaaaacagcatgttggagctgggtggctcctggtgcctgggaaatgaacccttggggtggttcttggaaggaagtgagcaggtttagtcccatctgatgaactctttcctctccatggttaagttggcttctaactcagggactaagttttatttgagactgaggccactgctggtgggttggttggtctcctccacctttcccttcacccgtaaatgggatattagtgaacgggtggcataacccacctgagggttcttatagggtttcaggagaacagccctcatctcccaatttcctgaactgccatcaagataactgtgtgtgtgtgtgtgtgtttgtgtgtttaatcgagacagagtctcgctctgttgctcaggctggagtgcagtggcatgatcttggctcactgcaacctccgccactcaggttcaaacaattctcatgtctcagcctcctgagtagctgggattacaggcacgtgccaccacacctagctaatttttttttttaagatagactgatttttgtatttttaatagagatggggtttcaccatgttggccaggctggtctggaactcctgacctcaggtgatctgctcaccttggcatcccaaagttctgggattacaagtgtgagccaccacacctggctatcatcaagataactctttaaataagccaaacatttattggccaaaagcaatgcacatgtgctgtcaacaagcaaatttggggaaacacaaagagaatagaaacagaaaataaatattaaccacccagatgtaatcatattagcattttggggcatatgtttctgattctttttaaaaaatatttatgtctctctgtgttttctatttatatatgtattgcaacctgatttttttcattgagcaaatgtaaaatgaacagaaaatgtccaggaaagcaaatgtctcccttctgctggcctggtgtattacacagggttctgtggagggacagaactaataggatagatgtatatacaaaggggagtttattaaggggtactgactcacacggtcacaaggtgaagtcccacaataggccatctgcaagctgaggagcaaggaaaccagtctgagtcccaaaacctcaaaagtagggaagccagcagtgcagccttcattctgtggccaaaggcttgagagcccctggcaaaccactggtgtaagtccaagagtccaaaagctgaagaacttggagtccaatgttccagggcaggaagcatccagcacaggagaaagatgaaggccggaagactcagtaagtctgttctttccaacttctgcctgctttattctagccacgctggcagctgattagatggtacccacccagattgagggtgggtctgcctctcccagtccactgactcaagtgtaaatctcctttagcaacatcctcacagacgcacccaggatcaatactttgcctccttcgatccaatcaagttgacactcaatattaaccatcacacctggtatgacagtactagccttgtcccaagaggcaggagccccagaactgcagagcatctgatagagatgtgaatagtggctttggaaggaatgactgtggccaggtaaggtgacaggtaatggcgaaaacaggcatgaaatcgtggggcagttcaggtgagccattccccaatattcaccaagagataatagggaagggagagagagtaggggtctcaaaagcagggtcacggtgctgataatctgaaaggtagggtctcagagccattgaatgtttcatttattcactcaacgagaatttcttgagtggctaatatgtgccaggtgctgcagcagccagtggggattgtaggtcacaaaaacatgacttcattcaaagcatgcaccattatttacatatgtaaagtgccttggcatgaaatagaagcccaataatctcttgcaaccatagagatgagcattaatgacttttccagaattgcatctatggttggtgattattcctatgtggccaaatgaccagaaggagcagaaagctacatttttgtggcatcttgtatacatagaaatgattgctgtaaatatatgttgactccctttaatacatatgcaactaattgaaagcgggcagtttatggtgtagtatcagtgaaacgtgctctgttgccattaagtatagctttgttacattattgagacaacttgccttgggggcactggggtaagttattgcttcttcaaccatattttggtccttagaggaccaaccgctagtccagcttttattacctgctgtttctttaatcacaacagggaaatgttggctaggcatcggacgggagacttttcttataagatgaaatgagccaagattggaagacgacatttttatttgccttacaaatggactggatacagtgtgaatggcttcgtgaatgagatgaagggctctgctgcgcagcaatcccaaaccattcacccttatgcagaggcagagagcctcctaaatgaattgggttctgttggagttagctgctcttattttcctgtgctgaggagtctggagtgggagggtatccatttcccaaccaataataattagctttgattccaggcaacatgtgcatttttaatccgttaggcatagggtcttcccgggacctatacgtttttcaagatctacagaaatgtttgagaccaaaaacaaacaaacaaacaaacaaacaaaaaacaccacacaaacacacatacacacacacacattggcttaaaaatgcaaaagagaaaatgacaaaattgaaattaatgaatatcttaaaaattacctacgctgggcatggtggctcacgactgtaatcccagcactttgggaggctgaggcaggcagatcacctgaggtcaggagttcgagaccaggctgaccaacatggtgaaaccctgtctctactaaaaatatgaaaatgagcttggtatggtggtgcatgcctgtaaacctgtaatcccagctactcaggaggctgagacaggagaattgcttgaacctgggaggtggaggtggcagtgagccgagatcatgccattgcactccagcctgggcaacaagagtgaaactccttctaaaaaaaaaaaaaaaattacctacaaattgtgctgctttgtcaatatcactaattgttaaatttaacattcctagggatttcattacatctgaaaaatgtggatagttagaatttcccactttctagacctcctgaatatgcacaattaccaagaaatcacatccaatctaaatttaaataaatcacctattgccagataatttcaggagcagaattttaaaattttctcaaaaaatgtttagagccaaaaatccatttaatgtaggatacaggcaaatttgtagcatgtttcaaatgctttctggtgagacctccaaaagtgaatgtgtctagggtatataaaattcttaaaggggctttgtcatccttcttccccactcacccataaaatagatgagataaaagctatttctaagggtggctcttttgtgaagtatttgagctttacggtagatgagactattgtttagtaaatatttgttccctctcctattacatcattgatgttcagctaggctatgtgacttccttttccctgagagatggcatagtgtacttccctacccttcgactgttgagttgagcttaactttctttggctaatgggatgtgagaggacataacccttatgaaaggcttgaaatgctctcgtgtgatgagtttgccttcttgtgcttttgccttctctatgagaaaaacatgacttagttggttgctggtcctagaaaaatgagatgcatctagagcagagccgccccagcatgtcttcagacctgcaacctccagcagagctgctccagccaagctatacgggcatggcagagaaataagctctttctgggatttggggttgtttgtcttacagcatctagctgactgctgcaagttcctgcacacagtggtgcttactcatgtttctgaaggaatagcagtttgtttatttcaaccatattgctagttatttgttattttccaccatattgctagggttataactctgaaaacaagttcagctacttctcacatgttccttctgcctgaaaactttgtctccttgctcttcacgtggatggctttctatctttggctctggatttaaatattactcccttgggatgacctcttctgatacattatttaaataccatctgtggtggagcctactatttacatattgaaacatctacattcccttttcttctctgaaataacaccttattttcgggggaaaaatttcaaactgagacaatagttggaagaacagtacaattaagttttccctctcctcgaatcgtttcccaatactttactgtgtgtgtcttgcaataaggaccttctcctatatgcccataatacgaccattaaagtcaggaaattattataacattgatacattaccaccatctaatccaaaggccccattcaggtttcactgaccatcccaataatgtcctttataatcttgcagggcaagattatcatagcatttaattgtcacgtcttattccggcagattcatcagtctctttgttactttcttgaccttgatacttttgaagatacaggccatttatgttgtataagagctctcaattggggattgtctgatgctttttcgtgactagaactaggtcgtgcaccaattctaggcttcaacaccccatgccagatctctgtcctatcccctctcgttgatgcttactttggttggtgccctttagtgactttaacactgaatatttgaggaagaataaaagatgaaacactgattttaattagggtgacatagactctgctttaaacaacaacaacaaaaccaaaaccctctaatttcccaatctctcatgaagctacccaagccatgtgatttagctttggccaaggaatgcaaagagaagagtaatatggacattttctcagaatgaggaccatatatttctttgcccatttttcctgttgttggtcttgaattaggatgcaatggctagatctctggatgccatatttgaccatgaagtcaagtccaaatgagaaacgatcattcccaaattaaggccgtgacttaaggaggtatataaaagagaaggtggcaattggttgaatgtagggtgtgatggagaaggactcaaagatgttgttcaggctcttggtttgggtaactgggtgaatggtgatgatattcatggagaaagtgagctaaaaattaggagtaaaattatttggaaggcaagttaaattcgtttttggaaagaaatgaatctgagatatacaatggacatctgacggtgttctctaaggtaacgggaattggaaacagatttcaatattgaggtggtagaagaaggggtcaaatcatcaaatcatgattctgttacttggaaggaaggctgaaggggagaccttgagcatcttgtttcttcttagttccatttatgctttatgcttttgagcactaatcacaacagatactgtggaggctgagctccagccattgtcaagcctgtgctccagcactggtataaattactggagtcctcattctagaggaaagcacggggacgaatcttttctagggctctttaccttgtctactcttcctgcagggagtagttcagactttcttcttctacctcctcttcttctttttttctttatagagacaagatctcagtctgtcacccatactggagtgtagtggcacaattataactcactgcagcctcaagttcctgagctcaggtgatcctcctgccttagccttctgagtagcttggactgcagggttcatgccaccatgcctggcttatttatttatttatttagtagaaacagggtctcactatgttgcctagtctggtctagaacttctgtcctcaattcatcctcctgcctcagcctcccaaagtgctgggattacaggtgtgagccactacacccagcctaggtttttctttcttttcaatgaatcataacccttctctcttcatttctagtgaacatgcatcaccttatcctatcacaaaccaactctgtgacaaatgtactattactatgcccattttacaaatggaaaaactgagacttaaagaatttaaattggctgggcgcagtgactcacacctataatcccagctcttttggaggccaagatgggaggattgcttgaggtcaggagttcgagacaagctgaggcaagaaagcaagaccctgtctccacaaaaattaaataaattagccaggtgcggtggtgcacacctgtagtcccagctactccacaggctgaggcaggaggatagcttaagcccaggagttcaaggctgcagtgaactatgatcatgcccattgcactccagcctgggcaacagagcaagaccctgtttctaaaaattagacaaaataccaagcaacaacaccaacaaaacaacaacaccataaaacaaagttaagtatcctggggttatactggaatccaaataatctggtttaagagcttaacctcctaaccaccatgctatactgccttgtggcaactcatgccttgtgaatctttactcctggtagtgtttcacagttgacagagagcttttgcattcttgatctcatttggtcctcacaacagccctgtggggcaggtaggaaagaccttgttattagacatgagggtcctaagaaccagaaagctaatggacatgccgaaggtggcccagccaatgaatagcagagttagataagaattgtgatcttcaggccgggcacggtggctcacacctataatcccagcactttgggaggccaaggcgggtggatcacttgatgtcaggagttcaagacctgacctcaagtctggccaacatgatgaaattctgtttctactaaaaaatacaaaaattagccaggtgtggtggcgcacacctgttatcccagcttcttgggaggctgaggtaggagaatcgtttgaacctgggaggcggaggttgcagtaagccgagattgcaccactgcactccagcctgggacacagagccagactgtctcaaaaaaaaaaaaattgtgatcttcagcagccttatagagcacttcttctactgtataatcctcgctttcctcatttacatctgtgaaaaagatattccttttgttcagatgctcttaggtgctctgaagcaagcaatagcccaagctggcattttgagagccatttcatggatggaaagcggaggctcaatggctaagggaattagccttggttctccagtgtgtctgcagtcttcatggcattggtgctgctgatccacagtcatgccagaggttgggtccgcagtgaaccgcttcacagctggatggttgggggaaaagagaggtctaatgatagaaaccttccccaaagcaaaggatgtaagcccacaccgagaattattagaaagaataatattctcccacactgagaattattagaaagaaagaaagaaaaactagaaagaaggacaaaggcattccagcatgcttcctgtgacagattgagccagtctttgtaacctcagattcacaaggacattgcaaagaatttcctgttgcgctcaccaaaattggctggcccttgtgccagagtcccactgacatccagaaaactattgcccatcttctctgggctgtgcaaggattagtgtcataatagatcatcacagccaaatgttattatgcaaagcagaaagctgcaagaaatggatcttcattcattgaatttgcatgtttggtggggactgcttcagacttcctttatctcgtgatcagtcgtgtgtgttgatcctctttgcaagttgttgtgagaactgggtgcagcaaaagctgccacttcaagagaccaaagggatttctgagatgaaaaagtgcatcaatttgcataaagaactcagataatttctaggtagaaagcaggtcagagaggctctagacctaggactctcgtgttggattgcttagtttcaaatcatgcttatgtcacttacatgcatgcaatctggataagacatttaatatctccccaagcctcagtgttctcatctgtaaaattagatgatgtggtgatgatgaaagaacatatataggctggatgcagtggctcatgcctgtaatcccggcattttaggaggatggggtgggcggggcacttggggtcaggagttgagaaccagtccggccaacatggtgaaactttgcctctaaagaaagtacaaaaatgagccaggcctggttgtgggcacctgtagtcccagctacttgggaggctgagacaggagaattgcttgaacccgggagacggaggttgcagtgagccaagatcataccactgcactgcagcctggacaatagagcaagactctgtctcaagaaaacccccaaaaaacaaaaaaaacaaaaataatatatataaaacatatatattatataatatataaaaaacatatataatataatatataaaacatatattatttaatatattatgtaatatctattttaataacatatattgtatattacataacttgttatattatataacatgttatataatatataatttgttatatatgttatataacatataaaccatgtattatatataatataatacatgttttatataatatataataattataatttatataatatatgacattatatattatatataacttatatatttatgtatgataaaatatatggtatatgaaatatacataattatatattatatgatataattatatatcatatatgtattatgtatatttcatatacattatattttattatataaacataagtatatattatactatgtaatagtataatatataattatacaatgtataattatatatgtaatagtataatatataatatacaatgtataattatatattatgatatgtatgacatacatatctaacatatattataacatgtatgttatatataacacatatagcatctagataccatgtatagcatgtgtacatgcatatatatttatgttattcaacatgggtccaggaatggagtaagagatcaacaaatacagtcattaaaatcagtgattcctcattcttctcccagctccttctttatgagattttgaaatccatatggatggataaaaatatccccaaatggtgcctaatgttgcagtgaaggaaaatgaaactctggaaataaaattagttcaaggagaaggagcatctccgctgttgacccggcttaacactagactaagaatagattgcaatggccccaacctcaggtatgccggataagtccctgaaggccctagaggggaacctgagaagggtttgaatgtttgcatgtgtgttcgacaagctggtacctggtagctgagatgtagaggagaatcattgtgccctatgtagagactggactatgtggactttttcatagctgtagacaaagacacgctgacagtaccagactggttttcaacctaatggcagcctcggggacaagggaaggtgaaaatggggctgcctatgaatggatgcgactcctcaggtttccatcagcctgaagtttggaagtgatctttggattaactgagtcggcagagtgttggaccacgagaaggcagatgtggagtgagatactggacttcttggctcctgtgagcaaagaggatgggcatgagattaaatggaaaagtaagagacgtgacagtttcccaggttaataacatgagtaatgccagttacatgcatgggagctcatttaacaactcttcagggttgtgttactacccaaaccctttatgatgctgagcacgcactgcagacactgattcctgcctgcccctccactctgtttcctggttaccttctgcctgattcattttgatctagacacactggcttccattcttttccatgaacaagccaagctccttcccacctctgggcctttgcacacgcagtttcctccacctggaatgctgctcccagatctttttacaacacatttcctctcatctgttgagcctcaccttacacgttaccctttcagaaagattttcccgttcatgtcctctccgctacattattctccctcccatcaccctctctaacatcatagtcctcaccattcctgaaatgatctttgttacttactgggtggcatgtttagaggctgctttccccactggctctgtgacagtgactttgtcatggtaactcaacattctgtttcctgtggcctgaagattgccgggtatatactaagtgctccatgaatatttgttggaagattcaatgaatcatatcttaccaatgcaatattggaagcctagagaaatgaaataacgttttcacaattgcacagagtaacagatgctttcagtgcttcccttgtatcttctaaccctttacctcttaagcatccactgacccatccaaatgtagttgcattctctttctgaggactttttctttttcttttctttttttttttttttgagatggagtctcactctgtcgcccaggctgaagtgcagtggcgtgatctcagctcacagcaatctccgcctcccaggttcaagcaattctcctgcctcagcctcctgagtagctggaattacaggcatgcaccaccatgcccagctattttttttttttttagtagatgtggggctttgccatgctggccaggctgtctcgaactcctgacctcaggtgatccacctgtcttggcctcccaaagtgctgggattacaggcatgagccaccatgcctggccctctttctgaggtctttttctggttgtactgtctttgcccacccgtatgatggcttggaagtcttggaggaatcaacacctgccctgggagcatccctccaccaggaactgatgagagttggtgtatgtggataactaccccatctccctcaccccttaggtcagataactatgaagcaagagctggtatgtgcatctttccccaagtccttgttcagggacaaggtagtgtgaaatcagccatggtgggaggatttacaccatggatatgggcagacactacaaatctgggcttttaatatttttctgcagtgttggttgttaaacatctaccagcacattgctagagatgttctacagtgtatcctagagttttccagcaagtttaagctccagttattgtcccaagtggtaacttgttttataatatgccctttactggctgcctccctgacctatttcatttcctgtgtcatgtttcatttacctcccacatagatgacttactcttggagtcttgtctcagggtctgattcttgggaaaccccgatgaaggcatacaactagtatgcgataaaaccagcatttaaacctaggaaggtctgactccaaatccacgtgtattttactaatactccactgcctcttgtgtctgaccagttctttgccaatacactgtgacaggagtcctttaaggagtgagacaaatgcattatattgatgaaagtagcttgcaattaagaagttagccttctaggccaggcacaggggctcaagcctataatcccaccatgattgggaggctggggcagggggatcacttgaggtcaggagttcaagaccagcctggtcaatatggtgaaaccccatctctactaaaattataaaaattagctgggcatggtgacgcacacctgtaatcccagctacttgagaggctgaggcaggagcatcacttgaattcaggaggcagaggttgcagtgagtcgggatcacaccactgcactccagcctgggtgatagagtgagactccatcgcaaaaaaaaaaaaaaaaaaaaaaaaaaaaaagaagttacgtttcttatgataagggatgggttaactagataaaacatgtggaaatctaatttagttagtaaattattttttatttcaaaaacacttttaaaacatagacatgttttccataaaacatgtaggcaccaagacagatttgattgctctcttgcgaatgatcagcagcaggcttccacttcatgcttgttataatttactgtttatagttcctaactctctgcttacacgctggtttgaatattcaagggtctcaccaagtggtgaggcactggacacaatgatgatgttgggtgcaaatgaatagggcttcagctggaaaggggcaaggggcagactggaaagagcttaggctttagacctctgtactggtcaggacactttggttcacaagggagagaaactcagtgcaagctagcctaggcagaaaagaaaaaagaacttaatgcctggggaaattggaaggttgaaggatgtgtagttagcttcaggtatggctcgatcaaggattactcgctaataaagcctctctccttcactagaatagaagctctgtaaagacaggcaccttgtctgccctattcatagctgcatcctccatcatatagaataatgcctggcacacagtgataataaaaattatagagcatgtcatatgggcatgccactgttcttagtttatccacttaacccaatgaggtaggcaattattaattataatccccatttttctgggtggagaaaccaaggcactgagaagtcatttagctgataagcagggtaactgggatttgaacctaggacctcttgctccagagtctgtgctcataaccatgctgctatattaactcagtaagtagttgttgattgagtgaatgaataactgactaatgatgaaacttgccagacacagagtattcagtaactaggagtgctgacatttatttgagtggcctctgttttctgtgtcccattagctttgggtgctggtgtcttcatctgcaggattccatatatttagcccagatcaatggagtgctggagggtcaggatgagtcgtgttcaagaaaataaggttggagttatttctagaattttttttttttttttgagacagagtctcgctctgtcgcccaggctggagtgcaatggtgtgatctcggctcactgcaacctctgcctcccaggttcaagtgattctcatgcctcagcctcccaagtagctgggattacaggtacccaccaccatgcttggctaatttttgtatttttagtagagatggggtttctccatgttgaccaggctggtgtcgaactcctgacctcaagtgatccactggccttggcctcccaatgtgctgggattacaggtgtgagacaccacacccagcctgaaattttgttttaagttcctgagatccaggggttgtttgttactgcagcatagtctaacccatcctgtgtagaagcccttacttacttaggatgtgtcattgagttcagagagaggcagtagaggaaagggcccagactttaaaatcagagagatgaaattccaactctccactcactagctgtgtgaccttgggtaagttccttaacctctctgagcctcactctgcattctcactagtgaaattacaactgtaattgctactccatgaaattgctttgactactaaaataggaaaccctgtcaagggtataacatagtaggtgttgatgtatgttggctattacttttgctattatgtagcaaagcatagattactttggctattttgaaaaaacctgttgctatcaattaaggatagagtggctaaattaagtaaattctgtaagcaaacaaggatgggtctttaattctcctccacttttgatttatggctgaagatttgacagttatctgaagtctgactagcttgaaaaccaagacatctgtgattagacttaccttttgttcttcccattagtgtaatacattgttttaggacatctctgccaacccactcccccaatatccatctagcttggagcctttatggccttcataaggacccggcttcccccttggtctttaaaattagacaacagatgttcataatcgaacctgtcttggttccagaaagtctgagatgttcagaaataatcagaacgtctctataaatatcataaaggatatatcattttggcagaaccagatccagtttttgtggggactgaagcttatataatatggggatctctgtttaagaaaaagaatacaaaattatgaatttaaaattaggcacaaaagagaatgttattttggaatgagaaattaagtataatattcctgtagctgcctggacatggtagctcatgcctgtaatcccagctttttgagacgccaaggtaggaggatttcttgagcccaggagttcaagaccagcctaagcaacatggcaagacccccatctctacaaaaaaaaaaattcaaaaaattagccaggtgtggtggtgtgtgcctgtagtcccagctactcaggaggccgaggtgggaggatcgcttgagccagggagttggaggctgcagtgagcgatgatcttgccaccacactccagcctccagcctgggggtaacagagtgagatgttgtctcaaaaaaataaaaagagaaaattctggagcctttagctatttccattccattcttctgggatctgtgtaggcaattaatcagaaatgtgaacatagaggtgcttcattattgaaacccagctttcccttctcacctaaagccttccccaagtccagcatttaaagagacaggtacaaggaaaagaccctgaagcccaagcctcattagcttcaggtaaattcacctccgctctctggagaagcagacaacagaggcctcttgtgaatattgaggagaaggttgtatgtgtgttcatgtgcgtgagatccaagtggagagcatgggaacctagctcaattttcccttgaggtgagcttgaagctttgggtatcttcctctcagagaacgtaaacccatttttccaacattgttgtaaaatattctgttcccacctttcccacaatcagcttgcctgaccccaccacagggtgtgtcatcttgtgcttctggcacacacacacacacacacacacacacacacacacacacacacactctcagagccctgccatctgaaggcagccagctccagaaaggccaacccttagctgtaactcagcatagcactgttcatgatctttggtttccatttctaggctggtttccttttttgttttgttttttcctttgccaagactgtagttgaaataggataaaggatttatttttccataacaaggtaggagaaagggtgctaggttacaagcaccctgtcaatatcagagttggaagcttcttcctaccatcaggtgtgtgttgtgaaaggaacgaggggttcaggcaagtatttcccagcaggtgggaaggggtcttgatgggatggaaactaggaaaacaaaccagattccctgagggaaaatcaactgttcctgaactgttatcagtgtgggagtagggttcacagatttcatattctaaacatgtttgtgtgtggtgtgtgcacacacacctactatgtggcagagcctgtcataagtggtgatggattcctgtagatatagtttgctggagctgccataacaaagtactacagactgggtggcttaaatgacagagattaattttctcacaattctggaggctggaagtctgagatcagggtgtcagcagggttggttcctccgaagacctcctcttggcttgcagatggtcgattctggtgtgtcctcagatggtctttcctctgtgcctgtccatccctggtgtctctctgtgtgtcctaatctcctcttcctataagaacacgagtctgattggattagagctcaccctaaatgagctaaataggtttaaacttaatcacctatttaaagcccctatctccaaatacaatgacagtctgaggtgctagggggttaggacttcaacatatgatccatatggttgaagggcttcaaattcatatatatatatatatatatatatatatatatatatatatatagagagagagagagagagagagagagagagagagagagagagagagacagagagacagagagagagagacagagtctcgttctgtcgcctaggctggagtgcagtggtgcgatcttggctcactgccacttccacctcccaggttcaagtgattctcctatcctggcctcccaagtagctgggatgataggcatgcgtcaccacacctggctaatttttgtatttttagtagagatggggtttcgccatgttggccaggctggtctcaaactgctgacctaagatgatctgcccacctcggcctcccagagtactgggattacaggcatgagccactgtgcctggcctcaaattcatatttgaacatttattcaaatttgaattttagggggacataattcagcctgtagcactgtcaacctaaaaggaagaagctgaggcaaaattaatgtaagtaaagactctgtttgggccaagcttgaggactgtagccagggagcgtagattcaagtttccctgaatatacactccaattagcagcagttacaagtggatttataaaggcaaaaaagggggacatggagtgggctggtacacagttggttgtcaggaattctcactggttttcagaaataacattgacgagtgattggctatacattgttaagctatgaggtgtgggttatagcatccagtggggcattattagattaatttatagctacttgtggcaatggcaagcagttttaagaaatgaataccgagctcaaagggggtatgtaggacatgattgctatctcattctattgcctctctgggcctaataatttaaaaggcttgtattcctcagatgaaagttctgttcttttctcagcaccttgaatggctggagagagcaccaccccatccttgaccatgctgagtgctggctggacttcaactgggccagtactcccttttcccttgtggaaggtcccctgattaatgcttacctgaacgcctgctcttccttcagtccccagttctctgcattccccagcactgggaacagagacagcatgtctgtgttatacaatagggaagagtatgggctctgggtttaaactttgactctgcccccttgttagcccagcgactgtgagcaagtcatttcacttcacccaacttgttttcctttttgtacattggaggttactaaaagcaccttacctgtccaattgtagagaggattaggtgtattaatgggcatggcacagtaaacactcacaaaatgctagctactattaattgtcaagattatgttggttgcaaggagcagaaactcatatggaagtcatttaggcaataaaaggggataatttattgactctcataaccaaatccaggaaggtaggagagcagttgagtggcaggggcaactggaaagagaccattccccatgtctgtctgtctgtcatatcttttttatttttatatatgtatttttttaccatggtgggtttttttttgtttcttttctttttttggttgttttttccatccttggctagaaccatggctgccaacaagcttctctgtttcataatgggagaccttctcatgtggttatgatgtgaaaaaaatcccagggaaggactctgattggttcagctcaggtcacatagccacccacgtggccaggtcaggggctggggtgcttaggtggggcagggggttctgggtagataaaaataattaatgccttctgccttatctaaatgttctttgtactatgcctggcacttggtagaaattaaacaaattcccctttttccctttctgtttgaccctcatgtctactttttattacataaaagagtaatccagaaaagaaagtcagctcattggagacactgggtagggagaaaaagctttttatagaatattaggtaggagtagtggcttaggatggtaagagctctgcacgaaaggaagacattacggtctaaggccacctgggagatctgagtcaagcagctctatcccttcctgaggacaaaagagatttcaggcaatgactcatttgtttggagagctaattgacaagacatattaagagttttagcaattgttcatgctttttgatccaacaaattcacttctagagtgtcaagaactgtgctggtctaagatattatcctacatggaggctagtgagttttatggatgtgggcagaagacatgagactctggattgagagataaaggactttatttttcatggcacaacaggaagcttgagcttcatgtctgcaccagttccctttgacccccaagtccctcaagggtgacacaggttgacatggtttggctgtgtccccacccaaatctcatcttgaattgtagttcccacaatccccatgtgtcatggaagggacccagtgggaggtaatttaatcatgggggcagttatcttcatgctgttcttatgatagtgaatgagttctcacaaaatctgatggttttataaggggctttttcttcttttgctcattcttcccctttctgccgccatgtgaagaaggacatgtttgctttcccttctgccatgattgtaagtttcccgaggcctccctgagtcaattaaatctctttcctttatgaattactcagtctagggtatgtttttcatttgtttgtttttttgttttttttgagacagagtttcactcttgtcgcccaggctggagtgcaatggcaggatctcagctcaccccaacctctgcctcccaggttcaagcaattgtcctgcctcagcctcctgagtagctgggattacagccatgtaccaccacacccagctaattttgtgtatctagtagagatggggtttctccatgttggtcaggctggtcttgaactcctgacctcaggtgatctgcccacctcagcatcccaaagtgctgagattacagccatgcctagccttttttttttctttttttgagacagagtctcactctgtcgcccaggctggagtgcagtggcgcattcttggctcactgcaacctccacctcccgggttcaagcgattctcccacctcagcctcctgagtagctaggattataggtgtgcaccacaatacctggctaattttttgtattttagtagagatgaggtttcaccatgttgcccaggctggtctcaaactcctgagctcaggcaatctgcccacctcggcctcccaaggtgttaggattacaggtgtgagacaccacacccagccttgggtatgtttttattagcagtgtgagaaatgagtaatacatggatggatccaggtagaatctgtgcctgcagtggatttgcatcacacctgaggaaccccaagtttaggaatcttggtcttttcaacctttaccctggatggagggagacattgtcattataatcctttctttttctttttcttcttctttttttgttttttgtttttttgaggtagagtcttgctctgtcacaccaatgttggagtgcagtggaatgatcttagctcattgcaacccctgcctcttgggttcaagcaattctcccacctgtctcccaagtagctgggattacaggcgcccaccaccacacccagctaattttttaagtgtttgtagtagagatggcagtttcaccatattggccaggctggtctcgaactcccaacctcaggtcatctgcctgcctcagcctcacaaattggtgggattacaggcatgagccactgcgcctggtccggagatattattattataatcctaatcagcaaataaatctgtcttctactatactagccctatcttctaatgctattagctatacaaacatccttataaagacggtctagaacaaaagctgacacaagatgtgcagaaatgtaagagacacatggggaattgttgcacagcatagagaatctttcctaaggaaactacatctgaaacacacacagaaaatgtattcttaaagcaacaatagttcagcattaggggaagaggttaaacagactgttgttgggatactcttctgtttctaaacatgtttctgaagatcttggaatgggaagtgtaaacgttcaacttaaaatgtaaagtggaacaaaaagctgcaaaacttgaatatatgtttttattaactatgtacagacatctattctaggaaacctgggagggagacgtgctaaaatgttcatagtctttctctgggcgatgagtctaggatccactgtttttcttcatttggaatgttcatagtcctcctctgggcaatgagtctaggatcaactgtttttcttcatgtggaatgttcatagtcttcctctgggcaatgagtctaggagccactgtttttcttcatttggaatgttcatagtcctcctctgggcaatgagtctaggatcaactgtttttcttcatgtggaatgttcatagtcttcctctgggcaatgagtctaggagccactgtttttcttcatgtggaatgttcatagtcttcctctgggcaatgagtctaggatcaactgtttttcttcatttggaatttttttttttcagtttttctataatgaacatgtattacatttataatagaaaataacaagataaattatttctgaaagcagtgcccagcatccagaatttggcaaaaacaggagaagaaagcataaaacaagcagggaaaaaggttttcagttaaattagatgtccaatgaagagatcagcttggctgcaaaatctctttttgacagacaattagttctgggcaagtcaaatgtttcaacagtgcgttcttctggggcaattaaagtaattcatacttgatgtgcggaaatgtggtaattgggaaagttccccaaatggcagttgaaactgggctggttgtgtttggagaagttaagtcatgcccttgacaagccatctatctgagtctactgaagagggcttgggctgggtgattttaagatggaattttccactgggcataggaagtgatgttgggaatggactagaagggtcaacagtgacaacattaacagcatttattgtaatataaatacagttggcccttgaacaacatggatttgaaccgcatgggtccacttatacatggatttttttctgtttttgccacctctgagacggcgaaaccaattcctcctcttcctcctcttcctcagtctcctcaatgtgaagacaatgaggatgaagacatttatgatgatccacttccacttaatgaataataaatacattttctcttccttatgattttcttaatcatatattgttttctctagcttattttattgtaaaaatacagtgtataatcatataaaatacaacatatgtgtatattgtttgtgttattggtaagacttctggtcaacaataggttattagtagctacgttttgggggagtcaaaagttataggtggatttccaactgtgagggggttggcatcacagtcattcatgggtcaaccattgtgtcaataacaatcataccacacatattttgagtgccacatgttgcactaagcacttatgtatctattaatttctacaactatcccgtgcaatagatacgattggagtttccgtcttactgataaggaaactgagggccagagaggtcaattgagttgtccaaggtcacacagccagttagtaatggagctggaatctgaatccatgcaatctgacccttgttcaatgctcctagacttatgtgctggatttttttttttttgaaataacaatgttttatacctctatctttactttcctagataagggcatctgatttccctccatggcaagcaagttatgttgtatttgctacatttgagagggaaaaaagctgaagttcagaacggattagaaatttcccaaggccacacagtgaaagaatagaaagtttccttttttaaatggcggagcttttatatcaatgctgtttgtaaattttagttggcaatgtctgttatattccatgaaactgaatgagaggtgaggtggtatattagccaaaactctctcagctacatcttgctattgttccatgcaacttcaaagcccacagatagactggacttcaagtatggctggatccagatgcttaaatgatatgctttgaaatctgtctgatctctacttctcagctctcttttcatccatgttggcttcattatcaggcccttttcttatgccatcagcagctgctgacttacctcctaccagcttagtaatcccaggggaaaatgaacttacctttgccaaaagcactggcataagaagctgactctcattgcattgtaagagtcaggtgcccatctctgaacgaattattgtggctaaggaagtagaagagggtgattagtcagtcctgatcatgtgctcagctctagctttagaagatggtgctatccaaactccatgaatgaacagtgaaggaaggaccattgttcaaaagtaagtggaaatgctgtttccaggaaagcagaatgggaggaggaagtggggggaggggggaagggattcaaggggtgggagctggaatggaattagccctaaatagttggagtttggagggtgtaagtaagtgtgagctgaatgccgaaagcagagttgcaagatggtgtgtcagcccagttctgagaaacaaactcccatacaggattacacatatgtgatttttattaagggaaatgcccttgagagaaagcaaagaaggtgccacataaagctgggagaacctgagacagtaatgcaagtctgactctgagtaaaagagagaggagaaaaaagttagggtgcgaacaccatagggaagtccctaagccaaagccggggacaggggaatcctgtgtctcccggggaggggtctgctttagtgtccctgccatgctcagtcattagccaggagcacctcatggaaggaagcatatggattccccagcgcagcagctggggccctggttaattacactcccagtagagggaggtcgatgaggcccattctcagggccaccacatggtgagccatgcagcagtggcctggcagaacatttgtctgggttcatacagtatttacattaaaaaaaatcagggctgggtgctgtggctcacacctgtaactccagcattctgggaggccaaggcaggcagatcacttgagattaggagctggagaccagcgtggccaacaagggggaaacctcatctctactaaaaatacaaaaattagctgggtatggtggtgcacccctgtaatcccagctacttaggaggctgaggcaggagaatttcttgaatgtgggaggaggaggctgcagtgagctgcgatcatgccactgcactccagcctgggcaacagagtgagactcttgtctcaaaaaaaaaaaaaaaaatcagttgccagcattcaacaaactgtgtattttacatctttaaaaacccctggatttcctgcttctctttaaaaaatagtggcagtttggcaacattgggagtccattccacaaatcttgcaaaattgagtcctcgctgcctccttagataaggtgtgtgctctctagtttgccacagtctccaccagacccagttgccctaatctgtactcttcactcatttgtgttacttgtctgcccatgtgtgcatttaagtttgcaacccttgccttaaattcatctgagaaacaaactatggcagtcaggttcagccatagaatctaatgggaaggagcaaagctggagattgagcgactaagctagaggttgataaagcaggaatagagcaggtagctggagtctgagcagacagacttcagggcttgtctgccttcctaagagctcctttgctggctgggtgaagtcactgagaacctaagcagagggtgtcagttctagccttcctggagaaatcttagttgagatggatgtttagagctggtggacactgcctttgtgtcaagccagtctaggagtcacagcaatatttggacactggttgaaagttgttccattccatcccacttgctcagcaatttggacaagtgtgggtttaggttattttaattggttaatacccttttgtttaggtgctctcctttcctcttccacatggttcagtaaggctgccaattctagagctctttcttctcctatgaaagtcatggatgtcttaggctgggttttcccagaggcagatcctgtgatgaggatttccatgtaatggtttatttgtagggtgactctgggaagcaccagtaggagaatgggagtgtattagtcagggttctttagagaagtagaaccaatagaatagcacacacacatacacacacacatatgcatatacatacacacacacacacacacacacatatataagcatatggggaatccatatgcttccttccatgaggtgctcctggctaatgactgagcatggcagggacactaaagcagacctctccccaggagacacaggattcccctgtccccagctttggcttagagacttctctatggtccatatatatatatatatatatatatatatgtgtgtgtgtgtgtgtgtgtgtgtgtgtatacacacatatacatgtgtgtatatatacacacatatacatgtgtgtatatatacacacatgtatatgtacacacacatatgtgtgtgtatgtgtgtatatatatatatacacatacatatatgtatctatatgcacttttatatacatacattcacatacatatatgtatctatatgcacttttatatatatgtgtgtgtgtgtgtgtatgcaattatggaggctgacaagtcctaagatctgcaggatgagtcagtaagctggagacccaggagacccagtggtgtagttccagtctgaaaaccagcaggcttgagatccagaaagagccgtgtttcagtttgagtctaaaggcaggaaaattttgacgtttcagcttgaaggccctcaggcaggaggagatctctctgactcaggcaagggttggccttttgttctatttagaccttcaactgattggatgaggaccatgcacatctggagtgcaacctgctttcctccgtctacccatttaaatgttaatctcgtctgaaaacaccttcacgggaacacccagaataatgttttaccaattatctgggcactcagcgtcccagtcaggttgacacataaaattaaccatcacagggcaaaatgagacaaggaaatctaaaccagaatagagcaaggtaatgagtaagttacttctatgggcagccggggcttggtccttttgatgggctttggttgatggcatggaacacacctcaaattgtcccacctgagtgttgagaaaactgagatatttatctttcatcactcatctgacattgaccaagggatgctctcagggactttgacatccttgaacttctggcctgtcttgccgaggccaagaaaaggccttcaggtggggagttgcaggtgcttgcagagggatgccttcagcttgtatgggatggggagggtccaagggacatgggtggccattgccagtgtctgctatggttggtaagtggcacatatctggtcaaacatcaggatctatccacccagcagtgttggaccttggagtggcacaggcatcagaatcttccctggggattaacttattgtggttcttgaacagagaggatatatatctggaggtgccagcctctacttgccctcccacatggagagagatggagaataaggctgagcaaagacaaacagtgaagagaaatggagacagagagagggagagagagagtgagagagagagagagagacagagagagagagagagagagagacagagacagagagagagagagagagagagagagagagagagagtatacatgtactttgaggcagtgagtcctgtttctagtccctggggctctggttcttttctcttcctgtcttagtctgtttttgctgctgtaacaaaatacccaagactagataacttataaaggacagaaacttatttctcaccgttctggaggctgaggagtccagggtcaaggcacaggcacattttgtgtctggtaaggggctctgttccttgcttctaaggtggtaccttgtgtcctctggagggcatgaatgctgtatcctcatatgtggaagttggaagggcaaaagggcctaagttagttccctctacccctttataaggcatgaattcattccttaagggccaagccctcctgactgaatcacttcctaaaaggcctcacctcttaataccactgcaatgaggattaagtttcaacatgaattttggaggagacacgttcaaaccttagcattccctttccgtaaatgacctcagctggataaaccagtatattcgtttcttgattaatttagccagagttagatttctgggcatgcaaccaaaagctcttactaacagttattgtggtgggatagggatgaggggaagggagattgggattgagagagagattgccctgggcctaagagctttctctccttattacatcccagtgcctgagatttaagttgctagaaggaagatgagtttatggtggaaatttgtaaccgaccattaactagaatggcgcagctaagcccctgtgcctgaccaattgttaggacttaaagaaatagcaataaagaaagagcttttagtttcagagcttaattagccattcttttccttcctgacttttagttttatgactctagcttccaggatagaattttattgtagtcagatacaaattaaacccaaacaaggactctcccgtgtttctgtttcttcaatttaaatttattctttgtagggtgacactaagtaccacagtatatgtcacatgtaagaacagtaaatttttaaaaaagagagacagggcaagcatttatcattgtgatctcttctctaaacataatgggaacttaggttaattaaaaaaaaaagttaatgccgttgttttttgccttaagaaaggtagggtttttatctgaagtgctctgagaattggcactcttaaatctgcaatgatgagaaataacagtagctaccatttgttgaaaatctattagtagtatgctaggtccttaaccttcagtatctctaattaccccaagacacttgaaggatggatggtctaaagtttccatgtgtgcaaaatgatagctctgagaagacttaaccaatgtttcaaagatttaaaaaaaaaaaaaaaggaattggagccagtttgcattaagaccttttgaactccaaaaaatctatctatgtgcttccgacttgaaaagggtatgttttgcatgctggatatgggtttggtggaggtgctggtgtatacactgtatgtttcaatgctagacatcgtgctgggtactggacttagtaggcacctgatcgcatttctgttcggcaaattcagaaaatgtgagtgactgaaacttcattaggttgaaggggaatttaccttttcactacgtctgagcaaagggtttattcggtaaggtatatttatattatattatattatattatattatattatattatattatattagtgccccatggaaattatatttgtttctctacagataacaaagattcttatttctctcttaaaattcaaaataaagagccttactgacatctaccataaatcctctgctgtaaccaggtagagtataaataactccataaaaagagagtaatgctgtcttgcgtttgcacagcactttacagtttagaaagtatttgcttgccatgtccctttcgatcctcctgataggcttgcggggtaggaaggagaggtactgtcatttccatcttcctggtgggaaacaaacatttggagaagttgggtgacttgccccaaggtgacacaatagtgaagggttcaaaccaggacttagttagtttgggtgtcagaatgggtcagagtgggtttgtcttagttagtttgggctgtgtattagtctcttcttgcattgttataaagaaatacctgagactgggtaatttataaagaaaagaggtttaattggctcacagttttgcaggctgtacaggaagcatagctgaggaagcctcaggaaacttacaatcatggcagaaggtgaaagggaagctggcatgtcctacatagctggagtaggaggaagagagcaaaggggaaagtgctacacacttttaaacaaccagatcttgtgagaactcactcactgtcatgagaacagcaaggggcaagtctgtccccgtgatccaatccccttcccccaggcccctcctccaacactggggattacgattcaacacgagatttgggcggggacacaaatccgaaccatatcaggctgcaataacaaaatagtataaactggatggcttaagcaacagaaatctatttctcacagttttggaggctgagaagtgccacaatctggctgatgtagctcccagcggaccctcctcctggcttgcagaaagctgctttctctctgcattctcacatgacggaggaagtggggggtggggggagcggaggtagagagggagagagagagggagggagggaagaggagagacagagcaagagagcaagccgtctggtgtcttttcttgtaaggatgctaattccatcacgaagacctcatcctcatgatctcatctaaactaatagtcttccaaaaaagcccacctcctaataccaacataatggaagttaaggcttcaacatatcaattttgaggggacacagttcagtccattggacttagagttcacacttcctggacaagattttggaacgttgtaaagctttcttcagaaaaacaactagtttattttcccccaagcatttatagcccactttagcagcactcaactgcatgcctctgatctatatgctaattttggatccgccttatctcttaagtaatccaagagtttgtgtgtgtgtggatgctccttgatttgaaatccttatgtgcttagaactaatggcgttgtaaaacacactccacaatgtacccttctctaattcagcctgattttctcccatccctccacgttagccgggctcccatgcccctgtttttgatcacgattgattgtccagctccaaagcatcatctgaacgacttatggtctttctcccgagtgttggagcccagggtaggcagatgggagagggtaggggatttgaaccggagaaagacatttaaatttcctcctgttcatcttagcttaggaagttacctgctgtctgaagggtgtatccctattttattatttatttatttttacaaaaccaagggaaaccagcaacgaaacgcaagaggagctcctctgcctctgattccagtagctgtgctctcaggttggagcagccaacccagaaattggtggccagtggctagggtcaggatgagcagagtgaacgcgagttctatgtctgattataaaaactgtacttgctccttatggagaatttgaaatctagggaaattataaaaatgtaaagtgttatcagtcctttgtcagccattgggctggttggttggtcagaagtcatcactgttatagaccctcattgcttaatgaaaattaatttgtcaagcgatttccttgatgatgctaatatttattgaaaggttaccctaggctgagttctggctaacagctatatatatgtatacttttattttccaagtgaagaaacaggctcagagagggtaagaacttactcacagtcacacagcaactgagtggggcggctagaatttgggttcagatagtcagacgttagagttcaggtttttcatcccttcaacatctacacatttttcaagaaataacaagattcacttttggtttgaagaggagtgcatgggagagaaagaaaagtaccaaatgggaaaaagagagagcaaggaaaccaaactccgtttgtggtcgtgagctacattaaaaaaaaaaaaaaaaaaaaaaagccaggccagggacaatggctggattatgcctgtaatcctgccactttgggaggccaaggcaggaggatcacttgaggtcagaagtttgagaccagcctgggtaatatagcgagaccccatctctacaattcttttctttttcttttttttctttttttgaattagcaaggcgtgctggtgtgcacctgtagccacagctactggggaggctgaagcaggaggatcgcttgagcccaggagttcaaggctgcagtgagctatgatcccaccactgcactccagcctgagcaacagagtgagactctctctgaaaaaacaacaacaacaaaaacaaaaacaaagcaaagctggtggtttcacatgagtgttgctccttctggaaaggcatcactggagtgggtgccatattttgatgctgctgctgccaatgatgagaacatgggcaacctcttttgcctgtaattttttttttttttttgagacagtctcactctgtcacccaggctggagtgcagtagtgcattctcagctcactgcaacctccgcctcctgggttcaagcgattctcctgcctcagcctcccgagtagctgggattacagccgcctgcatccacacccagctaatttttgtatttttagtagagatgggattttgccatgttggtgaggctggtctcgaactcctgacctcgtgatccgcccgcctcggccttccaaagtgctgggattacaggcgtgagccaccgtgcccggccaagagagacttttctacactttgtaattatgttatttttaaactgaaaactatatttcctatttcttagtgttagaaagaaagagaaatccctgagaacaatcagcagcctggagcatagtttgagactcccactaacagagccaagagtctcaaactaggccaacagatacccttggggaaccctgctgtatccctgggacataaaaaactacagtacaaacatcatcatcttcctggaggatgaataaactttagtagagtaatagtaacttaaaacacatgtggcacaaaatagaacgcagagttcacaaatacctaaggtaaaataagacttcaaagaaaatttcacccttgcagaggttattttgggctacactccacagagtatgaattcattctcttttcctctcagggatagtttgttaagagtctgaaaaccactgctctgggcaaactgccctccggagtcacacacaaaaaatcaatctcgttactaaagataaattttatttcaataaaaattgtaatgagcttgatcacctacccttttcacctgacttggctacaaatgactgccaactgtttaaaaaaaaaaatccaaccgaccctcagagctaatatgctattacttttaaagattacagacaggccaggcgtggtggctcacgcctgtaatcccagcactctgggaggccaagttcctatttcttagtgttagaaagaaagagagagaaatccctcagaacaatcagcagcctggagcatagtttgagactcccactaacagagccaagagtctcaaactaggccaacaggcacccttggggaactctgctgaggctgaggcaggagaattcccggaacccgggaggcggaggttgcagtgagctgagatcgcgccattgcacttcagcctgggcagcgagagcgagactcggtctcaaaaaaataaaaaaataaaaaagcctctcttgtgtccttgtccccagccttccagctctcctctgagggaaccagttttcaagatggcccgcaacaatccctgcctgctgccattcacaccttgtttagtcccctcccacgctggaaagatccatgttggggctcgtgtgtgaccaatgccgcagaagtgatgttatgtcacttccgcgattacgtcatgaaagactgcagcttccattgttggctctttctttctctttcttggatcagtcgctttggaggaagccagctgccatgttttgaggacactaaggcactttacggagaggcccacgtggtgaggaattgaggtttctaagagccagtaaggaatagagacaaccacacagtgagcctggaagcctagtcttcagccccagaaacgctcagatgactgcagtcctggctgacatcttacctgcagcctcattggagaccctaagccagagcacttagctgagttggcttgtgggttccaaatccagacaattagatgataaatgcttgttgttttatatttagttttagtttttgtgactacatcgtaggtgtatatatttatgggttacgtgagatattataggcatgcaatgtgtaattatcacatcaggctaaatggggtatccatcatctcaagcgttttcctttgtgttacaatctaattattctcttttagttattctaaaatgtacgattaaattgtttttgattatagtcaccccattgtgctagcaaatagtaggtcttattcattctttttttttttttttttgagatggagtcttgctctgtcgcccaggctggagtgcagtggtgcgatcttggctcactgcaacctctgcctcccaggttccaggaattctcctgcctcagcctcctgggtagctgggactacaggcgcctgtcaccacgcccggctaacttttgtattttttagtagagacggggtttcaccatattgaccgggctggtctcgaagtcctgacctcgtgatccacccaccttggcctcccaaagtgttgggattacaggagtaagccaccgcgcccggccttattcattctttctaactatttttttgtactatcatggttcactgcagcctcattttgacctcctgggctcaaattgatcctcccaccccagcctcctgagtagctgggactgtatgcacatgccaccatacctaggtaatttttaaagattcttttatagagatggggtcttcttatgttgcccaggctcgtctcaaactcctgggctcaagtgatcctcccgcctctgcttcccaaagtgctgggataacaggcgtgagccactgcacccagtcgatggcgtgtattaaaaggaatgatgatataaatactgatgactaacatttattgagtgttttttccatgtcaggcattatatcaagcactttacatgcatatctcatcagtaaaacatttgcatttttatttcttatcactagtaaatccttctcctcccagaagcatttaaaaatccacaaaccatggctaacttcctgtgaaatggcttagtgggcaaaaattcagaataaggggagtgtgagtccatgtctcctttccagagatgaagaagtttctcttttctgtgcatgaagaagacaatgggatatggatgacactaaacctttgaaagttcctgctaacctccaggtggaaggaaagggcccacggtgatcaataaatgtgtttgctattttttgggtgaaaggaagagagcctgcacctctgttggggtaggttatccacgctgtctgcctggggtccagattcctggcattgatatgacttcttggctctcttgagccctgaatctgcttcaaattcagaaagccccaagacttctgggctctataattactctgggctttggagaatggtttctcttatgagcaaaacaatggtggaaacttgtaccaatgaaggaaacacacaagcgtgtagaggaacattgctgtttgctgatgatgctggtggctgcttgggtgagagataaactctccaaagagcgttggcccttttgtggctgcaggatctgggtgaaagagattcttgtagtctatcctatcactagatactatctgtcttagtccattttgtgctgctataacagaataccacagaccaggtaatttacaatgaatagaaatttacttgggtcacagtcctggaggctgggaagtccgaggttgagagcttacatctggtgaaggccttcttgctgcatcatggtgtgacccaaggcatcacatgggtgagagagagggtgagagagagcacctactcctgtgaaaaccagcccgctcccatgataaaggcattaatccattcagaaagatgatgtccccatgatccaaacacctcttgaaggcctcacctctcaacacggttgcatcagggattaagtttccagcacttgaactttggggaacacatgcaaaccatagcaatatctgtgccggatattttgtatttgctcctttacatccactgtccacccccatttcctgctttgtaccccaggaggctgacttctatggactacatcacatgtggtctcccatcctcttgtggctgcttgggtttggccaatggggtggggatcatagaatactagaaggtgggaggagagagggattcggatatttatttctgtggctccttcctgttgggttgccataggttggaagctcctgccaggcagctgtctttccctgaagactgtggctactctccttgggttccataactatttctcctccaggtctaggggtagaaatggctcctcactgctgctagttagggctactgcaacctccctttttgtttttgttttttttaatcccacttatacagctatatatagccctttgctaaactctttttagttaccccatttgagtttactatgtatttcctgccacaaccttgattgatacagcagcccagagaagggaagcaattaactttctcactcctttattcattcatccaacctcccatcaacacttactctatgccaggacttgtgctgaggcttttaagaatgagacatgatttcttgtctatgtccctgagttctcagttgttcaccccagaaactgactcttaccaaagaaagagaacatgccgaaggcattgctgaaggcccagccttggaaaacaccccatacaaggtgactccagatagctttatagcggcaactcctccaagggcatgcgttagggataggctgatctggggacccctgctctccctgcagagaattcatggaaacccaatagggcctgtgttcttgcatcatgagtcaaggtgccaagagagatcacctgattggctgatccagagtcacacggttgggggagggtatacaaagtggagggctcaccacagcggtcagagataaggctgctccttgcagctctgttttttgcaattcctcttggaccctccccagttcggccaccacccttgaggctagcaagggtgagttgtgtcagaagcattccatgcaaggaaataacaacttggaatccaaatatattcattagtaagtaatggaaacctgaaattgcttaaacaagatgggacattattctctcacattaaaaggaatttgggggtaggtgagtctagggttggtttattcagtagttcagttgtatcatcaaagacctgggctcttgccatctttgtgctctgacttacagagcaagggcttaattccagtcttttcctctaatgagcacaaaatgggtgccacagtgccttacatcacatcctaacacaataacgttcaatgtccaaaggtcagaggagaaaatgtgtcttccttgtgtccattgttgacagcaaggaggaaatttccatcaactctcattggtcacaatgggtcacgtgcctattcgaaagcaatcactagacagggggtcagtattactatgattagtttaggtcagtcaagattcactccttgaggctcagaagggcaacttctcctaaagcatgtgactgttcaatactttaaaaattggggttctcttagcaacggagaagagaggctctttttttgacaagcaatcgtagcatctatcaaagcataagaaaagcttgtgagtgatgaggttggagactgagaaggttccagaacatgacattctggtgaagtaggcaggacccaggaatctcaaaagtgacccaatgtcacagagtctgttggtggcagaggaattgaggcatctagaggcatctaggcagagtgattgaggcatctcactttctacgcagaaaaggaggcatttgctccacaaaagcctcctgctaattccagggacctttcgctgtagagacaactttatggcatcagtgacaactttggcctcattgtcctgacagagcctagaatggtgctatctttgggcttcatatctgtgaggcactcagaaatgtatgaagcatttccaagtccatggtctcatttgctctccactttgcagtggggaaactgaggttcagacaggtgaagagacccgatcaaggtcacatagctggagagcaggaaacactgagctcaaccccagatattttaaccaaaggttttagttctctgccttcctgccttctagataactccatacagtctgcagggtagatcctcaatcatgatgtatgaaaagcgtgaatgaatgcaaaaaaaaaaaaaaaaggtttaaaaaagctgtgcaagctgggcacagtggctcacacctgtaatctcagcaatttgggaggccaaggtgggagaatgtcttgaggccaggagtttgagactagcctgggcaacatagtgagactccttttctataaaaaatttaaaaattagctgggtatggtggtgtgcatctgtagtcccagctacttggaaggcctaggtgggaggatcacttgagcccaggagttcaagaccagcctgagcaacctagggagagcccgtctctacaaaaactaatataaattagcaaggtgtggaagtgcatttctgtaatcccatctacttgggaggctgaggtgggaggattgcttgggcacaggaggtcgaggctgcagtgagctgtgatcacacaactgcacttccagcctgggtgacagagtgagaccctgtctcaaaaaataaaaaagttgtgcaaagataaaaacccagttatgactcccattgtggacccataaataaagcaaagttatcaaatagagatgtgtgagctgctgaatggaacagaactcactgggtttatggggctgtgtcaggcacctctgacaatgccagatatttactttgcagatgaatgacttcattgcttgccccaaatgcatcactggtgggtaatatttatgcagattggaagcattctccctcctttatatggtcctgggctgtttgtaaccattggatttttttaccttttgacttgacgttgttcttcacgggaccgtggtatgggatgcatttcaataaacaataccaaaggacagatttcggctttaaataaaattgtgttccgtaaagtgggagacaaaggcttataactcactgtcggctgcagacattttggcaaaaattatctttcaggctttgatctccactgtatcattttactgagtggccccatgtgctctatcaatcaaacccactgaagatgcaggagaatcacatttaaaatcaaatacaaattgtagattcatctgcccaggaggaagagaaatgtgtcatgaatcctgccttcagtcttctatgattacaacggaattagtttttgaaaactccagaggatggttttccacttcccaactttcatattattattattatttttgaagggggtaacattagatgggtagagaggtagactaaagtgattcagctgtgagatcggagtctcgccttccatctaactgtaggttagggccttttaatattcctctgacagagattctttatgtaggaagggatgttaagaagaaagatgttctctaacaagaaaacatttagacaaagaggatatgacctccctcactcaatctcgcctgctttcttggcatacatgggaagagaggatgaactagaaaggaaatattatttgctgatctcctttctttgtctgaggcacattgcacaggatgtctcatttgatattcacatgcccatgtgaggtgaacaatccacaccatgctttacagaaggggaaactgaggtcaagaaacatgctcatgggccgggcgcggtggctcacacttgtaatcccagcactttgggaggctgaggtgggcggatcatgaggtacagcattcgagaccagcctggccaacatggtgaaaccctgtctctactaaaaatacaaacattaggccaggtgtggtggcatgcacctgtaatcccagttactcgggaagctgagacaggagaatcgaatgaacccggaaggcaggaggttgcagtgagctgagattgcaccattgcactccagcctgggcaaaaagagcgaaactccatctcaaaaaaaaaaaaaaaagaaagaaaaacaaatattagccgaacatcgtggcacgtgcctgtaatcccagctactcaggaagctgaggtaggagaatcgcttgacctcacgaggtggaggttgcagtcagccaagattgtgccactgcactccaacctgggtgacagagcaaggctctgtgtcaacaaaaaaaaaaaaaaaaaagaaaaagagaaaagaaacatgcttatggctgaagagctgagcccaagtctatgtgattctgaataacatgcttttaatttaattaattaattaatttacttatttatttatttgagacagggtctcactctgtctcccaggctgcagtgccattgcaccatcatggcttggctcactgcagccttgacctcctgggctcaagtgatcctcccacctcagcctcccaactacctgggactacaggcacacactgccatgctcaactaatttttttttttgtttttttgcattttttgaggagacggggtcttactatgttgcctaggctggtcttggactcctgcattcaattgaccctcctgccgcgacctcccaaagtactgggattataggctttagccactgtgcccagcctaaaacttttgagaaagaatgcttcttgttgattgtctcccctctctattaccttagtgtctggcatatagtaggtgcttgaaagcacttgtttagtgcctaagccaggggctgacaaccttactgtaaaggcccagatagtggattatttgaggctttgggggccatgtgctctcttgcaaccatgcaaccctgccgttgtagtgcaaaagcagccacagacaatactttatttataaactctgaaattggaatttcatataattgtcatgtaatgacgtattattccttttgtctttttcccactaactatttaaaatgtaagaactagctgggcgcagtggctcatgcctgtaatcccagtactttgggaggccgaggtgggcggatgacctgaggtcaggagttcgagaccagcctggacaacatggtaaagccctgtctctactaaaaatacaaaaattagctgggtgtggtggcaggtgcctgtaattccagctactcaggaggctgaggcagtagaatcgcttgaacctggcaggcagatgttgcagtgagctgagatggtgccactgcactccagcctgggcgacagagcgagactccatctcaaaataataataataataataataataataatataaaatgtaagaaccattctttcttagctttcaggccataggaaaacaggcagctcggatttggccttcaggctgtattttgcagattcctggtctaaataattaccttaattatcacagtagcagatactagcagatactaagaactagtgtatctccaaagtctagtttggtgcccggtacaaacattctttccccaaggtggagtccacttgaccagagtggagagttacagtgctggggaagagttggaagacatcgctgcctgggggtgggggaagggcagagaaatctcttggggtttgttctggggaaactgggaattgtgggagaactgaggaggcgggaaaggggactttaagaatattattgtgggccaggcgtggtggctcacgcctgtaatcccagcactttggaggctgaggcgggcagatcacgaggtcagtagatcgagaccatcctggctaacacagtgaaaccccgtctctactaaaaatacaaaaaagtagccggccatggtggcggatgcctgtagtcccagctactcgggaggctgaggcaggagaatggcgtgaacctgggaggcggagcttgcagtgagctgaggtcgcaccactgcactccagcccgggcgacagcgagactctgtctcaaaaaaaaaaaaaagagtattattgcaggttaggaattggaccttttattacagaggttctcactggggactgaattgtcccatgtgtgtgtgtttgtgtgtgtgtgtgtgtttgtgtgtgtgtgtgtgtgtctgtgtgtgtgtgtgtgtttgtgtgtgtgtgtttgtgtgtgtgtgtgtttgtgtgtgtgtgtgtgtgtgtgtttgtgtgtgtgtgttttaaatctgcagagagcttttggttgccctaatgatagggatgggggagtcattacggtgtggggtagttttttgaatatatatatgtgtagatcccaaattcatatgggttagaagaaccatgattatcagagtctataaccttgttctatttttttttttttttttgaaacagagtctcactctgtcacccaggctggagtgcagtggtgccatctcggctcactgcaacctctgcctccccggttccagcgattctcctgcctcagcctcccgagtagctgggactacaggcgggtactaccacgtccagctaatttttgtatttttagtagagacggagtttcaccctgttggccaggatggtcttgctctcttgatcttgtgatcggcccacctcggcctcccaaagtgctaggattacaggtgtgagccaccacgcccggtccaaccttcttctattttatctgcctattctattttatatgtttacatgttctattttacatgtaagtgttgaatgaacactgatgtttccaagaatgtagcagctatggtgtaaatcaagagaagatttgactctgtttggtatgggaatttatcaagaaagagccactcttttgaagaacatggcactctcagtaaagccgatgcgacaacacaccacgctgtctgcgtttgtgactgtcactggttattctacacacacgtgtgtgagcacttgactgcttcgctccgtctttcctggtggaaacccaaatcatttctctatatattatttcattagaaatcctcatcatttcatttctcctttttattataattagggcacaattgtgattggttagaagagtagatgggttataggatcagcacattttttttttttcagggtagaaaagagagcttttcagctgggcatggtggctcacgcctataatcccagcactttgggaggctgaggctggtggatcatttgaggtcaggagttcgagaccagcctggccaacatggtgaaaccctgtctctaccaaaaatacaaaaaaaacaatgtaccgggcatggtggcacgcatctgtaatcccagctactcgggaggctgaggcacgagaatcgcttgaactcaggaggtggaggttgcaatgagccaagatcccaccactgccctccagcctggactatagagtgagaccctgtctcaaaaaaaaaagagggcttttcaattggttggttaaaacatgggacattggatctgatggcaccaagaatgcctgccctgtaacactgtttgagctgatgtgtggggaactgcttttggattacttatgggttgctgaaatatacttctttgaatgcagagattgggcccctgattatatttgggaggcaaaaccatcaccttgtaggcacctggcagggtaaaataaatggatgcttcttagaggccaactgctctctcacttcctgtttccgttttgtttgcagcgtaaagccagatgccttttatctcttgtatcagtgctggttgtctgagaatttttttttttttttttggacagagtctcgctctgtcacccaggctggagtgcagtggcgcagtcttggctcaccgcaacctctgcctcttgggttcaagtgattctcctgcctcagcctcccaagtagctgggattacaggtgtccaccaccatgttcagctaatttttgtgtttttagtagagatgggatttcaccatgttggcctggctggtctcaaactcccgacctcaggtgattcacctgtcttggcctcccaaagagctgggattacaggtgtgcaccaccacacccagctaatttttgtatttttagtagagatgaggtttcaccatgttgtccaggctggtcttgaactcctgatctcaaatgatctgcctgcctcagcttcccaaagtgctgagattacaggcatgagccaccatgcctggcctgggcagagtttttaaaaatgcttcaaactctcctttagctcagtttcggtagagtcattcctttacagtatagttacagtggagctgccaatcagctcaggccacacccagcccacagtctcagaggggctgggtccctgctctttctctctccctgaaaagtggctgttaattttctcctttagtctcctttccccagaaagatatttccctttaccttatgggagtttgataaaactggcatctccagccttcttttccttatgttggtttttctgccacaaaaggcccagagacattgtctatggaacgtttggctgcagctgggcaggtgttttattctattggaaaattccactaggattttctatgattacaatagagcatgggtcctcagtcaaaccctccaccacttataagaagctctgtgactttggggaagtgacttaacctctctgagcctcactttttctatttggaaagagtgatgggttggtaggttttatgtgttaactcttagggatacagggtgcacagctatttgcctaaacatcattttgggtgtgttcgtgagggcgttttgggatgactgtcatttaaattggcagattgagggaagcagttgcccctcctaatgtgggtggacttcatccaatccacggaagacctgaatagagcaaaagtcggtcctttccgaagtaagagagaattcctcctgcctgaaggtttttaaactgcaccattggcttttttctgcctttgtactcagactgaaacactgctctttccgggtttcgagcctgctggccttaggactggaactaacaccatcagttctctggggtctccagtttgctgcctcgccctgcagatgacagcacttgttagcctccataattgcgtgaaatctctttctctgtttagacattggttctgtttctctggaaaaccccagtcaatacaggcggtgatcatattttgaggattaaatgatacaatgaatagaatatgcttaacacacagtgagtgcttggcacatatgatctcctcaatacacatcagctttatcatggaaattattatgtatcattatacaaaatataataagatttcaaacttgtgttctcttacatgtcctctaaattattcaatggaacaaaaaactcttcactcatttttgtgtgtatgcaaacttaatgtctttcaataaattttccaagttattgtatgttcgcaaggacataattctgtttgacttcccatctttccaatactagtagtgagcctcattagcacatgaatgctggtgtctgtgagatgtgcttgccttcactgtcctgtttgccttgcccaaggtgggcgatggaaaggacaagccatctattattggttggaggaaggaccaaccatctactgtggcagtctgctcaggctgccatacaaaataccacatactacgtggcttaaacaggagacatttattgttcactattctgggggctgggaattcgaagatcaaggtgctgggtgatttgtttctccagtgagggccctctttgtggctttcagttggaagccttcttgttgtatcctcacaggggagagagagagcacgcaagcatgagagagtgcaagagagagagggagagatcaagcaagagtgagagacagagaaagacatctctggtgtctcttctaatatggacacatcacatctccaggaccttaggcttatgatctcatctaaacataatcaccaaagccgcatcttcaaatacccaaataccgtaacactggtaattagggtgtcagcttcgacatatcagtttgggggtggaggcacaaacgttcatttcatagcacttccttttccaaaaatgctccttaatccctccctgccatccttgctattctcatttgacagatgaggaaattaagactccacgatgtgccttaggttgcccatagctgtacatcttataagtgcgagctccccagataattgcattcatccacaagagcagagttaaccacagcatcatagccatccagggagcataatgccccgttaaaaataacaaagcgtagagacccagcctgaactgaagatgtgtctgtggttggggttcagggttctttgatttccagatctaccacccagatatttgtcaagttacatctacctctggtgctcatttccatatctctaaaacagaaataataactgagaggattttgtggcgtcatgcagatgaagtggctctcaagagcctgacttagtaaacgttggctgcgtgttgggcattattagctaagatgtataaacagcagaggtttggtttgtatgagtagatcatattcctgcctgttgtcactgagggagagcagagtcctaaggggaggggacacaggtcaggagaattctagggggtgggggatgtttctgatttctcaacaatgggtaaatctgggaatctcatgagagcttcagtgggtaaatcttggaatctcgtgagcaaaatgtggacgtgaagaaggaagaaaagctgcttggaggattggtgaaggaggagggaaagggaaaaataaaaggaaaaaaacatttaggtggtgctaagtgccacacattttccgtttttgcatcagtgaattgtaaaatcacactgcaaggctggggatattatccccattttacagatgagagagaggaggctgggcaagttaatgaactggttcaaagtatcacagctagagagttggagccaaagtgagatcgcacagctacgcagactctaaagcccttgtctgtatattgaatcaaatttcccctttttctggcttaggtaaactgaggcaggaagtgatgagaaagggttaagagacgtcggctgctccttaaacatctcccttcccagtgtcatttgccatccataaactctttcaaaatgtgataatggttttgattttcctgtcatctcgatttgatatgagaaatttgggatttccaaattgacagaaaactcgattttaaagatgctggaaggcaaacatctgtgaaaaatcacaggaataatgtcaacatctgtccctgtgaaaggaaattgctgaggttctcaatttacagccaatcaatcaatcttggaggccagggtgcttgcaaattgaaatgcatgttgaagctatagggatggctaattaatttagtttgtatgcctataagatttttcattgtttccagttaaaaaaaaattctcttttgaatagaaaacgtgtgcatatggtaaaaaaaaaaaaaaaattaaacagtaccagaaaaagtatacagtgaaaattaagtttgttttccatcccaaccaccagttcttcttctccaaggtcacaagtgttgctggcttctcttgaaagtttccagagatacaatctttatatagaaaaacatatgtatatatgtctcctcccggttttataaatgatagcccattgtacatattacactgcatcttgacttcattcaacaatatatctttgaggtttttgcatagcagtccatatagacattccttattctttttatcagctgtgtagtattccagtatacggatgtgtataaattaatcagttccctcatggtggacattcaggatattttctgtcattctccacaatttatgctagtatgtccatcttggtgtgtgttcatcagtaggatacaaatctagaggtgagcctcctgggcagatgggatgtgcatttaaagtatgatgccttcatgtaaagggaaggttttcttttcttttttcttattttattaagagacgggggtctcacgatgttgcccaggctggtcttgaactcctgggctctagcaatcctcctgcctcagccttccaaaatgctgggattacagacgtgggccaccgtgcctggccaggttttctttgttatcttggagggagcatcacccccgtcaaggagatcagattggtgaaggtgggatgctgtgtctgagagcttaatgactgttcacagatattgtggctgcccttctctaatgtacctgcttcttcaggcccaaaaggtggaaatgatgtttgtttcttacttctttggggctttgactgtgccattgagattttgtgctcagggataaactaccgtgtatttacagttacctcaacctgtgaggtttgatgcctctttctttctttctttctttctttctttctttctttctttctttctttctttctttctttctttctttttctttctgtctctttctttctttctttctttctttctttctttctttctttctttctttcttccttccttcctttctttctttcttctttcttttttccttcttctttctctttctttcctctttctctctctctttccctccctcccttccttccttcctccatccctcccttcctttcttgctttttttttttcttgctttgttacccaggctggagtgcagtggcatgatcatagctcactgcagccttgaacttctgggctcaagcaatcttcctgccttggccaccctgggattacaggtgtgaaccgtggcgcccagccttggccactttctttattctaaacttctttgttccatactttgcttcttttccctggatccatccccaccagcctcccttgtcactccagtgataggacactcagtcttgccaagtcaatgtaaacccagacccttctcatttaaaacctagtctctttggtaaacagtcaattcaggattctcacatcaatctgagttttaaatcttaattagttgaaagattttcatatctttatctttccactttggtcactggcttcgctgtgggtgctgcaccactcagacctctgtgcaggaccaccgaggccctctgtccccccagctgctgggagacctggctgctaacagctcatagcaaagtcctgcctctggcaagaaggcacctgtaggaagccacctagtgctgggaaatcctcctcccctcctaggcatcccataatcctggagggttacaaaggctctgtcccttgcccctctgtatgggagtgtattagtcagcgttctctagagggacagaactaatagtatagatgtatataaaaagcagagtttattaaggagtattgactcacacgatcaccaggtgaggtctcacaataggccatctccaagctgaggagcaaggaagccagtccaaatcccaaagcctcaaaagtagggacgctaacagtgcagccttcagtctgtggtcaaaggtccaagagtcccaaagctgaagaactcagagtccgacgttcgagggcaggaagcatccagcacgagagaaagatgaaggctggaagactcagccagtcaagcccttccatgctgctctgcctgcttatattctagctatgctggcagctgattagatggtgcccacccagattgagggtgggtctgcttttcctagtccactgactcaaatattaatcttttttggcaacaccctcacagacacatccagaaacaatactttgtatccttcaatccaattaagttgacactcagtattaaccatcacagggggtgtctcaggggtcctggcgactgttccacagtgccactcccctctctgcccaatgctgcttccttgctttccagcaggtgctcctcccagtaaaccccctgcacccagatctccatcccacagcttgtctctctagaaacctgacctatgacaggcttataaacaccacaacagggcatgggtatgggccaggagagctactcctctcatctgctgagggtcctaccccaggacccctggggagggatgaggtccctgttgttcatctgggtgatcatctaactcctgatgagcccaggagttagagaccggcctgggcaacgaagtgagaccccatctctccaaaaaaaaaaaaaaaagtcaaaaaattagccagatgtggtgcatgcccccagctacttgggaggctgagatgggaggatagcattagcccgggaggttgaggctgcagtgagctatgattgcaccactgctcttcatcctgggtggcagactgagaccctgtctcaaaaaagttgtcatggtcctatgacatttttttaggtcctatgcaggggtgcaggtggaggtggtttctggttctacctgactgtcttcgttcagcctggtccatttgttgactctgctacccagaagtgaaagaatatggcatctttctcatctctatatggtccccatgcagtaaggagttgactcagccggtctggggagttcaaatcctgcacattccaaagaaagctctggccgttgattggctcctgggagataaccgccaagtctttggaacattctgcctgataagagtgtctttgtttacctatggcctcaggctgagctagctagtccatgctaacaatgcaatttatggtgagtgcctgtttttgtatgtgtcagtttgacctctagaggggctggagactgagtaacaaaagtcacccatgcaggtgctccatgcctgggtgatgaaatgctgataaaacccctggacaccaaggcttgggggagctgctgtggctggcagtactttgtatacattgctaattgtctcttatagcttggctgtgtccccacccaaatctcatcttgaattgtagcccccacaattcctacgtgttgtgagagggacccagtgggaagtaattgaatcacaggagtggtttcccccatactgttttcatggcagtgaataagtctcacaagatctgatggttttataaggagaacccctttcacttggctctcattctctctttgccagccgccatgtaagacatccctttgctctcccttgctcttctgccatgattgtgaggcctccctagacacgtggaactgcgagtccattaaacctctttttttttttcataaattacccagtctcgggtgtgtctttatcagcagcatgaaaacagactaatacagagcattaggagctatccttctaactccactgggagaaaactactggaaacttacccctggtctctcttggagagacctatgcatcttgtaccttggttgattttaatctgtatccttttagtgcaataaacaatgttcatggggacaatggctttcctgattctgtgggtccttctggcaaatcaatgggcctgagggtggtcttggagatccctgacaaaagtcactgtagccagggaccatcttctgttgagcttatttcagaggaagatgtcataggtaacgggcgttgggggcaccctggttccatttgttgactctgctacccagaagtgaaagaatgtcgcatctttctcatctctgtatggtcccctgcagtaaagagttgactcaggaggtctggggagttcaaatcctgcacattcctaagaaaggtctggcccttcactggctcctggaagataaccactaagtctttgcagcattgtgcctgataagggtgtctttatttgcctttgttctagttcttgttctaggtgctggtgatagaactgtgaaccaaaggtcattgccttcaaggagtttatattcaagtggagaagatggaaaaccctcccctcacaaacaaacagactctgaaacctgataaataaatattagcattcagtgaagtgttaatgagtttctgtgagcacatacaatccttagcagagtttatctcatcctgcctgagctagcccctgcctccctccccagcccacatattttgccacacccttttcattcctcccaacattccaattccttcaacacatggaactccttctcaccccagggcctttgcacatgttactatctctgtataaatgcattcctctcacttgacacctggataactcctcattgtcctagtcttagcttaaatgtcatcatctggccaggcctgatggctgacacctgtaatcccagcactttgggaggcggaggtgggaggttcgcttgagcccaggagttacagaccagcctgggcaatgaagtgagaccccatctctaccaaaagaaaaaaaaaatcaaaaaattagctgcatgtggtgctgcatgcctgtagtcccagctacttaggatgttgaggtgggaggatcatgtgagcctggaaggtcgaggctgcagtgaactgtaattgcaccattgcacctcatcctgggtgacagagtgagactgtctcaaaaaaaaaaaaaattcatgaccttggggaagcccagttggatactctcctctttccccagaccagctggatctaccatcataggctgttatagcatgcatccaattctctctctctttctctcgctccttttttttttttttttttgtagagatgcagtctcactatattgccagggctggtcttgaattcctgggctcaagcaatcctcccacctcggcctcctaaagtgctgggattacaggtgtgagccaccatgcctggcctgttacctttcatttttatttcagtcatcattctgagtggctgagcatatggatgtgttgattgttgaaataaatcatttaggcaaattgttacgggccccatctaaattcagaatccagccatggatctggtctgtaattcttcccagccacactcttccctgttggagtccgagttctccactctagacctgcagcgggaagctttccagggaccagccagttccaccgcctccagagccacccctcacctgctgacctcttcctatgttagctgcccctctcgctgcctgctgcccttccccgggccagctgatacgagagctggcgataacttgaaatgctccccgcagaagataaatgagaggggaatctcagcaggcattgagctctgtacctaacgactggcagttggggcttctaattttaggcctgggaaggaagctgatttctgtgatgaaggtggccacacgctttatcaagggccaatttagcaaaaatctaaaatgtatatgaagccgtggtaagtctggattttcttggtatttatgctgggaggttacttaatgagcgtttgctgtgtgaccacattgcggtattaatcataggtggcattataattctctaaaataacagccataaggcatcagggcaattgaggcttgtattaagggaatggtccttttttttcttgctgaagttaggcagcatgaggctggtgtgtttttccttaaggcaccaaggcatctgaggttttgcactgggaatccctgggctctctgggccctctgggtccctagggtcttctacttgccaacacagccttgggttctctgcttcctgttggggtgacaggaacacattggtggtctctgatggatataccaggcgctctgcataatttttcttcttgcttccgggggtaactccagccccatcccttgaaggtgaattttatgttatatatatatttttttgcttaggcaagtttgatttgggttatattttcatcataaagaatcatgactattgcaaatcattatatagaaaagtgattttattcttgagcctgagatattcacagtgaaaatgacaacacattatttctgagacacctgctgggggcatccaccactttcccccaacccattctctctattcacctccaaccaattttatccaaaagccagctcagctgactgtacaaccacaagggatttggagttagatggatatggcatttatcagctgaatgatcttgggcataatactcaaaccttctgtgcctctgttttctcatctttaaacggggatagcacagggttggtgtgaggaataaatgagttattattgtcatagtaatatactaacatatagttaaatataattctatctgtcagatgtagacaggggtggagaatgccttggaagtcatttcttcctacagaataagtgatatggttttgctgtgtccccacccaaatctcatcttgaattctagctcccataattcccatgtgtcatgggagggacccagtgggagataattgaatcatgggggcagttcccccatactgttctcatggtagtaaataagtctgataagagctgatggttttataaggggtttccccttctgcttggctctcattctctcttgcctgctgccatgtaagatgtgccttttgtcttccgctatgactgtaaggcttccccagccatgtggaactgtgaatccattaaacctatttttccttataaattactcagtctggggtgtgggggtatgtctttatcagcgtgtgaaaatggtaccataaggaagtaccttaaggttagacaataagtacaataaggaaggaggaccgcaatccagtcttgtctcccagagccttggcacagaaagatggtaaccaatgctttgtcttggaaaatccctcctacctgctggggagacaaaggagcaaatccagcagaagatggaggggaagtgctggttgagttgcttggcaccccttgccttttttcaccctcttcctcagctccctgatcaccatactctccctgtgtcttttggctcctgagatcagttgttgatgaaatgctgggctgcgctcactcccagagtgggaggaaatggatgtgggaaccctcttggggagatgggcagttaccggggcccagagaaccaatgagggctttatcctgcagtcagagttcaacaccagcccttcccagaatcaatcacaccctcctttccactatttcactgtctgccgtgaactaacagacattggttgtgttgccctcagattcataggctgaagtctaacccccaatgtgatggtatcaggaggtgaggcctttggaaagtaatgagatcatgagggtggagccctcatgaataggattagtgcccttgtaagaagagatatgagagagatgatacccgtctctccaccacatgaggacacagtgagaaggcagccatctgcaagccaggagagagtcctcaccagaccctgaccatgccagcaccctgatctcagacttcccagcctccagaactgtgagaaataaattgctgttgtttaagcttcacagtctattataatttgttatagcagctcaagctaactaagacactaccctgacactctatttcagaaatgacaaggtttgggctgggtgtggtggctcattcctgtaatcccagcactttgggaggccaaggtgggtggatcacctgaggccaggagttcaagaccagcctggccaacatggtgaaaccctgtctttactaaaaatataaaaattagcaaggtgtggtggtgcacacctgtaatcccagtactctggaggttgaggcaggagaatcacttgaaccttggagacggaagttgcagtgagccgagatcataccacttgtactccagcctgggtgacagagtgagactgtctcaaaaaaaaaaaaaaaaaaaaaaagatgagatttgacttcacaaactaaaacttttgttcagagagaagaggaaaagggagggtgggggaaaccacccatgctcccaaagatatgagacgtagaattgatctaagtgccacaaagcagaatttttctgactccattctgtttctcctgtgataattcagctgctttcaaattcctctcctctcagacggtcctgagaatccagtgggagttttctctgtgctccagaacatagtggcctcttgcattcattccctaccagaaataatgtctcattcaccagctattttctcagccaataatttttgtccacccccattcctccttcagaaacttgcccttcccagagccctaggagacccagaaccccataggattcttttggctctggccatggctgtgtaccaaggggttggatatgggattacagccaggccatgtggactctctcccagaaatttggagttgaaaatctctgagcttatctctggaaggtgcttgaaactagagggggatagaaagttggtgacaatatagtcatgtttggcctgtggacaattgcaatagaaaaaactgatatgcagggtgatatggtttggctgtgtccccacctaaatctcaaattgtagctcccataatttccacatgtcatcggagggacatggtgggaggtaattgaatcgtggggcgggtttttcccatgctgttctcgtgatagtgaataggtctcacgagatctgatggctttaaaaaggggagttcccctgcacacactctcttgcctgccaccatgtaagacatgactttgctcctcattcgtcttctgccataattgtgagatctccaaagccatgtggaactgggagtccgtgaccactctttttctttataaattactcagtcttgggtatgtctttattagcattgtgaaaacagactaatacatgggggggcggagagagagagagggagagagggagatggggagcgagaagatgggggagagagagtgagagagagagacagagagaaagaaagaagagattgagaacacaatacagacttaggaaggacagaccgggagctcccagaaagacagagacaggctgtgttgactcctgctatctttctatcccaaaaccctgctgtgctttctgactttggttttgtgggatgctttatttaataggttgaactgtgttctccaaagagatatgttgaaagccctaacatctcagtaccccagaatgtgacctctgttggaaacagggtcattgcagatgtaattacgaagatgtgatactggagtagggtgggcccttaatctaatacgagattgtccttagaagaagtaggaaatttggacacagacccacagggaagacccccttgtgacaatggggatagcgattgaagttccattttaatgtacgtgctgccgaagcgagcacaaggtagagattgaagtgaagctgctacaagcccaggaatgcctatggttaccagaagccaggaaaggaaaggatgggatcttccccagaggctcggggtacagctttgtgaaccccttgattttggacttcttccctcaagaattgtgagagaataaatttctcttgtttcaagccacctcgtttgtgctgttttgttaatcatccttaggaaatcaatatgccccttatccttcttgaatgagctctgtaccttataatgagattattgcagtctaaaaatctagaactagttgcaggaacatcacagacaagggaaagtttgaaccacaccatggatgagtgacaagcttggaaaagaagggcacttcacctctgtggtattctttgcaaaaactcatgacctgagtctaatcatgaaaaaagaaaaaaatcagacaaactcaaatggaggctaatacggtttggctctgtgttccaaatctcatcttgtggctcccataattcccacgtgttgtgggagggacctggtgggagatgattgaatcatggggacaggtttttcccgtgctgttctcgtgatagtgaattagtcttatgagatctgatggtttttaaaaatgggaatttccctgcacaagctctttttgcctgctgccatccacatcagatgtgacttgctcctccttgccttccaccatatttgtgaggcctccacagccacgtggaactgtaagtccaataaacctgttcttttgtaaattgcccagtctcaggtatgtctttatcagcagcatgaaaatggactaatacagagatatatcctgcaaaatccgtccccagtactcctgaaaactgccaagctctgtagagttagagttagaataccttttgttgttgaagatgtgagggaagtatgcatgtgaattgactgctgaattcactttttttttttttgagacggagtctcgctctgtcgcccaggctggagtgcagtggcgggatctcggcgcactgcaagctccgcctccccggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctgaattcacttttgtgccatttttgtaaatacaatagttttgtacaaccttagaaaaataaggaaaggctgaagaagctacacatttggttggtgtggtttctaatgtagttttattttacattaaaaggtttagacaatgggtcctcatggcagttgctggtgacttaccttgtagttgtaaagctgggttcttgttttctttttcttttaaatgaaattataataataataataataataataataattattattattattattattattattttgagacagcctcttgttctgttacccgggctggagtgcagtggtaagtcgtagctcactgcagcctttaactcctagattcaagggatcatcccatctcagcctgccaagtagctgggaccacaggcagatgccttcacgcctggctaatttttaaattgttggtagagatgaggtttctgtatgttgcccaggctggtctctaactcctgtgctcaatcgatcctcctgcctcagcctcccaaattgctgggatgataggtgtgagccactgcacctggctgaggccttgttttcttgctggctgtcagctggggacctctatcagcttctagaggccacctgcattctttgacatggccctgtcacaacatggtagcttacttcctcctagccagcaagggagtccctaagtctcctaaggggaaatcttatttggtgaaatatgatcaagggagtgacatttggcacctttgccatattctgttgattagaagcaggtcacaagttccatcctctctcaggcggggaggcttgtacaagggagtcaccttagctgtgtgcaatcaggaatacagcccaggggccgtgcctgacagttaagaggactcagtgtgatcaagctgatcaatatgaagtgggttaggcagctgccagtgctaaattctgtttgggagttttccaagaaccagccctacccatgagtatctctctgggtaaacctcctgcaacttgggagtcaccttagctgtgagaaccgtttttcgatcttaccagcaaaaatgacagcccagggtattccaggcagctgcttctccagctccaggcagatgattttggccctgccttgcaacagaaatggaatcgtttcgaggggatggtctcctcgctctggatccagcagcagcagatgctccagccgaagacgtgtgtccactctgagcaaggttgagagaatcaaattaatttcttttatgacccgaggcaagcttgaaattggctcttccaagatgaaaaaggagaggcaggagtggcttgcctggctccctactctccttctcctcctgcctccacctccttcccagcagggctccagcaatttaatcggggtgggattccttccaccaagcaaggcagtctgtcacgcgccgctgcagtaggggccatgccagagacagcttttcgaagcggcatctgtgggcagacatttgggcaaccccactaggctggcaagccctggtcgatttttagtgacctcttagaagtagatgggagggactgtcagccatgccggaagtgggagagagcagaaggggtcaaagacaagcctcggctgggaagagcatctctgtggtcctgtaattgatgattggggtggggagcattgaaacgtttcccttgaatcacagccttcagtgagaatggctttgcctgctgtttggacggtgtgttgagagtagggtaaccatatgtcctcatttgctgcaacagtccctgttacgactgctttcctggttttgcctgtctcgaaagcattctggtttgggcgataacttataaggtcatcctaattctgggtttcacagtctcagcactgtggacattttgggctagataatcctttgggtgagggttgtcctgtgcactgtaaggtgtgtagcagcatccctaggctctgcccactagatgccagtagcacaaccccctgccccattgtcattgccaaatgtcccctgaggggaggaggaggaatcacccctggatgagaaccatggcccttttttaagggcactgttgaatccttccttctgataccatctgggggtaacttgagtacttggttcatgttctggaaggaaaaactccacatagtgcttctgggttcatttagcccatgtaagcttcgtttttctgtttcttagaccagtatctcactttttgcagggagaggtgggacctctcctccattctcagcccatgtgttttgggtgactcgagagactgggtttggcagatgggagaatgccattctcctggctgttgtgattgattcagaaacctgcctttaaggtggttcaaagagcatcagtggcaggacttctgttaggtggatagggaaagaggggttctctttttgctggggttgcaaacctggtagggtggaaaccgggagctgctggtggtcatctcatcaccctgggggagagcctgcctgagaaggaaatcacaggagagccgagctgagagaggagaaggaaagccgatcacactgtctaacagcctgtatcccctccaacctgatgacagatctcacctagagtgaatttctcagtgaagccagtttgacttgagtttctgtcaacttgcaactcaaaaaggccatgtgttgccatgaggtatttctctgttccctttcctaatctagagattaggtaactttaattctgctaatgctgagttttgtctcatcaaatggaaacatcacagaagtctctgatcttgccccatcaacccttcccattacctctagggctcagccaatgctgctggtatcttttgcttcattttttcttttcttttcttttgtttctttctttcttttttttttttctgaggcagggacttgctctgtcacccaggctgaagtgcagtggtgtgatcacggcttactgcagcctcaacctcctgggctcaagtgatcctcccacctcagcctcctgagcataggtgcacaccaccatgcctggctagttttttaaattttgtttgtagagaggggagtcttactcaatcattcaggctggtctcaaactcctgggctccagcaatcctcccaccttgatctcccgaagtgttaggattacaggtgtgagccactgcatctggctgcctcatttttcttaatctttcaagactctgtagaaataatacctactccttttcattcctccttatctcctgtcttcctttccaacactatagccctcttttcattattacccacatttacaaaaggtctttgtaacttaatggcatacccagacagaaataatgttctctgggttaattatctagtttgccacaatctcctgtaccagattctacccagcctgctctgattataaaggggactattgagaaatagctgcaaaaatgcacaaaaccataagaattcccattctaagacccagagcagatggcttttggattattcccttctctttttctatcatatgtttacataattgagttcatcatctatatgaagtcttacatacatatatttttataaagatataaaattatacaatcaccccaattaaaaggcatgaacattattttaataattggaagaagatttcattgtacgaacatagtgtaatttcagaaacatttttctgttggttgacacttcattttttaccatttgcaataatgtgatggcttccttgggcatacatctttgtcctcaactggatgtactcccctaaaataaatttctaggagtggaccttctgggtcaaaatgggtgagtatttgtaaggctcttgatacatattgccaaatgaccttccagaaaaattgtgcctgtttacatgcctaccagtggcatggaagggtcagatgtcagaatcatgattgcaattattgataaagatccagctagttccagttttgccaacaatattaacaccaccagcacatccaccaataataataataacaataatggtatgataaataaaataggtgatatggtttggctgtgtgtctccacccaaatctcatcttgaattataatcaccaggtgtcgcgtcgagggagggagctgtaagccccacgtgtcgaaggagggatgtgattggctcatgggggtggcttctcccatgctggtctcatgatagtgagtgagttctcatgagatctgatggttttaaatgtggcagttttttcccgtgctctcacttctccctcctatcgccttgtgaagatgtctgcttctccttctgtcatgattgtaagtttcctgaggcctccccagccatgcagacctgttgtgagtcaattaaaccccttttctttatcaattacccattcttggccagttgtttatagcagtgtgaggatggactaatacaatagacttattgggagcttgtaatattctagctatgttactaaaaatttcacacattatttcatttagtccatccagtaacctagagattaggtattattataattcccccatttacaaaataggataataaggtacaaagacgttaagcatcttgcctaatgaccacagccagtaaatggtggatcttagatttgatgccaggcatctgacttcttcaagcattgtttactgttttagtatgacggagatgactagttggatgtaattccacctgaatggctagctttactgtgtacagatcaccaaagatctaccttgaggaaaaacattgctatacattgcaaataatagtcagggctctggtattaatgtttcccagtctctccctcctaaggacattgtcaccctcccagacaggtgtgtggtagaaggaaacgactctctcctgatgctatgaattccaaagaattcccattaaccatatttctaagccagtttgctttctttcaatgtgcactttctgcaaaatgccatctgcacttgtttcctggggaaaccatctctctgaggtgggtaagttctcattgtgaagatggggacttgcctaatgtttggcattccctttttggggcacgtacagtgatttctgaactgacttgaaaggccattaacttggtttttactgccttttctggcttgcaaatttaatgcctggctcccaacatgtgtgaatggacaaacagcatcagcatcatctgggaacttgctagaaataaaaattctcaggctttaccctagacttacagaaccagcaactctgagggtaggttccagaagtctgtgagtttacaaatcttccaggtgattctgatccgtgctaaagttggatctactgctctaaaccttagtttcttcctttataaaataatagtagtagtagctgtagcagtaataataatattggcttcatggttatagggggaattccatgagtaatttgagtccttggcactgtgcttggcatacagtaggtgcttaataagtggtagttggcatcactatctctgaactgtgaaggtcgctgtgcttaacctatgtagtatttatcagccccgcatcccactccgttcagggatggcccttctcctgcctgtgggtctggtgggaccactctgcagaatttcttatgcccagatcttctatcatggtgtgacaaaagcatggcccatcaaatgcctgccttctgggaatttgcatcttaaggagagatcatcaaggatgtagagtgattagagtccggtcattccacgaccctgcagcctagtgcttctcaacctttaatctgcttaacgctaactggaggatcttgttcgagggcagattctgactcgaaaggtctggggtggttctgagagagagtctgcatttctgacgagctctactggagatggtgatgccagtactgctggtttctggactcacggtgcagttgcatcccgagagtagtgaatctcatttttcaacctcaccttagaatcacctaggggaggtgtgaaacaagacagacctgagccagttaaatctcagtttctttcctttttgccttgccttgctctgccttgccctgccttgccctgccagggtctcactctgtcatctaggctggagtgcagtggtacaatctcggctcactgcaatctccacctcctgggctcaagctatccttttgcctcagtctcctgagtagctgggactacaggcatgcgccaccacatccagctaatttttgtatttttagtagagacgaggtttcgccatgtttcccaggctggtcttgaactcccgggctcaagtgatctgcctgccttggcctcccacagtgttggaattacaggcataagccaccatgcccggcttaaatctcaatttctgagggtgagggcccagcatcagtggtttctaaaagtctctttggttgactgttggctgcagtgagggttgagatccaccaccatacaaagatggtccaactggaaccccctcaagtctgggaactctattctttctctgatcctgtaagctccccgctttttaatgtaaagatttggttctgttggctgggcatggtggctcacgcctgtaatcccagcactttgggaggccaaggtgggcagatcacgaggtcaggagtttgagaccagcctggccaatatggtgaaactccgtctctactaaaaatacaaaaattagctgggcatggtggcgtgtgcctgtactcccagctactcaggaggctgagggagaagaatcgcttgaacccaagaggcagagcttgcagtgagccgagatcgtgcactacactccagcctgggcgacagagtgagactttgtctcaaaaaaaaaaaaaaaaaaaaaagatttggttctgttgcttgaaaactaagaaccttaactgatagagcctcagaaatgagaagagagtcaaggtgagtgttcattgcctctgggctctccagctgcagatcctcttgcttctctgtgcttctctttgggatgacaccacagagacattaaaccttttggagggcccgtacagtaatttctgaaccaacttgaaaagccataaacttggtttttcctgccttttctggcttgcaaatttaatgcctggctcccaacatgtgtgaatggacaaataaaagaggaactgtcccttcctctctttgcccccatcaagggccacctgagagactgtatctctttaggatcgcttagctctttcctcagtcccaggtctggattttgcgggtgacagcttcaccagtatgtgacaagccatgccaggtgaccagagtgtgaaccagcctgctcacctgtcaggtggtggtaatgaaaaccgatggacctggtgcggtggctcaacacctgtaatcctaacactttgggagtctgaggtgggaggatcacgaggtcaggagttcaagaccagcctggccaatgtggtgagggcctgaagtagtgggaacagagggtgactgaggcagagtcagccttaaaagatcagtcgctaaaaaggacttcaactgcctgcctttggggagagggatttgatgggagaagggctggggtaagacagctttgttttccatttcaagtcatttgtatcatttgcttgtactgctttgataaagagaaatctgaaattctagaaaaaattagaagtgaaaaaaaattcctttatagccatgagcagaaccgttaacaatagcagccgggtatggtggctcacgcctgtaatctcagcactttgggaggccgaggtgggtggatcacctgaggtcaggagttcaaggccagcctggccaacatggcaaaaccccgtctctactaaaaatacaaaaattgccaggcgtggtggtgggtgcctgtaatgccagctactcaggagactgagtatggagaaacacttgaatccaggaggcggaggttgcagtgagccgagagcgctccattgtactccagcctgggtgacaggagtgaaactctatctctaaacaaacaaacaaaaagcaatagcaatagcaacagtaatgacactaacttatattgatgtgctagattttatccatgtcacctcattcacctttagttctcactacaaccttgggtgacaaacttgtgttggctttagcactttactggatttgacactgagcgttccctatacctggaaccacttcggtcctagataaaccaaagaggatggctggtcaccctactacagccccagaggcagctgctattaaccaatgcatgctgcaggggaggaaactgagaccctgagaacttctgtaactcgcatcatggtcacacagctagttagtggtagaaacaagttacataccgactcggtggtggacacaattaagggtcccacagtcagttagttgtagaaacagttaagagtcacacagctagtcagtggttgacatagttaagggttgtgcagctagtcagtggtagatactgttagttaagggtcacataggtagtcagtggtggacacagttaagggtcacacagttagtgatagatttaagggttacacagctagttagtggtagatacagttagttaagggttacacagctagttagtggtagacacagttaagggtcacacagctagtcaatggtagacagttaaaagacacatggatagtttaagacacatggatagtttagtggtagatacagttagttaagggccacacatctagtcagaggcaggtatatttagttaaaggtcacaaagctagtcagtggtaggtacagctagttaagggtcacaaagctagtcagtggtaggtacagttagttaggggttacacagctagtcagtggcagacagttaagggtcacaagactagtcaatggtagacaattaaaagacacatggatagtttagtggttgatacagttagtgaagggtcacacggctagtcagtggtaggtacagttagttaagggtcacacggctagtcagtggtaggtgtagttagttaagggtcacaccgctagtcagtggtaggtatagttagttaagggtcacacggctagtcagtggtaggtacagttagttaagggtcacacagctagtcagtggtaggtacagttggtgagccatctcatcactcgtttagtagtagagcttggattggaaccaggtagggctgtgtctgttacattacatcacgtcacatggagtctcagagctgaaaggactttagggtcgccgtgtctattccccttgtttgtagatggggaaacttgcctgagtggcggaacgccctacccaaggtcgcatggtgagttttgggcttctaagagaccactggaggaagtcagggagacatgccctggcagggacccgtccggaggcctgccaattggctttgagaggagcgcgtcttgcatctcccaggaaggattggcagagggagggcgggcgtctcgggccgggggctggtgcccggggctggggctgaggggagggggaggctgcttctctttgtaatttacatacacagcagcaacagcctgggggaaaacaacccaaacaaactctcaaaggatgttttggacttaatcccgggatcggaagcagctcggtaagataaataagataaagttggtgtgcctcttaaggttgaacgatcatatcactattgcatttgaaatattcatgaggggaagggaggtatgagaaacagctacagaaacatattctgctttgaaaaggcagaattcaaaggcatgaaaaatgaatcaggggaaattaatgtcgaggttgggaggggggtgggctggtggggggacaattattgcccagaaggaataaggaaagagatgtggaggagatgtttcagactgggccgtgatcagaattctgtatcctgcctggaatatttgaaatgtcaattgtctcatatatcatttgaagtcaatacttggtcgcaaaatggatgattctagcaaggattaaaaagcagggtgggctgggggatatgggatggggagggtggagtggggtggggcagggagatggaaaaagatgggtaaagtgaactaagtcctataaattgtggacgaattactgatcactcaaagagggctctggaggagtaagatgcaaagaaacgggaatttcttgtgatttcttgcaagtctctcggtcttggtttctccctttataaagccaggaggttgggctggatgttctcctagatggtcccactttgccttgtggagggggtggggctctgatttggagatgtgcttggaaatagagggttccttaaggcaagagggtcaagggtattgacgaacggtagcaatacagacatgatgcttgtggttaatggtggctctcagcagagccctgcaagtctacaccgtgttaggggggccagtggggtttggccccatttaaaagcaagcccttggactgtggactggcgcggtcattctagagagatctgacactaaagcaaatgaaggctgcatattctctgtggtcccagaccagcagcatcagcatcacctgggagcttgttagaaatggaaattctcgagtctccttccagacttcttgagtcaaaatctgccttttaacaagatccctgggtgagtcctgtgcatattaaagactgagcagcagcaattcccctcctggatttataccccagagaaagtttcacccaaggatgttcaaggaggtgggtttgtggtagcggggtattggaagccactgctgtgcgcatcagaaggggatagataagcaaagcatgacagatactcactgtgggatatgactgtggtagttagaaaaacaggtctgatcttcacatgccagtatggacggatcttttattttatttatttatttatttatttatttattttgagatggagtctcactctgttgcccaggctggggtgcaatggtgcaatcttggctcactgcaacctccgcctcctgggttccagcaattctgcctcagcctcccgagtagctgggattacaggcgcccgccaccatacctggctaatgttgtatttttagtagagacagggtttcaccatactagccaggctggtctcgaactcctgaccacaggtgatcctcccaccgcagcctcccaaagtgctgggattacatgcgtgagccactgtgcctggcctggatggatcttaaaaacaaagcacaaggggaaaaaaagtgagcaatagaatcaatttatagcaagtgtctttgtttgtgctgctataaaggaacacctgaggctggataatttacaaagaaaaaaagtttatttggctcatcattctgcaagaatcatggcaccaacatctgcttctgatgagggcttcaggaagcttccactcatggcagaagtgaagaggaactggtgtgtgtagatcacatggtaagatagagagagaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaagagagagagagagggagataagaggggtatgaggaaggaggatgagagaaggaagaaggagacagggaagaataggagacagaggagggttccaggttatttttaactatcagttctcggccggatgcagtggcttatgcctgtaatcccagcactttgggaggccgaagtgggtggatcacttgaggtcaggagttcgagaccagcctggccaacatgtcgaaaccctctctgtactaaaaatacaaacattagccaggcatggtggctcttgcctgtaactccagctacttgggaggctaaggtgggagaattacttgaacccaggaggtggaggttgcaatgagccgagatcttgccattgcactccagcctggccgacagagcgagactgtgtcccaaaataaataaataaataaataaataaataaataaataaataaataaatagaaaaaaataaaaacacaaaaattagctggatgtagtggcgggtgcctgtaatcccagctacctgggaggctgaggcaggagaatctcttgaatccgggaggcagaggttgcagtgagctgaaatcgtgccactgcactccagtctgggcaacagagtgagattacatcttgaaacacacacacacacgcacacacaatcagttcttgcaggaactaagagtgggaaatcactcactcttgagagaatggcacccagccattcctgagggatctgcccccacgaccaaaacacctcccaccaggccccacctccaacactggggatcacatttcaacatgagacttggcaggggccaaaacaaaccatatctagaccatagtatgacacaatttttattggttaaaaatgtatttgtacacaagacagtatgcttaaagctacaagagggcagggatttctgtctattttgttcaccgttgtcttcttgccacattctgaacactcaatatttgatgagcaaatgcacttcacaagaatgcgcacacattcaagagaagaggaatacctcagctgagggggttttgcactgcaccgtggtgatgccagaaactcaggagtaattcactccactttctgcacctggggtgaaatagaagcccaatcttgtgtgagaggtgagggggagggtggccgggctggcctacgtttgcagagcttgttccatttcacagtggcttggctgccctgcccttggtccctccaaggtcctgcttgctcagctcttggcttgccaccttcctgctccatctctaaggctttattggctgttcctgtagaaacagactctccaagtcatggctttttctcagcattttgcatgtaccacctcccttatcctcacaacactgcctacaacactggttctcaactggggacacttccatccccataagggacatttggcaatgtctggagacatttttgattgtcacaactagggtatactgtgctactgtcatccagtacgtagaggccatggatgctgctaaacatcctacaaggcacagggctgtccccagactccccagtaaagaacgatcaggtccaaaatgtcagtggtgttgaggctgacctagggtagggggctctaatatctctattttatatgtgaggaaacggaagcatggtgaggttgggtaatcctgtgtgaggtcctgcagctggtaggcaatggagatggggtatagaccaagtgagtctggctctagagtccttgcttttaaccaccatacatgattgcttctcagaagtggaaaacgctgagacaggcacagctttttatacctttactcacttatgttacggcgagggtgaccagctgtcttggtttgcccaggcctgagcggattcccagagtgtgggacttgcagtgctcaagccaggatggatagtcaccctagtaacctccagactctgtagacatctgtgtttgtgatctgattgttactttcagtctgttgagttcatattactgatgtaagagttaagaagagattatttaggcagatagtgagggtaaggaagtcctcagtaaggttttccttttaatgaaaagcagtccccaaatcatttttcttttctaacggagagcatcctgtaaaatcaagctgcagacataggcaagcaagctggaagcttgcacgggtgaatgccggcagctccgcccataagaaaaggctagctggggctaggcacgtccaacagggcagctccatcttcccttctctttgccagccatgtgtacagtaaggagcaggcaacaaggagccagccaggcaaagaccccatttgcataataacactagggtggggcggccaacttccccatgcgctatgtaaatgtcacacctggtgcaaccaatctttgggccctagtaaatcaggcaccgcctccccaaccctgtaaaatctggtgcactctgacttgggccagaagtcccactgggtgcccccctctcggaagagagacagtgttctcctttctcattcttttgcctattaaacctctgcttttaaactcactctttgtgtgtgtctgtgtccttaatgtttttggtatgaggcaacgaatctcaggtattacccccgagagaatgatgctgcttcactctgtgctaatcacaattgacacaagggccgaatcccagtctcaagttcacctacgatgactttatcatccacatggctcaaagctgtggtcaagtttcctcctgttttgaaaatatgtgctatgctccagttaagtcagcacagctctaggtagatcaaaattcatctttggaggatttctgaaattcacttgaggagtagatcagttggggatggtgtgatggaggaaaaagaaaatcccaaggtttgatggcaaggttagagtgaccttctgaccttgagcaaatggcttaagctgtctgggccttgatgtcctcgtttataaaatgagtccgtaataaaagccacaatgatgagcatcaggcactgtgctgagtgtttgccatctaaggggttatctggttatctcatttaatcatcacaaccacgggaggggaagctcctggggttaagtgtctcgcccaaggttgcagctggtggggaatagtctggttgcaaacccagagaccacacttttaactgctatggaatgttgtctcccgtggctgtttctgaggagatagaaaaacatgccaattagggccaaaaaaacgggaggtggcctcaagggcagtgcattacattaagagtgtttgcaaaggcgtgggtgtttctccacccccgagtcgctgctgacttcccgacacctacacgcagggtcaccctgcagcttctgagcacctggccggctccccccagcaatgtgtgtttgatgttatcagggggtttgaggcacggctgaggccccaggaatctttctctttcatggagaagccaagctcacatctcccagtggcagctggtgctggcgtctggctggagttgcagggactatgtgtcagctctagcagttcctgcgactgtattcacctactgaaggtccttgatctattgctggggtttgccaagggtctcaggggtctgctgcggagcagagagactgattattattttttaaatctccagttgacccccttgttctcacgttaatcactttgagaataaaaatggctaccaataattgagcacttactacgtgccaggcacaggcacatcctatgcctccctccctcctcctccggggctgctggctctccttatcctttttatttttgcttttttctccacagctagtaactgtgttctaaacaccaataagagggcctggcaaatgtggttactcaataacatttattgaatgaatgggtgtgagcgagtgtgtgttaggctccctgctaagcccattacgtgtattattttactcaactctcacagtaatcctatgagataagcttcatctttatctccatgttacaaaggagaaaatgtgctcagagatgtcaagtaatttcccccaaaatgcacagcttgtgtcaacgcaagaatgcaaatttagcagtctccaaattctaccccatttactatctcccaaatagatatgtataaatatcccacatatggagatacattttaaggatttatacgtatctatttccatgtaacacggccacacatatgtatcctatataatatgcacatgtatagtatgtgcacatattcacgtgtaaatgtatcagttacctgtagctgtgtaacaagtaacaccaccctcatggttataaaaataaacacttattttttgctcataggtctgtggtttagctggagagattctgctttaggctgtgggttgagttcaagtctgattcttacatttatttctgaggtccagattggagaagcagtggtacctggtgaaggttggcagcttccagagaggagtgagcagaaatactcaatgccttttaaggcctaagctgggaactggtgcaccgtcagctctgctcatgttccattggccaaaacaaacccatcactaacagggcagaggattctgttcttcccatggtgaagggaatgagagggaagtaaatatttgttaaacaggaaaacataccactatcatattttaattatatatggatgtatttgtattttatctttttttttgagatggagtttcgcacttgtcacccaggctggagtgcaatggcacgttcacggctcactgcaacctctacctcctgggttcaagcaattctcctgcctcagcctcccgagtagctgggattacaggcacctgccaccatacccagcttttttttttttttttttttttttgtatttttttttttactagagatgaggtttcaccatgttggccaggctggtcttgaactcctgacctcaggtgatccacctgcctctgcctcccaaagtgctgggattacaggcataagcctcggcgcccagcctatatttatctttttcacccatgaccccagcttcagtgaggagttctgttactttgtacttttactgggcattcgtttccttgtttggaaaatagtgactataattaataaaagtgtttgtattcttgcaaattgctaagagagtaaatttgaagcatccccaccacttgttaattagcttgatttcaccagtccgcaatgtatacatatttcaaaacatcaggttgtacacaataattatagacaatttttgtttgtcaattcaaaaagtaataagtaaaggaaaagaaaaatgtaagatactttaaaaaatgactggctcgtgttgagaagtaacttttactatttatttgtttttttgtttgttggttggttggttttttttttttttttttgagacggagtttcgctcttgttgcccaggctggagtgcagtggcacgatcttggcttactgcaatttctgtctcccggggttcaagcaattctcctgtctcagcctcctgagtagctggcattacagatgcccaccaccatacctggctaattttttgtatttttagtagagacagggttttgccactttggccagactggtctcagactcctggcctcaggtgatccacctgccttggcctcccaaagtgctgggattacaggcatgagccaccgtgcccagcctaacttgtactatttatttgagttaagccaacacacacttgagttccccacatgtcatagagtgatgtggacaagcccttgaaatctggctttcctgattacctggttgaccttgtagatgcctctctgagcctcagatatgttctctgtgaaatgggcatgaaaccagtacccactttgtagagcactgtgaggattaagtgagaggatacgtgcaaaagtttaccacagtgcctggctccagaagccactcaatatatatttgctgttgttattaatattgatactattcttacaacaaaaacagcacagatgttctaatgatcaattatcctagcctgtcgtctgctggtccccagcccatgtttctcggaccctgtctgtgtgtgatttatgatccgactctctctacactttgtgttggggtttgatttttcctgctttggctcaagacccccttcctacagaaatgtttggacccatcttacagacttgtgcctccttggctgtcctgcctggtcagccccttggaacacagggttggccctaagttggtcctcccatcccagcaaaatggttcactggggcattgcaggttgattgtggaatttcaacaatagcatgggtggtgggaaaaccttcggacatccacagacagcagcctggatgtataagagatgggggtggtgttctttccatctggagtcctccgggagctgtcaagcctggaatctttgcaatttaggcagtctgtttgtaatggtctcaagaaaacccattctgcctacaaacgcggtgacctttaatttttttttctcagatttttccaagatgcacattgactcttcctgtcaacgtggaaggctctaatgccgcctggggcatttagattgcatttgccaatcgctgactgctgtagccaatttgttcctgatctcaaggtcgattttgaataactttagctgggctaagtctcttgcattgaataactgggaaacaacctattaaggtagcaggcgggcgggggcaggagggggcagggggctgtttctattttgtagaagttctttgattttggataaatgagaaggcttctagctctgccagtcatggactatgtggccttgaacaagggagggaaagaaagaaacacatgccaagtacctagcatatgctagacacagtgctgggcacttcacacatgccagctgcttaatctactccgcgaggtgaacatcgtgatctccatgttacagataaagaaacggagtcccggcaacttgcagggttgagcttggatctgtctaaagccccgcccctccccctttttttgtttgtttgagacggagtcttgctatgttgcccaggctggtgtgcaacagtgcaatgatcttggctcactgcaacctccgcctgccaggttcaagcaattctcctgcctcagcctcccgagcagcttgggattacaggcacgtgccaccatgcccagctaattttttatattttttgtatagacgaggtttcaccatgctggccaggttggtctccaactcctgacctcttgagccgcccgcctcggcctcccaaagtgctgggattacaggcgtgagccaccgcgcccggccgatgatgctctttttaaactatccttatgagtgtatttcagcaacctcccccgacccgaattacagtaccacaggctgcgtcctaatgctgtgccctctcctgatatggtctggctgtatccccatccaaactcaccttgaattgtaataatccccacgtgtcaagggcggggccaggtggagataattaaaacatgggggcagtttccgcatacggttctcatggtagtgagtaagtctcacgagatctgatggttttataaatgggagttccgctgcgcaagctctcttgcctgcccctgtgtagcatgtgacttcgctgttctttggccttccaccatgattgtgagacctcctcagccatgtggaactgtgagtccattcaacctctttcctttgtaaattactcagtctcgggtaggtctttattagcagcgtgagaacaaataaacctcctgtcatcttctctccttggattcactcctctagtctgagatgtctggttcgccttgtttccccagcggtgggctcatgccggcaggggttggcatcagcaactgttctttgatcccatgactctgattttgagatgagcctggtgcagcttggtggtttcacgtggggccctttggaaggagaaaacctggtccgaatccctgcaagttgtgtgacgggttgggttccttggaagcccgagaatgagatttgggtaggtgcggtttattcaaggtgggggttctcaggagaaggaaagtgagggaaggaggatgatgggggaggggacagagccaagcaagaatgggctctcaggctgaggctagccttgatctcacgtgggtctctggagtgtattctgccttgaagcaggaggactggacttttgtgtgactcctctcgcctcatatcgcttagtcattggccagttcagcatgtgagagcataactccctgggtgaaatggcttttgctagctaaggaattctccggagaaagtattggtataagccattaggcacagatcagcaaaggctgaatgatgagtggtttactggcaatgaggatctgggtgaagcaccaggaacagctgcgacgttgtgcaactgctctgcctcagttttcctcatctgtaaaatggggatgttgataaaacccatctctgagcgttgatgcaagggttagatgagatacttgcatttgtgttactgataatgtgcctgtcactggccaggtgcaaagcaagggctcaacgaaagcataagctattattattattattattattgttattactggcagttttggatccatagcaacaagcacatataaacaatgctcacttcttctctagtttaattcttataactcttctgagataagttctacttctaccctgttttacagacatggaaactgaggcacagtgaggtgaagcactttgagctcacatgatggggctgagattccaatttagggagtccagtcccagagcccccaagtgagtgctggtttgggactgtctcttctgatcatgacaaatcttttttttgagatcactctcagttccttgaatgtatccatcttctctgttgtttctgggtctttgtatattctattctctgtgctggcaacagcttttccgctttaacctgatctgccctggttcatcccttgagactgagctctgagctcatatttggccttttttttttttttttgagacaaggtctcaccctgtcacccaggctggagtgcagtggtgcaatcgtgactcactgcagcctcaacctcccaggctcaagtgatcctcccacctcagcctcccgagtagctgggactacaattgcatgctaccatgcccagctaacttgtgtactttttgtagagatgaggtttcgtcatattacccaggctggcctcgaactctcaggatcaagtgatctgcctgcctcaacctcccaaagtgctgggattacaggtatgagccacggcgcttggcccatgtttggccttttccaggaagccctccaggttgcctccttccacagccccttgtctgttccccaaagtgtctgttaggatgtattacacttgcctagtcacttgtctgcctctcccattagtctatggctccaaagaattgaatattttgcctgtctctatcattgtcacccctgcaagtagcatttgtctggcacatagtaggtactcaataaatgtttattttgtggctgaatgagcattccagattcagaactggaaacattggaggcttacaaaagttcagaaccgcatacattggaggcttacaaaagttcctgttgagttgaattaattcattttgaaatgacatggactaagttctttctgggaaggtttcctaactaaatccgtgggcatggtggactggagcgttccagaaccagtgcaaagagtcccctgtccataggcatgagatgaaggctcagggacttaaaatacacttctattgtggaaagttcttcagagacccttctggcattttatttaattgatgctcggctcatttattttattattttatttttattttttaatttttttattttttttttgagacggagtcttgctctgtcactcaggctggagtgcagtggcgcaatctcggctcactgcaacctctgcctcccaggttcaagcaattctctgcctcagcctcccgagtagctgggattataggcaagtgccaccatgcccagctaatttttgtatttttagtagagacggggtttcaccatcttggccaggctggtcttgaactcctgacctcgtgatctgcctgcctcgacctgccaaagtgctggaattacaggcgtgagccacggcgcccagccatttttattttattttttttgagatggaatgtcactctgtcacctaggctggagtacagtggcgcaatctcggctcactgcagcccccacctccccggttcaaacgattctcctgcctcagcctcccaaatagctggaactacaggcacacacccacacaccaccacacctggctaatttttgtatttttggtagagacggggtttcaccatgttgcccaggctagttttgaactcctgacctcaggtgatctgcccaccttggcctctcgaagtgctgggattacaggcatgagccaccacgcctggcccagttaatttattttatgtaatgaatgtatttcttttcattaggaaagtatgagaatcacgttgctgaaaatgtgggaaacctagaaaagtagagaaacccacccactatcatttggtagtaaatttcttcagatttttctcctcccatatatgtttttctctttctttattaaacatacttatgaccatactattaatatagtttagtatcctgctactttttttccgtttagcaaaatgagatttttccaggtttaattacatagttttaaaaataaccatcatcattttgttcttatttttttcccttttgaatttaaaaaaaaaaatcatagtaatatgagcacatcgtacaaagttaaagtacagaggagctgctaatgaaagcagcggttcctggccccttctctcctctctcccctccttaagtcttatttcccggaggtaagtgcttgaaatgttgtttccatttttaggtcttcggttatttatctctgtaactccaaataagatgcttatgtggctgtttcttgatttatcaatttaagacattttctattgactctgtgccatagaagatgaggattcagcttattgacatggttcctccccactttttgtccttccccagtttttatttgaaaaaagtcagacgtgcacatggcaaatgatgaccggaggatgaaggagcctctcttactctaatgcttcagtcttccacccacccctcctcccagtttcttgtgtatctgtggcaggtcaaagatgagtgcaaactgtttgataccccatgcattcagaaatggggtctatttcccttttcctgagcctgggctggcctgtgactgctttgacgaatagattgccatagaagtgacaccatgatggttctggtcctggcatttaagggatcatgcagtttccgccttacacctcttggaactcttggttttaaacccctgagccactgtgtgagaaatctgagggcttttgctggagggaaacctggagagactctgagatgacatggaaagggagagaagttgctctgagcccagcttccatcctgtcccactgatatgatttggctgtgtccccatccaaatctcatcttgaattctcacatgttgtgagagggacccggtgggaggtaattgaatcatgggggtgggtctttctcatgctattctcatgatagtaagtctcatgagatctgatggttttataacagggagtttccctgcacaagctctctttttgcctgctgccatccatgtaagacgtgacttgctcctccttgccttccaccatgattgcgaggctccccagccatgtggaactctgagtccattaaacctctttcctgtaaaaatgacccagtctcaggtatgtctttattaagagcatgaaaatggactaatacacccaccaaggtgcctggcacatcactaaaactgcactagacccttcagagcagccccgaagccctctgaatactactgagtgacctcagatgatactgtgtgagcagaagaactgcccagctgggtcctgcttgaattcctgaccctcaaaatcatgatctataataaaaacagttgtggctttaagccataatgtttggggattaacttgaatggcatccttcaggagataccccatgtgtcataggttttggggatggaggttatcttagcctaccaacagtgcctgatacaaatatgtgaatgtttcattgggtcacgcaatctcaagaaagcagggataagggaaagagagaaagaggaagagcaaaaccaaagaagtgcatattgcctagtggagttgcagtttcccagaaacacaagcatgggataactctggagtcagtcatctgccagctcctgctgtttcctgtctcttattggtcaaagcttgctccactctgcacttctgagtaatggccctcagcccctcctagcagcttctgggggatccaggacctctgggagctgataggtgtgatagaggccagcccttaaccccacccagggtaggctgagtcacttttattttattgtaaaattgatatttatttacttattattttaaggtaattttttttgagacaggatcgtgctctgttgcccaggctggagtacagtggcacagtcatagctcactgcaacctcaaactactgggctcatgtgatcctcctgcctcagcctcctgagtagctgggactacaggtatgcaccaccatgcatggctagtttttaaaaagtttttttggagggatggggttttgctttgtttcccaggctagtctcaaactcttgacctcaagagatcctcctgcttcagcctctcaaattgctgagattacaggcataagccactatgcctggcctctattattattattttgagacagagtctcactctgttgcccaggctggagtacatcggtgcagtcttggctcactgcaacctctgcctcctgggttcaaacaattcttgtgcctcagcctccgagtagctgggactacaggtgtgtgccatcatgactggctaatttttgtgtttttagtagagatggggtttcgccatgttggccaggttggtcttgaactcctgacctcaagtatccacctgcctcggcctcccgaagtgctaggataacaggtgtcggtcacagctcctggccactggcttctatttttttattttttgagagggagtctagctcttgttgcccaggctggggttcagtggcgcaatctcggctcactgcaacctctcaagttcaagagattctccagcctcagcctcccgagtagctgggattacaggcacgcgccgccacgcccagctaatttttgtattttcagtagagacaggtttcaccatgttggcaggatggtctcgatctcctgacctcatgatccacccaccttggcctcccaaagtgctgggattacaggcgtgggccatggcacctggcccagcctctatttttaaagtaacttttatgggatgtcagacattgtaaattttaccttggtgggtgctggatgtttttgtgcctggcacagtcctaggtgctgaggacctagcattgaacaaaaacaaagatccctgctcttgctgaacttccatgctactgtggggagacaatcagtgaacaacaagcataatttaggtttgctcttattatactgttgcacacgtaccttttgtatatgtactcttaaacggccattgtttttagtgatttgattgaacaaatatatttgattgaacagatatatccttgctgaatgagccatttctctattgatgggtaattatattactttctctagtaagagtcatcagaagcttagaggcttaagaatctaagctcaacaaacagaggttggagaggttattataaagtccattgtgagagcagccactcctaaccttgggaccaaagattggtattgcgtgacctgtgagccagaattaccctggattggactgtcctaccaggtgggcccctggccagcaaaagagatgatgggggttgttagaatgtcagagagggccttagacaccccttttccatatagtctccagctctttgactaaaacctgtaccccagtatataatcagtcacccaggcctagagtcaaggtcttttatatcatgtaaatttattttttatttttaaaattttttatttccatagggttttggggaacaggtggtatttggttatgtgagtaagttctttaatagtgatttgtgagattttggtgcagccattatctgagcagtacacactgaacccaatttgtagtcttttatccctcaccccctcccaccctttcccccgagtccccagagtccattgtatcattcttatgcctttgcatcctcatagcttagctcccacttgtgagtgagaacatacgacgtttggttttccattcctgagttacttcacctagaataataatctccagttccatccaggttgctgtgaatgccattaattcattccttattatggctgagtagtataaatatactgctggtatatggcatatatataccacagtttctttatccactcgttgattgataggcatttgagctggtttcatatttttgcagttgtgaattgtgctgctataaacatgcatgtgcaagtatctttctcatataatgatttcttttcctcagggtagatacccagtagtgggattgccagatcaaatggtggtgctacttttctttaaggaatctccacactgtcttccaaggtggttgtactagtttacattcccgccagcagtgtagaagtgttcccttttcaccacctccatgccaacatctattatgttttgattttttgattctggtcattcttgcaggagtaaggcggtatcgcattgtggttttgatttgcgtttccctgatcattagtgatgttgagcattttttcacatgtttgttggccatttgtttatcttcttttgaaaattgtctattcatgtggatttataccttccccgtattcccatgcctttgtcttcaatgggactattattttttgtctaatggctttgaattaaatcttctgtcttctattccactgatctccagtctccagcaataattatgctgtttgcattggggaaggtggcagatgtagttgttgccttgcctatgtcctctggcataggaactcaccattcctactgcaagcatctgcaatactgcctggggctttgtctcactgccataacctaggctcttgtggggcaggctggaagtgcagagaaaccaacacaggcacatctcccccagccagctgctgagggcagttgccctgccttccataccttagggtgaggcaggcgctatgctgtctcccagatgtccccagtgggattgaaccccagttgcccatagtagcagcctgcttataaacatgacctggattagctcctttcccttctctgtctcatttccctattgtcatcccagtgtttcctgggctcactttccaaatcaacccacttatcttcaagtccttctgtattagtctgttctcatgctgctaataaagacatgcctgagactgggtcatttataaaggaaagaggtttaatggactcacagttctgcatggctggaaaggcctcacaatcatggtggaagacaagaaggagcaaagccacatcttacacggcagcaggcaagaggcttgtgcaggggaactcccatttataaaaccatcagatctcatgagacttactatcaggagaacagtatgggggaaaccacccccatgattcaattatctccacctgcccccgcccttgacacatggagattgttacaattcaaggtgagatctgggtagggacgcagccaaaccatctcaccttctcttaggatttgtttctggggaaacctaacctatctaagatgatgaaaaatacaaagaaccaggaaaatccataaatagatttaacaagaaaattttacctagtcttgatgagtggcaaagcttgactgccctgaggaagtgactttgctgagctgagacctgaggatgggtaggagttagctaagcaaagcagcactggaagaacagcaggggaagaacattccaagcatagggaagagcatgtgcgaaggtcctggggcaggaatgctagtgtggatggggtgcagaaagagaggcagagaatggtggttatctttggaggatatatggcctgaaagtgaatttgggtccctgactttaagtctctttcctctgcagtttaattatgtctatacacttttttttgaaccccattatggtctggcttcatttaaatgcatctgaaatgaaatctctaatgttaacagtgttgtcagatgtgaaggcttcatttctctttggttctttttcaccgaatgctatctgtgagtttctggggaggatatgaggattttgattgttttgatttttttttttttttgtatgaccacattatgttaatttccccattgtcttagagtatgagaacataaaagcaataactcatttatatgaagactgaatgtgctgagaggttgtcatggaaacctctcatgttggcttgagtaaattgaataacccctgttaaaagactgaacacagataactggcaggctttgtttcagggcaagagttcacaaactggggtccacagatgctcaaacattctatcatgaatagaattcggggatcccatgatcttggacagttaaaaatacatcttatattcttttatctctacctgaagtttagtctttctttccattgtgaatgaataaagcaataaacaaacaaaaaaacaaaagattgaacacagaacttatttacccaattgcatggcattcacaagagatgagaaattcaacatgatacatgagatttttcccccccgcaggggcagggaggaggatgaagagggtgaatgaatgctaggaatgtattatttttatttagacagtgatttctatttttctttcaaagattatatttttgtttccaaatgggagaggtgttatggggcgatagagaaaggatccagggaaaattgcatggtaaaattgctcctgggaaagaccagcttagggtatccatgattgtcgcttctgtagccctgagcatgtttctccccttggagcatcctctgaagtcttggtcagagtcgttgaagagacatgaaccttttcagcattttctgctttgctttggcaggattgtttactgcctatcaagctgacttacaaaaaatactagttctgttgtttttcatttttaaaagcaaattgcttcacctcttcgtaaataactccttaaaagaaaagccgtggatgacagatgaggaagcatagttgggaacagagcgcggcactcgctcacgatcatagtgtcaggtcacaggaagccctctgagccccgggggtgggggcagcctctttaaagtgattatggagcaagaggagcttgaacagtggcactctgagcgttgtcttgggccagcttggagatcaggtcctgggctccagaagacatcgaggctggttctacctggatgttgcatccgtaggtatcaaagtaggagatgctttcgaggggtgagtttttcatcagtggcctccaccccaaagcaccatagtcctacctccttgttgtatgtctttcttctcacaggctgcttgtcagacttcagaatttcatgggcatgatgggcaaataagcttgattaatgcttcatgcttgctatccactaaatgtgttcccaccatgtgttgaaacctaatccccagtgtgatggatggtattagggggtggggcctttgggaggtgattaggacatgatggtggggactccacaagtgggattcatgcctatttatttatttatttgagacaagagtctcaccctgttcccaggctagagtgcagtagtaccatctaggctcactgcaacctctgcctctgggtttaagtgattctcctgcctcatcctctgagtagctgagactactggataattatctaccacacctggataattttttttttttttgtatttttagagagatgaggttccaccacgttggccaggctgtcttgaactcctgatccaagtgatctgcccatcttggcctcccaaagtgctaggtttacaggcgtgagccactgcgcctggccaatgcccttttaaaaggggtcccagagagcccctttgcccttccatgatgggaagacacagtgaaaagagggctgtctatgaactaggaagaaggccttccccagacactgaatctgcctgggacttcccagatcttctggagagaaccgtgagaaataaatgtctgctgtttgtaagccacacaacctatggcattctcttatagcagtctaaatagactaagataataccataaggatctacctttgggactgtgtgctgttataataaaggctctgataagtcctgctagcgccgtttagaccaggggtttctaaactttttgaccacacaagttatttttccctttgcaagcaccttccatggaaatcttttgggaggctgaggcatgagaattgcttgaacccatgaagtgaaggttgcagtgaactgagatcatgccactgcactccagcctgggtgatggagtgagactctgtgtcaaaaaaaaaaaaaaaaaaaaagaaaagaaagaaaaaagaaaatattttcaaaatgatgccatggattaaatctgatagtcacaaaggatccttgtctggtgttacctccatttgatgggtgaggaaacaggagtcctgagaaaccaagtaacttgctcagggtcatgctgttaggatgtagcagaatcagaaccaaaaccctaagtcccagacgactaaaatccaccactccaatggagaggcccttactgcaatgacctgttctgaaggagcgaaacaaggcatttattgcagcatcatttaattaggaaaaaaatctggaaagaccctgaatgtccaactaaagggaaatagttgatatttatgatacttccatacaatagaatgttatggggcatcgataatagacatgaagcacagtaacatgaggtggcacatattataatgtaaaatggagaaataaagcaaaatgataatcatgcaaattaaatgcatgaaactaaaaaagaaatacaaaatagtagctgtctctagatggtaggtgagtcagttcaggtcctctgagtagcagaaggcaaaacagaattaattgtacaaggtcccagtctccactgatttcaaatccacttttcaacttctgtatgaagttctcattctcttactaatttttttttttttttgaggcggagtctcactctgttgccaggcttgagtgtagtggcgcgatctcggctcaccgtaacctgcgcctcccgggttcaagtgatttcctgcctcagcctcccaggtagctgggattacaggcgcatgccaccatgtccagctaatttttgtatttttagtagagacggggtttcaccatgttagccaggatggtctcaatctcttgatcttgtgatccacccacctcggcctcccaaagtgctgggattacaggcatgagccactgtgcccggccctcttactaattttaaataacatgtctcctgcagcttctgtattgcaaatataggaagtgattttggcgagcatttgaattatggtagctgatctgatctgttgtgtctccttactttctaattctttctttactttctgctcttttcctccctctgcttatttgcttcctcttgctgtcttcctttatctccttttcttttcctacaaatttctaaaatgatagctgatgagaaggaagatcactcttacataatttgattcctcagtttccattttcttctttttacaagtataacattctatatttcttttttttaaaaaaattattttttaattgaaaaataatggtacctattgatggagtacgtagtgatgttttgatatatataatgtatagtgatttgatcagggtaattagcatatccatcatctcaaacgtttctcatttctttgtgatggtaacattcagtatcttccttctagctatttgaaactgcattattattaccattatcattttattttatttagacagaatcttgctctgtcacccagactgatttgtagtagcatgatctctgctcaatgcaacctctgcctctcaggttcaagcgattcttctgcctcagcctgccgagtagctgggattacacgcatgctccaccacgcccgactaatatttttttagtagagatggggtttcaccatgtttgccaggctggtttcgaactcctgacctcaagtggtctgctcacttcagagtcccaaagtgctgggatcacaggcacgagccactgcgcctggccaaaactacatattgttaactgtagtcatcctacagtggtttacaacatgaaagaaaaccaagtattaattgtgcaggaaattcattgaagaaaatgcctgtgaagggaaatggggagggagcagggagagatttcagaccgtaatgcaggtctgacacctctgaaagcagagtgggaaggaagagagatagttagaaagagaaaggcttcggcacaactctgagaatgtatcagccagtgtaatagttcctaaggcaactctctctgttggacaactcccagttgggttagaatcacctaattccgttacttccactgtgcccagtcactggctgggaaaatccccagggaagtgcagcctagcatgaacacctcggtgggtcaaaaggtacagcagctagaggttgtcagttagctctgcttccagagcagttcaccttgaaggaagatttgagcacagaacttccatgactgagagcttctggtgcactttacagcagaggaatttgtgaagcaggttcactgttcactggctaccaacttgtccagtgagacagaacactcccacacaacaagttacctgaggtaggtttattacttacagataggcagcaagagatggtagaagcctaggattcattgtgagctattcctccaagtccccggaaacctgctgagggtaagtagagtcatatctgtgcatgccttacttgcacagaagctcagataccccagaaagcagctggttctgtgttttataccccaggatgtgtgatttgctgggctaaagtgtttaagacattttgtttctaggggtggactgaaacagaggttgggtcgttctggccagtccctctctatctcaagatgttgcatttctagcacattcttcagttattcttaagaaccatgagttgggaaaagagggaagaactgggtaggcccaaggccacccagtgaactgtctagcagcattttgcattttgtaaaagcacattaacaatggttttgagaagctgaagtctgtggactgattctccctgtaaatacaggcctgctttactagcacctgcactttctggttcttatgccccctcaaaagtgtactgagtcatttgaacagaaggagactgcccctccagctccccacaatgggaaattgtcatcactgccacaaaatgaatagaaggacttggccaagttcatcttcctttgtttactgcctgcacttcatcccatttggaagagagaagcaatagcattgaatggtctggcttttttttttttttttttgtaatcatggctatacagcagggtaatgaaggtcagagatgggggcttgaaccacctgcctgtggttttgaggtttccccaaatactctatggttgttaagttccataagaaagggacttgtttttcatttttattttctttccaacttttattttaggtttgggggatacgtgcgcagatttgtttcatgggtaaattgcatgttatggggcttggtgtccagattatttcatcacccaggtaatgaatgtagtacctggtaagtagtttttcaatcctcaccctcctcccatcctctaccttcaagtaggacccagtgtctattgttcccttctttgtgttcatgtgaagtcagtgtttacctcctaagtgagaatgtgcaatatttggttttcttttcctgtgttaatttgcttaagataatggcatccagctccatccatgttgctgcaaaggtcatgatttcattcttttttatggctgcatagtatattccatggtgtatatgtaccatactttctttatctagtctgcaattgatgggcatctaggttgattccctgtctttgctattgtaaatagtgctgcaatgaacatatgtgtgcatgcatctttaaggtagaatgattattcttttgggatttatacccatgaatgggattgctggattcaaccttagttctattttaagttacttgagaaatctccaaactgctttccagtgactggactaatatacattcccatcaacagtgtataagcgttaaagggacttaactgctgaatagtcttcacccaactcaaagcctggctctcagtagatactcaatatattgcttatacaattaaaggaatggttaaaaggaaggaagatgtatgcagaatctgtgtactgctaagtcagcaaacatttgctgagggtctgttgaatttggtcctgctcaacattgaacttgcccacttctcaccaccattaaggctccagaaaatttgtttatccacagccttcttcgtctaccttattaccttgtcatttctttgagacctaatatccattcctcctgatctccagctcaactccctagaatccatagcttctagagttttgtttatttattccatttttatttatttgatttattccactttcattgaatatcaagacctccaggcatagttccaggcacctggtatgcagcaacaaatatgatgttcagataatctcttgctgcataaaaaagagcctgatcccacagtggctggaaacaaatatttggtattattgctcatgactctgtgttgattgggctcacctacgtggttctcatttcaagtcctatgcagttgtagtcagataatgactggggctggagtcatctgaaggcttgactaggctggccatccaagatggctgagacacatggctggcatgatattggctactggttaggagctcagttggtgctgtcgcctggagcactttcatgtggcctttctatgtggtttgggcttctcgtagcatagtggtgtctgagttccaaaagtgagtattccaagatataggaagtagcgcttgatagtcttttaaaacatggactggaaaagggcacagtatgatttccaccatattcaatacgtcaaagcaatcatggaggtcattaaagtcaagggagagggtgtagatcccaagagattgttgtgtgtttttgtttgtttgttttttgtattttttttgagacggagtctgcctctgtcacccaggctggagtgcagtggtgtgacctcggctgactgcaacctccgcctcctggattcaagtgattctcgtgcctcagcctcccgagcagctgggactacaggcgcccaccaccacatcagctaatttttgtatttttagtggagacggggtttcactgtgttggccaggtgggtctggaactcctgacctcaggtgatctgcctgccttggcctcccaaattgctgagattactgatgtgagccaccgtgcctggccctaagggattgctttgatgtaaaaatgtacagccatttgaaaatggccacaggtggtctctgctgtcaaggacttcagagttgataaagagatagtgatgaaacctatagtaggctgaatcatggccactcaaagatagcaggttctagtccgcggaacctgtatatgttaaattataaggaaaaggagtctttgcaggtatgattaaattaaggatgttgacatggggagattattctggattatctaggtgggccctaaatttgattgcaagtgtcttataagagaaaggcggagagatattacacccagaagacaagaagttgatatatccagatggaggcagagattggggtgatgccactccaagcaaggtaatgctggcagccaccagaagctggaagaggcaaggaacagactgtcccctagcacttctatagggaacgagctctactgacaccttgatttcagtttattgcaaccgatttcagtcttctgacctccagacctgggagagaagaaattcctgttgtttgaagccatttagtttgagatcattgttacaaaagtctcaggaaatgaatacaaacccagacaatgacaagcaagggtggaggtgatatggaggaagcatataggaggcacctgaagcccagcccagctgggagagaagaaagcaggaatgcttctttaagctctgatgttcaaatgagaacacatggacacacggagggaaacaacacacactggggacagttggagagtggggggtgaggggtgggagagcattaggacaaatagctaatgcttgtggtgcttaaaacccagatgatgggttgataggtgcagcaaaccaccatgacacatgtatacctacgtaagaaacctacacattctgcacttgtatcccagaacttaaaaaaaaaaaaaattctgacgttgattcatccctaggaagtgtggcatcatggtgatgttcattcatccctaagaagtgtggcatatgacaacatgtggaacttgaatccattaaacttctttttctttacaaattacccagtctcaggcatgtctttattagcagtgtgagaatggactaatacaaatattatgatgaatgaggacattctcatatcttccacaaaaccatcatggaagacattatccatcatttggttacatttcccttatgtaaggatccaaggggatctggagtactgcttttctgtttgcgtctcaactctgccacatactagctgggtttataggctgctgtgaggtttcaatgagtaaatcaaaacctgtaaacacttggtgcatgcatagtaagtacttaaaactggtattgttataattttcgggatatggtaaaggatattgtttttctggggaaagacactaggcccatcatgggggtaataccctcgtgacctcgtctaacccaaattacctcctccaaatgccattgcactgggggctagggcttcaacgtgtggatttggtggagaaagacaaagacattcagtccataacaattttccttggatttttatgtatatgatcaagtcacctaggaatgatgactgtttcatttcttcctttctggacatttcccccctgtctaactgcactagctaggatatccaggacaatgtggaatggaagtgaggcttatgggtatcagtgctatgataccatccacagggagaaacctttggctttgtatgaaaagctgatgggtagggatattgatatggtttgtctgtgtccccacccaaatctcaacttgaattgtagctcccataattcccatgtgtcatgggagggacccagtgggaggtaattgaatcaagatggggggtcttttccatgctattcttggccagttgtcagcctgcccaacatattgtgaaaccgtgtctctactaaaaataataagccctctcttgcctgctgccatgtaagatgtgactttgctactcctttgccttctgccgtgattgtgaggcctccctagacatgtggaattgtgagtccatttgtgagtccacctctttttctttataaattacccagtttcaggtatgtctttattagcagtgtgagaatggactacttcagatgtcatgatgaatgaggacattctcatatcttctgcaaaaccatcatgggagacattatccatcatttagttacatttgccttatgtaaggatccaaatggaattttttttgaattctattctaagaaaaatcatttcctttcctgtgaacagctatacttccctttgttaaatgatgatattcatgtgtcctttatgttttctttttcttttgctctggctattagggagctaaaacccaagagcacacgcaatcaaaataaccatattaaatgagttttcttatgtatttgataaataaataatttttcttttggtttccctttgggtgtaccttttattgcaagctgtctcaagaagtttttttcacagtaaatggggataaaattattttaaaagaataatacctgacctgattattacctgggtttatttcattgactgaatggtgagactaatgaatggacaagagctttatgaactgtaaaatgccgtgtctgttattaactaggggaagaacatgattgtccttgactttaaccaatgtaccttgtgtcttccttagttggcactgatggttctgagttaggtaaccatgctccctaaagcctctgagatttcccctgagcatcctggccactcagtgcttattttgcaccactcttgtgtgtccaggatgactccttcaactttatctttcttctagaaagttgctatccattgtttacatccagtggctcatgcattcatagactgcagcagcattttctaagcaccagctgctgggtatgtattggttacctgcccagcaacccttttctcttcttctttgctgagaccatcccattttcattcatgcatcagttggcaatatgcccagagaaatggagccccttccttcctcatgctcttaggcatggaactcagttggcccaagccaggcatgctcatcttgtttctctcactgctgactggtttagccttgggcacatgacctggttctcagtagtgagctagtaaggatcagaaaaaccacaaagccatgacattattgaattaacctgtctggaccacctacgcctggattttgtgtgggagatacaataaatctggattataggttggtgcaaaattaatatttaaatcacctgtagttcaactctgtgttgcttgcagtcaaaagtatccttatcaggctgggcacagtggctcacgcctgtaatcccagcattttgggaggctgatacaggcggatcacctgaggtcaggagtttgagactagcttggccaacatatagtgaaaccctgtctctactaaaaataaaaaattagctaggcgtggtgacacgtacctgtaatcccagctactcaggaggctgaggcaggagaatcgcttgaacctgggaagcagaggttgcagtgaactaagatcccgccactgcactctagcctgggtgacagggcgagactccatctcttgcaaaaaaacaaaaaaagtcctaatcaactgttttagtttggatgctcactgaagtagactctgaggcaaggatttgagtgccaatagtttattaagcttgaggaggtgggggaaaggggacaggcaagggagggaagtggcaagaaagatgcattatcatgtcagttaccagtgtggggaatcacagtttaatctctctggggaactctggaaaatgacacagagcagggatttgcaaactattggcccatggcaaacctgttctgccacctgttatttcaataaaatgttcctggaatacagtcacaccctttcatttatgtatagcccatggcagcttttatacaacagcagcagagttgagcatctgtgagagacaatatgacctgcaaaacataaaatatttactatatgaccctttttcaagaagtttgccaaccctagtgttgagcatgtagctcagaatcaccccctggaggagtgaaggagctgggatatttatacatccctccagttagtcactggtgaagacctaatgcaggaggtatgttaattctccaggacttccgacctgtcctgtgcacaggcattgtgggccctggccaagcaaagagatgtaaataccgattgttgggatttgtgcaagtatggaccctactggtccataccagtacactaacagagatggccacatcagtgcatccagagatggctgagaagtgcacctgtcctccaggaacccatagtctgaaggcaaggttggaaatggccaaacatttttatttttattttttttgagatggaatctcactctgtcacccaggctggagtgcaatggaatgatctcggctccctgcaacctccgcctcccaggttcaagtgattttccctcctcagcctcccaagtagctgggattacagggacctgccatcatgccggctaattttttgcatttttatagagatggggtttcaccatgttggccaggctggttttgaactcctgatctcaagtgatccacccacttcagcctcccaaagtgctgggattacaggtgtgagcaatcgcacctggcctttatttttattttgtgagacagggtctcactctgttgcccaggctggagtacagtggcacagtcatagctcactgcagcctcaaaatcctgtgctcaagtgatcctcccacttcagcctcccatgtagctggaaccacaggcctgtagcatcctacctggctaatttaaaaaacaaacaaaaaaaaaaacaaaaaaaataaagtgtgtagagacagtctcactgtgttgcccaggctggtctcaaactcttgggctgaagcattcctcctgtccccgcctctcaaagtgcttgggattacaggtgtgagtcactgtgccctgctcaaacattttataattaagtagaaaaaccgacatgtcagctggggtcccctgaatcctcaaagatctaggtaagatcttctatgcaggctacttcctgctaatctggggagggcgaccttctcaaggtcgtatctgcctctggccctggtgcccccaacccacgctggctctgctttttcccctacaggagcttaagtgcagaactttgcgtctcccattgcctgcaggaaacctactcagctagtgagttcatagggcttcactgaagactgggggattctggaggggatgattttctggcacattcaggcttctagaaccctctattctttccccagctctgcttctcgtttttttttttgtctggctccaaaaccttactccttttattgagcacattatttctctccagttcccacctctgcatttcctttcctgaatgcttctagggcctcagcagaacaaggaacgcctcattgatgacgttaaaaaacaacaacaacaaaacaacctaagacacaagacacagacaaaactttttttttttttttttttttttggtattctccagacaaaacgtttgcagcatgagatgaggtcccctttggaaacatctccccacattctgtgattctgccaagtcctctaaattttgtctcctccttcatccaccaggtggatttcaggactcctactgtcagaggcttggaataaacctctggcatgctttgcttctgttttgctttctttctttctttttttctgagatggagttttgttcttgttgcccaggctggagtgcaatggcgtgatctcggctcaccacaacctccatctcccaggttcaagtgattctcctgcttcagcctccagagtagctgggaagctgggattacaggcatgcgtcgccacgcccatctaattctgtatttttagtagagatggggtttctccatgttggtcaggctggtctcaaactcctgacttcaggtaatctactcgcctaggcctcccaaagtgctggggattacaggcatgagctatcgcatccggccctgtttggctttctaaaatagactgtgtgtctcacccagcatgacgttagatctgtttagcatgacagcattccattgagtcaactccttggacatactatatgttttgtttccctggtagctaattaaataagacaactaagtgcagtctagaaagttcctctcataacaaagttcccaagaatttacgtctttgctttacttacttactttttcgtggtagttgaagttcaagtggaaactgattataaaggagaaacctaaatcaagttaggtgaattctgcagtatgaactgtgcttggaaaatctaactggtaatgtatccacattgggaacttggtccttcctctcacaaagaaaattccaggtcaatttcatcccctatgctaagcatttgagtgttcaggaatgtgattttagttttataaaaattgttctttttaaaattcctgtcaaataatcagatttttttctcagcacatttagaagtaaaaatggaaagtttagagcattttgatattttagtatttccatgaagtcatttaaccctcccagactagtttcagagttttgtcttccagcccatctttgtgtctcactgtacattttctgcatgtacaatgagaggtgatttttaattggaatcccttagatttttagagagaaagctctcctcctctattcttcttcctctcctctcactgtctctcattttaatccagagaatcaaagtgtctcttacaggcttggatatcaagctgaactgttaaaaacagtggggtccaggaacctgagtttaaaacaagcacctctgattgtctaagtggacttagagaaagacaaatgctgtgtgatctcacttatttgtggaatttaaaaacgttgaactcatacaaaaagagtagaattagctaagtgaactaattcagacagagaaagacaaatgctgtgtgatctcacttatctgtggaatctgaaaatgttgaactcagaggaaaagagagtcgaattagaatggttgccaggggctaggaggaaatgttgctcaaagggtacagactttcggtgataagatgaataagttctgggcatctcatatttggcacggtaactatggttaacaataccatattgcttacttgaaatttgttaagagagcagctcttaaaattttttttttactttttgtgggtatataataaatgtatatatttacgggtacatgagatgttctgatacaggtatgtggtgtgtaataatcacatcatgaagaatggggtatctataccctcaaatatttatcctttgtgttacaagcaatccaaatacactctttcagttattttaaaatgtacaattaggccaggcgtggtggctcacgcctgtaatcctcacactttgggaggccgaagcaggtggatcacgaggtctagagtttgagaccatcctggccaacatgatgaaaccccgtctctactaaaaatacaaaaaatgagccaggcatggtggcatatgcctgtagtcccagctactcgggaggctgaggcaggagaattgcttgaacccaggaggcagaggttgcagtgagcccagatcgcgccactgtactccagcctggtgacagaccaaggctctgtctcaaaaaaaaaaaaaaaaaaaagtgcaattaaattattgactatagtcactctgttgtgctatcaagtagtaggtcttttttttttttttggagtgaagatctcatttctgttacccaggctagagtgcagtggcatgatgacagctcactgcagcctcgacttcctgggctcaagtgatcctcccacttcagcctcctgagtagctgggactacaggtgtgccccacaatgcctggctattttttgtatttttagtagagatggggtattgccatgttgcccggctagtcttgaaatcctggccttaagcgatctgtccgccttggcctcctaaagagctgggcttacaggtgtgagccaccacacctgaccaagtagtaagtgttactcattctttgtaactatttttcttgtacccattaaccatccctacattccccagcccactacccttcccaggctctggtaatcaccatcctttcactaagagaccagatcttaggtgttctcatcacataaacatccaaagacaactatgggaggtaatgaatagggtaattagctggttcatggtgatcatttcacaatttgtgtatacatatatctccaaagatcacattgtacactgtaaatgtattccatttttatttgtcaattttacccctctaaagctgggaaaatgaaataaaataagcatcctgggcaggactggctgcatagttttcagggcccagcacaaaacgaaaatgtggggattcttgttatgaaaattataggaattctggctgggtgcaggggctcacacctgtaatcccaatacttttggaggctgaggctggggagttgctttgagtccaggagtttgagaccagcctgggcaacatggcaaaactgcatctctacaaaaaaaaaaatgaataaattaaaaaataaataaataaataaatcagccgggaatggtggtatacatctgtggtcctagttactcgggaggctaaggcaggaggaccgcttgagcctaggaggttgaggctgcagtgagccatgttcatgccactgcattgtagcctgggtgacagagaaagaccttgtctcaaaaaaaaaaaaaaaaaaaaattataggaatttcaaaatgccagcatcacagtggggtcgtctaattatggggccttgtgcagttaccccaggcagcatagcaggaagcctggaagagctttgctgcaggattcagatcccagaccatggtgcccatgagtttcaagatcttgtaacatgaaggcgtgtcttcaacagactctctccaaagaaatcctctcttgctcttggcccttctttgtgcctgaaaagcgtgagaagagggtgtaagcaggacagaaccacttttatttttatttatatatattttttgagatggagtctcgctctgtcgcccaggctggagtgcagtggcgccatctcggctcactgcaagctccgcctcccggggtcacgccattctcctgcctcagcctcccccgagtacctgggactacaggcgcccaccaccacgccccgctgatttttttttttttttttgtatttttactagagacggggtttcaccgtgttagccagggtggtctccgtctcctgacctcgtgatccgcccgctttggcctccgaaagtgctgggattatagtcgtgagccactgtgcccggccagaaccacttttcaaagattttgtttgaaaatctgccttttgattttgtacttgattttggaattctttattattattattattttttgaaacgaagtctggctctgtcacccaggctggagtgcagtggcgtgatctctgctcactgcaagctccgcctcccgggttcacgccatcctcctgcctcagcctcccaagtagctgggactacaggcgcccgctaccacgcccggcaaattttttgtatatttagtagagacggggtttcaccgtgttaaccaggatggtctcgacctcttgacctcgtgatccgcccgcctaggcctcccaaagtgctgggattacagtcgtgagccaccgcgccgggcctggaattcttgatgctttaaacaaaacttaacatcttgcctgacatgtttttgtagcccaacaggataactaaaacgccagcattaaaactcagtccctggcaagatgttgtctgtgatctccttcatcttcacgacaagatcatctagggttgtatgctgaggttagcagcagagtctcagtggagtcgaccctgcaggtgggaagccacacttggaattcctccatcgtgcttagttcaccttgaggactaggtagctatctaatggcagaatggtttcaaaacccaagtatctgtgaagagctttctcttttgtgaattcttcggtccagctcagtgacttccaactgttcgaggggcatagttatgacttaaaatgattacatacacaagtacatgcacactctataaattatggttgatttaaaggaatctcaggagtaattttgaccacaaataatttttcctcttctgtactaactatggaaatgaaatgtttgtgtaatatatgatttcattttgccagaatatatgaatacttctgtgaaagtgtcctgaaataaatgaaatgctgtctctgcaaaaaaaaaaacctaaaaaacaaaaacagttctttggctgtgacatggacatgaataaaaaggttataactagcatcaaattcaagcatttggttttattgcttatgtgaacacagcatggaacatcttttgattcacgttttccccattcttagtcgtgttatctgttcgtgactatgcaagtggttttgtctctcagggacatttggtcatgtctggagacattttcagttgtcacaactggggatgaggaaatggtgctactggcatctggtgcgtagacttcagggatgccagtaaacatcctgcagtgggcggaatagccctgcatggtagagaatgatccactctagatggtgtcagtgccctctaaacattacgtcctgggctgtacccactctctggatgtgaaaatggaggcctagggaggctaagcacttatttattatttctttgtagttaaaaaaaagtccatcttgttccaggaaggaacaatttactttctaaacatgaggcataaaacagaaataactaggaaatcggtggaaatgtgttttcatggggaccgtgtagactgaggacaaattttcaggcttctatttgtccggtgaggttagtgcttgtgcgctgggccaagtcaacatcctcttagcggtgtcttgtctccttcctgatttagaaaaggcaaacccacctgctgtcatgaaaaataccttctagaagctaccgggtaattgggtgatatttctggatttgtctccctgtctaatgtacatcagttaaacttttgactcttcagtgccttctggagaaagtaataatcggaaactaaatcgacttggttttttctctccccctttgccccgtatttgtaaagattaatcttcagtatctatgagtgctgggtgatttgcggaaactgcagctgctttgtcaatatcagcttggcctccattgatcaaaccctcatttaggcgttcactgccgtctgctggaaacagcccagggatgaggagggaagggaaaaggccacttcgggaggccaccttgccttggagtttccgtcgttttccgaggtgagcttggatgtcactgctcagcacagttgattaaagaggttggtgctgtgagtgagtcactgtgtgggaatcaatcccgatggtggcagatatgaataaagcgtcggtgtaactgtcctggctggattgtttttctccgtctcaccatactgttttccctctgcacgtgtctgtgacctccggcaggcttgcagataaaagtgatgcatcttcattttgtcggaggagttaattttgtgtgtattccaaggtaagatgatactcacggtgcttatatcttgggcacccactgtgcattggacactttccataaattaactcaaatttttcttagcagcttgctatggctcttcactgtttctccaattcgatttacaaaaccttgatttcagtgggatccctgtttgctcttgcaaactcttcactcaccacctgctttttgcccactccacttcagctgccctgaactttgtgttgctggaattgactttgctcactcacacctctggtcctttgcacatgctgtgccctgggcttagtacatttcactttcatcctcttaacctcgttcatatcttgcttgggacaacagatacggctgtaagtatcagaaaactctattatcatggcttgaaggtgcaagggtttatttggcttacacaataagctaaacagtaggcaagccatgttggtagagtgaatcaaagagaccatcagaaacccccacttttttcattttcttgctctgctgtgcaatttctatcctcatggttacaaaatagctgcttcatctccaggcatcacgtcagcaggcatagaagccaagggagggcagcaagccagaaaactaaaggtgcgctctcccttcttttcactggtcacaactacgtcagatggccagccctagctgcaagagatgctagtgaaagatgatttttagctggatacattgtcgccctcagcaaaataaagatgcatttttcttattagcagaatcctaacaattaagattcagtgctcagttttgatgccactcagctgagtggtcctccctgaatccctgtgacagagttgggacacacaggtattaggcaatctcatagatggcattggagttacatgaaattgtggtcttgtttccctatctggattgaaagctccatgaggaggacttggtctacctttcacacagttgtatctctactacctacatagttccagatatatagtagatgctcaataagtaataaatgaaggagttacatgaaattgtggtcatgtttccctatctggattgaaagctccatgagaaggaggacttggtctgtctttcacacagttgtatctctagtacctacatatatagtagttctagatatatagtagatgctcaataaatacttaataaatgaaaaatagctactattttgcccctttgtagttgacacctagagctttagggagataagataacttgccctaagtaacacatgtactccttaattcctccattcagtaatgtttatagtgcaccttctatgagccaggtcttgtttcagacacttgggatacatcagtgaacaaagcagataaaacgactgcctttgagaccattatccctaatattttattacaaaaaatttcgcacatacagcagagttaaaccaatttcatagggaacacgtgttcagttactacctaggttctaccagtcactggggcacattgataccagtgggggaaggcacacagtaaaccggaaacaaaacaagtaaattacatggcattgtagaaggtggcaactgctatgagaaatacagagaaggtaacggggtgtagggcgtgcagttcggggtggtggtggtggccaggcttggcctcattgagatggcgacagttatgcaaagacttgaaggacatgagggagcagtgtcgatattggagggcaaagcagttctaggtggaggcaacagccagtgcaaaggtcctgaggtgggaatctctgttccaggaggggcaaggtggaatgtgtggttggaggaggagcgttgatggtggctgggttagtagaggaggaggagtttggggaaaaagatcaagggaactcagctttggacaggctatgcttgaacaactcaggggcagagctgggatttagatcccagacctcacaaccttcctgtattagggttctctagagaaatagaaccagtaggatatatatgtctatttattatatggattgttgtatgcagttatggaggctaggttccatgctctgccatctgcaaggtggggtatgaggaaagccaatgacattaagtcccagggtaagtctgaaggcccaagaaccaggagctctgatctccaaggtcaggagaaggtgaatgtcccagctcaaatagaaaatgtacacttcctttgcttttcgttctgtttgggctctcaacagatgggatgatgtctgcccacatgggtgagggtggtcttctttttttctttttttgagacggagtcttgcagtgttgcccaggcccgagtgcggtggcatgatctcggctcactgcaagctccgcctcccaggttcacgccattctcctgcctcagcctcccgagtagctgggactacaggtgcctgccaccacgcccggctaattttttgtatttttagtagagatggggtttcgccatgttagccaggatggtctcgatctcctgacctcgtgatcggcccaccttggcctcccaaagtgctgggattacaggcgtgagccaccgcacctggctgagggtagtcttctttactcagtctacagattctaatgctaatctcttccagaaatgccctcatagacacacacacccggatgtaatgttttaccagctatctgggcatcctttagctcagtcaagttgacacatgaaattaaccgtcacactttaccattttgccaacatctgtcccccagtcattcaaagacactgtgaccagctggccaggtggcaagaattcctagggcacaagcctgaagccttcgggagaaacttcagctttacagggggcagaatgtttggtaactatttagatttaaagcagaagcactttggattgagcaatttcatatgtgacaactgtctttgccacaagcaacagcagagacctgcagatgagaacacctttatgaagaacaagaccatgctttgaagttgggcagagatcttggttcaaatcctggctctgctgcttgttagctaagtcacttcaggtaagcgatttaacttctttgggccttgctttcttgatctgtcaagtggaggttcataatagtatcaccccttgagggcagataaactgatgtatgtttatgcatacataaactgatgtatgtgatgtaatttagcacggtgctggtccacaggtgaatggagatgatttttgactttctgtctcgcagaaagtctgtacctccccaaggacatctcatgcccacagcagcccagcattgagtcctcaccaacccagactgactttccagcctcatatcctcaaaggatctgacattttccagccaccaaccttggtttgcactatgcccttcatcaaaaatgtctttgcttctctttgatgcctgggtatctattcctttagaacccatttcaaatttctcctccttaaagatgccgttggtcactgttccaatctgtaggatactctgttttgcccagatcccttttgcactgccttctgggactcagatacagagggggcaaaacatcccggaaggggtggggcccatggactgctcttggagtggggacagagatcaccacgagatggcgctattgagccatcactgtcaactggtttttctctgttttcattttcttacttgatgagaaatgtgtgatttccaaatagtcccagaaggaatagaactgtgactgtgtcccaccactaaaaaggtggttttgcatatctctgatcgtcctatcacatcgcccactgttaaaaattccatccccacatgcaggggatttagaaggagaatatcacacacttgctaccacccccaatccatgcaaataccttggtacttgctatagacacttggtacacaaatactgcctcagtcttttattaaattatattttatatattgcatcagagtattaagcccttaagggtaggacctggggtccatgccaacttactagaacggtgtcgacttctctaggatatggaatccacacagctccttggaaagctggaaaatgcagttttgaagcaaccctgcttcatttccacaccaatggaaaggaaagtgataaatcctttatggccaagagtccgttctgtttatttcttcctggaaatgctattgatggtggctggggaagttgtttgttttttaatctttcccttggcaaggtctccttactcatagcccttccttatgttccccaaatggtgcagggggcagtgttcagaagcccagtatgcaggtcttgcacagaggagaattatggcttaaagaaacttggctaagtgtggtggctcacacctgtaatcccagcactttgggtaggtcaaggcaggccagatcgcttgagtccaggagtttgagaccagcctgggcaacctgatgagaccccatctctacaaaaaattagccagggatggtggtgcatgcctgtagtcccagctactcaggaggctgaaatgggaaaattgcctgagtccgaaaggtggatactaaagtgagccgagattgtgccactgtactccagtctaggtgatagggtgagaccctgtctcaaaaaaacaaaacaaaataaaaaccaacaacagaaaaagaaacttgggtgggatcatgtgtccaggcctcagcactgttgtcccttactctaactcctgcagagaggtccttgaacagacgtaagcggacacaccttgaagtcaaggtgctctttgcaaagcaacacaatgttattgacatattccatttgaataaccaaattttgtagttgattgtgcgctaaggtggatacgcattacattatgttcttatgtagggaagtagaagttagtgccgagatttaaagaaaaatcagtggggaaaataacagttgaatcttatttgtttaaaaacttaggacttatttattcttctgtccacccattcatatatacatttaacaaaagtatttgaaattagttttatattgctatttattttaaaaataggtattatacacgtatggctcaaaattggaaagatacaaaagagtgtatagtaaaaggtagtttccactcccatccttgtcctaaccagtttgtttcttcacagaaatggcaaccactattgatagttttctatgttccccttgagaaatattctatattgtaaatgtatattcatgtattcatttattcacccatctatccatttattcatctacccatccatttattatctagccacctatccatagatggatccatttatgcatccatcaatttattcatctatttacccatccatccattcatccatttatccatccatctatctatttactttccattaatctatccattctttcatccacttatccatccatctatccatccactttgcattcatctatccattcattcatccatccatttatccattcattcatccatttatccatctattcatttacttacccatttatccatccatctatccatccacacacacatccatttatccatccatccatctattcactcatccatccatttatccatctaatccattcattaatccatttacccatctatgtcatttttttccaggaagaggaaaagggcagccattatttggttttagatggtagaccaaatttgtgctactgttccactggaaaagagatttggaaccactccttggcgttaagccagccactccaaagctgtagtgttgcaatgtcatacatctgtcagggaaggctgaacattttaaaaacaattgggtatggccattcagattttattttggcccagcataatgagtttgtgtttgattctgaaggagagggagatttgtaataaatcagcaagtgaaattaaaagtgagccagtgaggtgccataaaagggtggttggaatcagacattctcaaatccatatcctatccccacccatgttaaaagctatataggaggttatttaacttcttgggagtctcaattttcctcttatgttctgagatggggataattgtatttttctttgcaggttaaaggctaacacaatgcttggatatagtcagtgctcatgtggtaactgcccttaacattattaagcccacataattctcttcttttttgtaagcagttgagatctttaggttgaagattcaatatacaatgtaacagagtcagagggtgggtggcaaaaggtacatacatactgcagggcagggacttggagtatggaatggagaaatagcagaggacatcttccagctgcagttgggatgggtgctgagctacaaagctactagagaaataggaaactcaggtctcatcattgcagggacccttgtttcctgcaaagaatccttggagaaatctctcccactgtctctgggcattgtattcagaaatgtctggcctggatgatagtcttcctgcttttggcctcaccctctatccactgtcctctgctgaatctttctaaaatgcttgcttaaaactccttatctccttcaggagaaagttaaatcctttaccacacaaggccattacctgggggccctttctaactcctcccacctcaattttgtcctctttctgcaggtatctaagtgtcatgatttagatgtcctggcatgcactgtgctctttttctggaagcctcctttctttcttcatccaactacctcctcttcttccttcgagattcagctgagactctcttgagcaaattttccaagactccttaaggggaaggacctggtccaagttgacttggtgtctccgtcatcaagcacaatgcctggttcacaatggattcttcatgcatctctttctacaagatgagaaggatcagagggtgaggattggagctgggtgtcttaaaaatctgtgagagtggaagctaagccagtgatgtttgctttgtaagctattcttgtgatattacaatccttcagagtggtgaggttggtgggagtggtaaaaacaaacaaacaaacaaacaaaacctagtttctttgtcttggattttcctgtgtcagtttatagagagagactatccatcatattttattttagcttaaccaaagtcctactttttgttgtttctttttttctttgctgggatcttaaaagagattgaataaaaattcagttgtaggaatggctttaccttcctctctggtcttgttgttttgtttttagactatgatatcacatgtcaagactatgatatcatatcaggactaggatatcaagtttataatagaacaataattatgtattatttaaacttattttcatcaaactataactaatacacaatggattttttaatggtatatacagatatttaaaatttgaaataattttagatttatagaaaagttacaatgatactatagcaagttccaagaaatcccttctcagtttcagtttttcttaaattttgttgttgttgttgagacggaatctcgttcgatcaccaggctggagtgtggtggcacgatctcggctcactgcaacctccacctccttggttctagcaattctcctgcctcagccccctaagtagctggcactacaggcacacgtcacctcacagctaatttttttatttttagtagagacgaggtttcaccatgttggtggtcaagaccaccaggctggtcttgaacttctgacctcgtgatctgcccacctcggcctcccaaagtgctgggattacaggtgtcagccattgtgcccggcttctttaatgttaaaaaaatgttaatgtctttgtcacaactttggaaactattaattgcattccaaattttatttgaatttcaccagtttttctactaatgtctttttcctgtccaggattcaatccagagtttcatgttgcatttattctcacgtctctgtagtctcttctggtatggaacaatttctccatctttccttatttttcatgatcttgatagttttgaggggtactgggttagggattttgtagaattggacttggtgattagaacctaggtctggccgcctacccatcacagtatcagtaaaagcctcccttgaaattgaccaatggcatgaacatttcagatgagtctgccatctttggtgctcctgggacacgagagagacctgtcttggagacagagacctcacagactcagagattcaggtgctttttctggtaatgattttgtctgcgggctgatcacaaaggtggatgagactttggccaaagctaaggctgcagggtctgggctaaaaaattccagaaaaactaccttgccatgggaggctgagttccaaatcgcagcccgcgtgcagcctgctttaccaaataatgaggcactgggtgctttttaaggcagctgacctttggagcaaattatccaaggaaatctgattagctagttcactgggttcctgcaaaatggagcttggtgtgtttctgcagcagaaatgtcagcataattggagtttctggagctcaaagagcttctttcttattgtttccatcctttggaggaaaaaaaaacaccccaaacaaacaaaacccaaacccccaaagaattgttctttgacttacattctttgcttttgcacatggttcagaagctgctcctgactgtgtttacgactttattaatcaggggaacagcccgaacatcatttaaacaaacaaggccaaaaaaaaaaaaaaatccatccctaaacagatgatgtgagcttaatagagatggccaagccaaagaccttaaataaataaactgactttaatttgtaggaaggagcatggggtggtcattacttgaggctgtgtgccatgcgatgtaaccaaatttgaaactcgctaatttcattattttaatggaagtctgcctcccattcattaggctgacatatgactagccattagtaacagtccatttccaaagctatggtggataaagggtgattggaaatgagcgagggccaggcctggtggaggctggcaatttcagaagggaactggtgggtgggatttatgcaagaggcagggaacacaactaggaaaattgtcaatgtggatggaggcagcaaaccattgagtccaaatacaggcttgagagacctgggtttgaattctggttctgccacatactggctgtgtgaccttgggcaagttacacccccgcactgagcttcagtttgctcatctgtgagatgggagtaatcatagttcctatctcgtagggttgcttgcaatgactcaatgaggcaaattcttaggaggctctagtatagggcttggcaaaagtaaccacttaataaatggtagctatgatgatgataacgttggccaaagtccccagtatttagggacttggagattttgctaatgaagaaatgaaggctgacagaaataaagtaaggtatccaagtttgccccgaacttggactcaaatttctgattcttaatcctatactcttaaaaaaaatcctatactcttaatcctatactcttaagacccgtatttttaaaattgtttcatttcttgaacaggccagtaattcatatgattgaaaaatttaaaaacaagagtatgctagaatagtcagtgaaaattgtcccttctgcctggaacatttccttttcacagacagccattgttacgtgtttcttctttatctttgcagaatttcaggtacgtacaagcaaatacaaatgtatatgcacttcttttttttttattacacagacagttctgtatcctgccttttaaaacttatatcctgcttatctttctgtatcagggtatagtgagttctttcattcttacttataattatatgtttttctattataatggctatattatgtcttatttaattatttctctcttgatgaacagttgggaaagttctcatcttttgctattacaaaccacaatgcgatgaataacattgcatgtatgtcattgtgtacaggtgtacgtatattctaggataaatttccaaaagtagaattgctgagttacagagtgaatgcatttctgattttgatagtgctcaaaggtctgggggcacatagagatggtgctttagcagtgagcttaggctgacagcggttaagagagacatgcctcaggttgccagttaaaaaaaaatctgcataatgtgttgcttaaagaatgtggtaaggtgaaagcttggaaatactggtgtcattggaaagacagaaataagacagagattgtgttgggaagagaacacggaatttcgagtaatttctgcctgggtttgcatcttgaccctgccactcctggctgcatgaccttgggcaggttgcttcacatctctgagctcagtatcctcacctgtaaaataaagaccatgataacttccattataggctgctggaggaagtaaaaaagaaaatataaacagcagttagcatgatgcctggcacatggtgtgcattcaggatataactggggcctttgggtgagtaaccaagttcataatgactcatagctagctaacattattatattatatatactatactgtattagtgggaaatagctaacatttattgagtgtttactgtgtggcacgcactgtgcttactgcctcccatgaaacattccacttacctctcataacaactctgtgaagtattcttgctcacctcagcttacagatggggaaacggaggcaggacactcaagtactttgtctgttgaaacactgtgaacaaacgacagagcttatatttgaactgaagccacttgtcttggagggctcctctgatcccacatcctgttctttttttttttttttttttgggagatggagttttgctcttgttgcccagtctggagtacagtggcgcaatctcggctcactgcaacctccctctcccaggttcaagcagttctcctgcctcagcctccggagtggccgggattacaggcacccaccaccacgcctggctaattctttgtatttttagtagagatggggtttcaccatgttggccaggttggtctcaaattcctgaccacaggtcatccacccacctcagcctcccacagtgctgggattacaggcatgagccactgcacccagcccatcctgttcttttgatccacgtattataacataagaggctgacttattctgagacaaggacatcatgggtggagcccccttctcatctcggtgtgacctagttcagcttccccatctcttaggcagataccattgggttcagaaaggttcaaggacactttttctcctcttagcttagtgcttcctcaagtgatccatgacttatgaccttatgacgatgccgtgtggtgagtctgaaatcagatgaagatttttatcccgacatgatgaacacaagcattgcataacctgactcgggttacccaggatctttcctctgcttgtggtcaccactgctaggattttggaagaaccctttaaaaactaagctctctgaggacaggcatttttgtttggttcactattgtgatgccaatgattagaaaaatgcctgggcccataggagggactcatgttcaatgcagaggtggataaatgagaaagagactgtttgccgcagaatactaagagattttattgttcttgtcataggaaccaggcaatattccagacacacatgacatcagtaacatccatatgtctgtgatggggtaggagagaagactacttttcaggtgggacattttgattggagagggtctctgattcagagagtgaggtgagctattttcttcttgggagttcttggcatttgataatccttggtgtttatttcaaaatatggaagaatttgagatttacttagacatcttggcatgcagtgctaaacctcagacttcctgaatttatttaccagctaggggaagcatattcccaactttaattgtatttacaaagggctctaatctggtgtgaagtctgaaggcatatttgttgtaggagttactcaattagccagtgagaaaagaacaaaggaaaagtcattatgcagatgtatgcccattcaaatctattccgcctctagatgctttcttcgtagtgaagggaagaactccagtctgcaagtctctcgtctctgctgtgttttctgctaattctcttctaatattaggccatgaatgattaataatattgcattttgacactgttagattttgtcaatttttttcaatataaaagcagataattacagattactttaacatccaggaagtgaaatcaaccatgaattacactcagactcatccacgaccccttgaatatctgtcttttttttttcaataggagattgaagtttctttagtcaattacacaagtcatgtctgacaattgagaaaatgctgttcacataaaacatcataaattaaaaatatacagtgtttatattttaatacagtagggtcccaggattcaaacaaagaattttgatctcagaggttgcattatgtagttatgtgttctgctttaaagaactatactggaggtaaacttgaaactgcctttgcagaaattataactgaggaaattatgacagtgaaagagatcagacctaaccaactacaccttttatctaatcttaaagctatccttattcattcctgggcataggccgaaataaccttgggaaggaatttagtttacagtttgactctgaaacaaaattgataatagccgtttcctgaaaagacctccttcttgcctggtgaccagtctgcctttgtaggactaacaaattggctacaagattggaaattatggtttaggggtcatgcagcccctgactccaagagtctgaacctccccagattgctcctagggatagcgtcattattgtaaaacttaagatcagtgcttgagatattttgcaaaccctgcactcagtggatcagctgacaccacccagactggtaacttggctcccagttctgccatcccacccaggaacagaagaccacaaaaaaacctcacttcgaccccctatgataccatctccaacctgaccaatcagcaccacttcctgagccgctacccaccaaattatctctaaaaactctgatccccaaatgctccaggaaggctgatttgaataataataaaactcaggtctcccgcacacgtggctccgtgtgaattactgtttttccactgcagttcccccatcttgctaaattggctctgtctaggcagggggccaggtgaacccattggatggtatatttctcaagagtcaaatattaataggtttaacatgtaagacttacatatgtgtgtgtgtgtgtgtgtgtgtttacatatacatatatttcaatagcttttggggttcaagtggtttttggttacatggatgaattataaattatatagtggtaaagtctaagattttagtacctgtcacctgagtagtgtacactgtacccaatatgtagtttttgtatccttcattcccttttcatcctctcctcttctgagtctccagtgtccattatatcactctgtatgcctttatgtacctatggcttagttcccacttataagtgagcatatatggtatttggttttccatccctgagttatttcacttagaataatggcctccagctccatccaagttgctgcaatgacattattatatcattattttttcatggctgagtagtattccatggtgtatatgtaccacacattttctttatccactcattggtcgatgggcacttaggttggtttcatatcttgacagttgtgaatcctaaattttacgtgcaaggttttgcatctgtagaggaagacaggattctcagtgcatgtgccaatttttgggttttccacttgagaatcttcaccagttttctcttcagaatcaaattcctgactatctggtgcttcagagttatccagaggttcatcattcagtctctgggttgcctctgtcatatactgtactctgccgcttttgccaattgtttactctccttttccaagtggtcaatttcattgttctttcttcaatttctctgtgaagcctctcattttccttaagtgtttcatagagggtgttcctttgttctgctacttctctccaatattgaggggataaatttcatttaatcctaaaatcaaatgcttcttgggtgactcctccaagattttaattgtcactctattctgggacaatgacaactctagagtgggaagtcctggctgtcaactggtcattccaatgcttcctcttggatatgctttgggccagtcacttttttttttttttttttttccgacaagagatctggctgtggaaggatgaatcatcttcagagttcttcttggggagaaactgttctttacatctttgattcctccttgtttctactttatcctaggattcattatacagctggtaaagcacaaaagatgggaggagaggattaatgatcatagtgaattcaggtgactgtggcacagccaacctacattgatccccactgtcgctggagtggctggggcacactgctgaaaagacttactcctcttgaacatactcctttgagtagtttttatatatgtaattttgcatatttttttcattttttttattattatactttaagttttagggtacacgtgcacaacgtgcaggttagttacgtatgtatacatgtgccatgttggtgtgctgcacccattaactcgtcatttagcattaggtatacttttaatcgtagtgccatacaattgtattgcattttccatttatagcatattataattattttgacttttattatgaaactttcaaacagaaaagtagatagtataataaaataaaataaaaagtatatatataacaagtatgtcggctgggtgtggtggctcatgcctttaatcccagcactttgggaggctgaggcaggcagatcacttgaggtcaggagttcgagaccagcctggccaacatggtgaaatgctatctctactaaaaataaaaaaaaattagctgggtttggtggtgggtgcctgtaatcccacctactcaagaggctgaggcaggggaatcacttgaacctgggaggtggaggttgcagtgagccaagatcatgccactgcactccagcctgggcaacagagcaagactccatctaagaaaaaaattatatatataacaagtatgtaaacaaaatacataagtaaaaggtagaataaaaaaagatagcataatacacacccatgtatttattgcttagaattaacactaatattatattttctttgtgcattttttttcttaagtggttcaaaagaaagtacagacatcatgatattaaaccctaaatcagtggctctcaactgaggttgactttgacccttgtcctccgcaagaggacttttggcactgtctggagacaatgttggttgtcacaaaaggaagcatgcctgcatccctggtagagatcagggatgttactaaacatgctacaatgcacaggactgccccctccaaaacaaagaattatctggttctaaatgccggtagtgctgaggttgaaaacctttggtctaaatgattaagaatgcgtttcttaaaatgcaaaatttcacataaccacatagcaccatcacttctaacaaagagaaaaataactctttaaaattgtctaataaccagtccatgtttccccaccattccactaaaatgttttttacagctggttttagcaaacactttccattttattagcactgttaatagaatctcactctaaatgactacagaatagtctgttaaatggattccctgaaatttattcaaaggatctatttttggatattagttttgcttccaggttttagacaaattatatttttgtaaataatgagagtttacttcttttctaactttgtgccttttctttcttttatttgccttatgttctggctaaaaacttcagtaaatactgaacacagcatatgagagtgggcatccttttgttgttccagattttaggagaaaaagatttaatattttattaagtatgatattaactgtaggtttttaaagatgaacgttatcatattggagatggtcccatctattcctagtttcactgagcgtttttatcataaagaactaatgatttctgtcaaattttttttctgtgtattttgaaacgatcaaatggttttcaaactcttactctgttatagtatgatgaattatattgattgattttcattaaaccaaccttgctttcttggaataaaccttgcttggtcatgatgtattattctttatatgtatgtataaatatatatctatagatacatatacatatatacatatatctatctatatatatagatatgtatacatatatatatagagagagctggattctgtttgcaaatatttggtttagaatttttgtgcctatgggctgggcgcggtggctcacacctgtaatcccagcactttgggaggccaaagagggcagatcacgaagtcaggagtttgaaaccaacctcaccaacatggtgaaaccccgtttatactaaaaatacaaaatttagctgggcgtgttggtgggtgcctgtaatcccagctacttgggaggctgagtcaggagagtcgcttgaaaccggaagggggaggttacagtgagtcgagattgtgccactgtgctcctgcctgggcaacaagagtgaaattccgtgtcaaaaaaaaaaaagaatttttgtgcctatgttcgtgagggattaggctgttattttttttacttgtaatagctttgttatattttggggtcagggtgatgctggccttctatattaaattgggaagtgatacctcttcctctatgttccgaatttgtgcattattgatatttctcccttacatgttttgtagaatttactaatgaaccatatatgtggaaaattttctttttagaaaggttttacaaatttaatttctttaatagccatggggttatttattttctgtgtcttcagttgttagtaatttgtgatttggattaattaatataagttgttgaattgttagaatgttttaatatttatcctttttaacatttttagaatatgtagtgctgtttcatttttatttatgtgggcaatttgtgctttccctcttttttttgtccattgttgttaagactttgtattgccactttactattagtatttcctttcttttacttgctttagatttaccttattcttctttttctagcttcttaagatggaaggttgtatatacctttcttctccagtgtaagtatttaaagtcataaattttcttctaagcactgcgttagctttatttcacaaattttgatatattttcatattattcagttcaaaatattttacagtttcctttatgatttcttttttgatctatgggttatttaggagagggttgttttattgcccaatacataggggatttgctagatatcttattgtgaatgattttattctatcgtgttactctgtatgatttcattctttgatattcattaatacttttatatgatccagaatatggtctattttactgaatgttccatgacaactttaaaagaatgagttttctgcagctgttggatgtagtagtttaaaatattatgtcagtttggtttacagagttgttcaaatagtgtttactgaatctttgatctgcttgttctatcagttataagttgagcatccctaatttgaaaatctgaaatctggaatgctccaaaatctaaaactttttgagtgctcagagtaaatgctcattggatttggagcttcatattaggaatgctcaaccagtaagtataatgcaaatattccaaaatctggaaaaatccaaaatccttctggtctcaagcattctggataagggatgttcaacctgcaccaagagggtttacattctccaactatgattgtgaatttttttttatttctcctttcagttctgtcagtttttcctttgtgagttttggaaatgtgttgttaggtacatctatattcatgattgttttcttctcaattatcctttttttattattttgaggtattcttcttaatatccagtcatactctttgtttaaatgctacattgtctgatattaacatagtcataccagatttcttatttttggtgttttcatactgtatctttttctttccttttactttctattggcctgtatctttataataaaattgtgtttctcaaaaacaacctatagttgggtgttgcctttcatatccaatttactaagctctgactttttcttagaggagttagtccatttacatttaaggtaattattgatatgattcgacttatgtctcccatcttggtatttgttttatatttatggtatttattctttattcctttgttcatttttgtcttttcaggggaaaattaagtattcttaatattacttttatatcctctgtggatagttagattatatttcctttttaaaaaatttagtggttactatagaaactacatgtaaatgttcacagtataccttcaaacaatgtttaacctaattcacagtataaaaatcatgctgcagtataattccacttatgtccaatcctgccttttgtgctcttgttatattctgtgttacagtgacacatatggtattaatcctatcatacgttgttattatttccagtctacactgtaaatagtcacttaaatatttgagaaattataaatgtaaaaataaaagtcaaaaaaggtcttttccatttatacaaatatttaccttttctggtgtttttaattcctttctgcacatctggggttccatctgatataatttccctcagcctgaagtatcagcaagtatctcagattttgtctctctaaggatatctttatttcatcttcattttgaaggatattttttgctagacatagaattctctgcttccatttcttttttcttgtcatactcaatgatgtcatttaattgttttctggctttattctagattctgatgaaaagttagccatcataaatttttttctaatgtatttaatgtgtcattttattcctattgctttttagatttgctgtttattgttttatgtgatttttggttgttaaatagctaggtaaggttttctttatatttatcttgcttagggttcactgagcttcttggctctacaggtttatgtctttcatccattttggaatgttctcagatggttattattatatcaaatatattatctatccagtttttctcttctctttctggaacttctattacatcacttgatatcatgttagattcatttatactgtccaacagatcttgaatattctgttgtattttttccactatttttgccttttgtgtttcagtttggatactttctattgatctgccttttgtccctgatgctttcatctgttttttttccagtgtgctgttaagcacatctgatgttattgatttctaatattgtatttttcattgctacttatcccatttgattttcttctaacatttcctggtgaacatgtctttaggaaattttccatttcttcatgcatgttatctatatttttcgttaggcttttggcatttttattatagttattttaaattccctgtctaataattccaacatctgagtcatctgtggatctgtttttcttgattgtttctactcttaactataggccacttttttgttgttctttaaaaaaatattaatacgtcttctaatgtttgattgtatactgaaaattctgtataaaagaacagtagagactaaagtaaaaaatatttacatccaaaagagcatgcttttgataagacctgtagtaaatctctcctctcctctaaaatgatcttcactttgtggaatttagttcatttggatttttctgtgtccttagttcactgaaggttttcttttttccaaatagctttgtagctcatctaatttgttttgattatttgcatgagaatggcattttctgttgactttctatttctgaattcaaagtagtatgcaaccaaatatgcttcaacaaagatgtgcattcaccaaatatttttttaaaaatttacaataatttccttaacataaattctagaaggtagacattgatcaaaatatctaaagattttttatggttcttaataaaatatggtcatattacatctcaaaaaaacaaggaagttatacctatttttaatgagtgcaaataaccattttgcttcataagctttaagtgttataattaatttgactttgctaacttattcaaaaaatattatttcatattacatacctttaacttcaagcactgtacaggatcaaaatcttatgttcattttttagcaggactgactttacctggagaataagtgaacccattaaacatcagaattgtttgagtagatagatggtaatgactgatatttattgagtgctttttatgaaaaaagtggtgttttaattctcacagtgacctgtgaagaaggttatcatttcatcactccagaaggagggtttattccctacagaggagaaaagagaggctctgatataatgggacaggattaaattcaggagaatctgagccccaaacctcagtcttccaactttgatgtgatttaaatcatatctgaatgcaaccaatattgctatctgtattagtcagctgttgctacaataatgccatataacaaacaccccctaaactcacacttaaaacaatagttttgtattctcattgagctgcagtttggcagtagaagttttgctttaaaactcccctcttagtcatttattgaagaaaaacataatgaatacctcttattttccaagcactcttctgggctctggagaaacaacaatgaataaaatacacataaatgctgcccttaggaaacttactttcttgagggaagagacatacagtaaataagtagactatatagtaagtaagatgctgataatttctttattttgtttatttttctttttctaaattggtttcctcagattgaagataatttctttctttttttttttttgagacggagtctcgctctgtcgcccaggccggactgcggactgcagtgggcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgataatttatttcttttgtttttttttttgagacggagtctcgctcggtcgctagactggagtgcagtagcgcaatctcggctcactgtgacctctgcctcttgggttcaagcgattctcctgcctcagcctcctgagtagctgggactacaggtgcacacaccactacacccagctaatttttctatttttagtagagacaaggtttcatcatgttggccaggatggtcttgatctcttgaccttgtcatctgcccgccttggcctcccaaagtgctgggactacaggtgagagccacagtgctcggccagattaatttctaatgacagctataaagcagtggaagaggagaggacgggctgtcaggtgaagaacagcaacagggattgctgttgcaatgtgctttctcttatcactgcgcttcctagcataccgccaaaccctggcatctctgttcatttttacaatgcagagctatttcactacttctttgtttcactgtcttcttctaaactgtgccctggggggcctcacatttcataaccaaagctgcctatcaaagtgttttgctaaagaaaatatatttagtctggagagaaataatgtctctcccttagggacagaagcagctgcagtcagtagtagttttagatagcatttttctcctctgtcacgcagcattgcaatctcttctttatttaaaagttgaaggtcagaggtgaagatgtgtggaaacttactgaggaaaggagacatttgcagagcacccactatgtgctagatctggtgcaagcagatgtcttcaaataatccttgaattagacattatgattcccattttcctaatgcaaaaactgagctgtatgcaggcaaaataatccactctcggacacaaaaccagcagttgcagatctaagttttaattcttgagtgtgtccttccagcctcctcccaaccaccttcttgttgctttggattggatgtagagagctgcttattttataatctttgtggctagacctggaatgctggctttgtgtttctgggcctctctcccgcttcatggctagtctgtgtggtatagcccaactgctgccccagtaataggaggaggcagtcaggtctggggggaaatgaaagaattcccagggcacccggcaaatgaatgaattccactgatcttgtttggttccttatgggatcatccatcatgatttaacaacttgcagcccagggtaactacaggcatgcttcttgcccaaagccacagacacagtgtaattcatggctgaaaaacagatttgtttttctgttattattacctgtatcatgcccattatactatattatatgctgtgttatcatgtaatttagtcctctgtctgccgcattgacgtttgcttttgagaagactcggcttttctcattcttttgtaatgcactaaagtaaacaaattccctggctgtaatgtaagcagatatttgttgagggcccactgtgtgtacagtagatgggatacagaaaagctctggttttgctcaggaaacttaccctcctattgttttctgcatttaattttatttttaatttttttctgaggcagagtctcactctgttgcccaggctggagtgccctggcatgatctcggctcactgcaacctctgctgcctgggttcaggccattctcctgcctcagcctcctgaggagctgggattacgggcaccggccatcacacctggctaattttttttttttttttttgtatttttagtaaagacggagtttcgccatgttggccagcctggtcttgaactcctgacctcatgccatctacctgccttggcctcccaaagtactgggattacaggcgtgagccaccatgcctggcctatttttaaattttttaatgcaatatttgaaacacagaaataatatatatatataacatgtaagttatcaaacatatcaacaaaatgaagacccataaaatcattgctgtcttagtccatttgtgttgctataaaggaatacttgagactgggcactttattttaaaaagcagtttatttggtgtatggttctgcagtctgtacaagaagcctgacactgcatctgcttctggtggggcctcaagctgtttccacttagggcagaaggggaagtggagggactgtgcacagatgacgtggtgagagaggaagcgagagagagaggaggagatgccaggctcttttcagcaactagttctcctgggactaagaatgagaacttttttttttttgagacaggatatccctttgttgcccaggctggagggcagtggcatgatcttggctcactgcagcctccacctcccaggttcaagtgattcttgtgcctcagtctcctgagtagctgggactataggcgcctaccaccacgccctgctaatttttgtatttttagtggaggcagaggttcttcatgttggccaggctggtctggaactcctggtctcatgtgatcctcccgcctctgcctgccaaagtgctgggattacaggcatgatccactgcacccagcccaaaatgagaactcacttctttgagaatggcaacaagtcattcatgagcaatcaactcccatgccccaaacacctcccaataggtcccacctccaacatggggagagatttcaacacgatgtttggaggatcaaatatccaaactacattaagtgcctaactgattgactaaaatgaccagttctactggatccatctgggtggaaagtgcctcttgcatcccccatcctatccccatgtggaaatctacaatcctgttttgtgtttatcatcccctttctttgctttgttagctttaccacaaagctttatcagttttgcttgcttttgagctttataaagatggtctcataccttaaataatttttttttttttttgagacagagtcttgttctgttgcccaggctggagtgcagtggcacgatcttggctcaccgcaacctccacctcccaggtccaagtgattctcctgcctcagcctcctgagtagctgggattataggcatgtgccaccatgcctggctgatttttgtatttttagtagagacgaggtttcaccatgttggtcaggctggtctcgaactcctgaccttgtgatctgcctgccttggccacccaaagtgctgggattataggtgcgagtcactgtgcctggccttaaataatattttaagacttgctttgttcacactatatggtttctaagatttattccatttttcttcatgcttcttttctttcttttctttaaattgaggttttttgtttgtttttgttttgttttcaaactctgcttttccctttacttgttggaattttaaaattccaaattcaaatattaagattctaaaaattctaaaattccaaaaatttaaaacctcttttctatcatctctcccttgaaattttattgtgtgtatcaaggaaaattgaaagcccataaatatcttaacttccccttccaaatactgtaaggactttatgatactttaatgtcaatgacttccccattacttaaatgtcaatgttgtcagtagtttcaatctcatcttaaattctcacaaatcagattgttactattaatattttatatagataatgttttagatttatctcctagtttgtaagcttacttgctaactattcttcttacactcgaaatttttttttctgggctatttttttttttttttttttagtattcttttagtgggaatttatcggtggtaaaaatctctcagtttttgtttatatggaagtgtcatcatttcacactcattcttaaaagacacatttgcctgaagcgcaattctagaatgatggttgttttcttttagaattttggagatgttattccagagtcttttggcttctgttgctttgcctgaaaactcaggtgatgatctaaatgtagtgtttttgaaggttatctgcccctttcccctgtgagcttttaagtcttctctgtctttgatgttctgtggtttcactgcaatatgtctagctatgaatttctttgcattcatcttgcttatatatgctgtgcttggacctgaagattttatgtgtgtgtttgtgtatatgattatctatctatctatctatctatctatctatctatctatctcatcatgcctcacttaacaatcgggatatgttctgagaaatgagtcattaggtgatttcatcattgtgtgcatatcatagtgtccttatacaaacctagatagtgtagcctcctacacacctaggctatatggtatagcctatggctcctaggctacatgactgtacagcatgttactctactgaatactataggcagttggaacacaatggtaaacctttgtctgcctaaacatatctaaacatagaaaaggtccagtaaaaatacagtattacaattttgtggagccactgatgtatgcagtctgttgaccaaaatgttatgtggtacgtgactgtattttaccatttttacaacatttctttccccctcccctcccttcccctcccctcctctcctttctctctcggacagagtcttactctgtcatccaggctggagtgcaatgacgcagtcttggctcactgcaacctccgcctcctgggttcaagcgattctcctgcctcagcctcctgagtagctgggactacaggcatgtgccaccgtggccggctaatttttgtatttttagtagagacagggtttcaccatgttggccaggctggtctcaaacttctgacctcaggtgatctacccacttctgcctcccaaagtgctgggattacaggcatgagccaccctgcccagcctttgcaaaatttctatctattatcacttttaatattgcctcttatccagtctctctattctctcctaatattatgtctaatatattagacatacattagtctgtttctttctgtcctctgtatctcctaacttctctttaatagttttaatcacctaatctatttgtgttgttgcaccctagataatttctttagacatatcttcaatttctaattctctttcctgctatttttaatctgaattgagtttttattttatttttcttttttgttatatatatatttttgagacagattctcactctgtcacccaagctagagtgcagtggcacgatcctggctcactgcaacctccacctcctgggttcaagcgattcttgtgcctcagcctcctcagtagctgggattatagacctgcgtcaccaggcccagctaattgaattgagttttttacttcgacagttatatatttgatttccaaaatttttatttgaccatttttcaactatacctcataatttttttataaacgttgattattttcccatttttctaattccatcttttatttgtttaaatattttaatcagaattattttatattatgtatctgattatttcaatggttccaatatctgaagtttgtgggagtaaaaatttgttgtttattaattctgctgattctcactcatggtggcttatttcctaatgagtttggtggcttttgattataagctcacagaggcttgatcttaatctatggaaattcttatgacccaagtagaaaatgctttcacacagggagaattttcatttgcctccattaggagcctgggacaccaccagcattgtcttccttcaaaataactagccttacatgggagtctcagattccccaaccttgtcacagtcagtgactagttgttaatttaatcataatcacttgatgtatttttttaatgtcacacactgtccggtgtgttccacaaacattatttctaacttgcaaaataatcttgtaaaccacttcactgttgaggagataaaagctgggggaggccttccacacaatctgcttctcacaattctcctacacttctacaccatctctgcccatcaaaatccctcccctccttctacaccgtcctcaaatgctgcctcctcagggacactattcttgagccacaaagctgagcttaggcttttgctcctgtttatttgtttgttttttgagacagagtctcactctgtcacccaggctggagtgcattggtgtgatctcacgtcactgcaacctccgcctcccaggttcaagtgattctcctgcctcaacctccctcccaagtagctgggattacaggtgcctgccaccacacctggctaactttttttgtattttcagtagagatggggtttcactatgttggccaggctggtctcaaacccctgacctcaggtgatccgtctgccttggcctcccaaagtgctgggattacaggcgtgagccaccgtttgttcctagaacacataatttatatcggtgattcaagtaatcatcccatttcacagatgaagcatttgaggccctggagtttcatttgtaggcatttgtgcggatctacctaaaatgtcatctggctgcaaggccatcgcttcagtgttatttttgcatttatccttctccatccctcctaggcaacccctagttccttaccttcctcatatacatacagaatgcaagactaagaggaaggattccaaaaagttggatacattaaatttaggtggagagatgaggaacatatggagaacaggccatcagcttagtgattgtcaggcgattcctgtcatcaatatgtacccccgtggcccatgttaagtcccttactcattgggactgccctggtcctccgttgacctcaggtaaacaatcatttaagtgggattttattcaaaaattgcacttagagtggttttagtgggtcacattggctcttccatgaattctttgcgtctttttaagccagatctttggcattttatcaatctttgctttggcatcacgtttgaggatatattcaggggattttttttatttttaaaaaaactcttttgtttattgacagaaatagcatttctactaatacctcaagagcaagtactatcatgaatttaaattatttttccccaaatttaatcaagagtacttgagttaccagcttccaggttggccagaagtcctgaattaccttattgagactttctgctccagttccagggttcttgtataattaggagtcctcacaacttgtactcccaattagggaaaagcgctggtatttgtcagcctgtttgggtttcctactgagagaagatggcactgttgaacacggagccagtgctgctgggctacaatgtagtgcgggctggtaactctcacggtaacccctcttagaggtcctgttctggatgaggtttgtttatccactcaccacggtccccacaactccaatgccttttccaatgacagcaggtgaatgagacctacccaggatcaggccatttttactttcagcccctgagagagaaaagaaattaatttggttctcttttctgaacaatagagatttattcgttctaaaaattctacaaaccatatccagcaggcaaagaatgcctggactttagataaaccaaaagggcagtcatcctttgtggcagagtgctaatttttctccagtatttattttctccttcattttgttagcagtagaacttctcaagctttcactctgtatgtgaccatctgggtagagactacctttcttagcttctcttgcaactgtgtgtggacacgcaactaaattactgcctccagggtgtgagcagaacggatgcgtgcagcttcaagtcacagcactggaaaggaaaatacttgcctttcattctctatttcctctttctacacgttggaatttgacggagttctggcaagtctacttcaaccatgtggatgaggacaatacttcagaggaaagaagaacattaaaatgcaaggaaccagatccctagatgactgattgcaaggggcaaagaaactatggcagccctagactatgtacctctggaccaatctgtgaaagagaagtagattcctacttggcctgagtcactgtgtttttggatctcttgtaccagcaactcagccagtgtcctaaataacatgcatcctccctagtgggactggagagcttataggttcagtctcactgatgatccaacctctttagagcaggcaagaggaatttcatgtacctcttgataaagcggtaagcaaaacacaaattcagtgggacactccactgcaggtgattttgaggttctgcagtctgtctatcaagttaaatgagaaaaaagaagatagaggatcctggctgcataatcacacatgcacggaaggcaaaatcatttggacgggagccttgagtggtggagaaagcaagggctctgagccagatatttcagagttcacatcagtgtgtctttataatttagttgtttaagtcactactttctcatctgcaaaatgggaattgcaatgcatatttcatgtacttgttccaggaactaaatgagataatctatttaaaggtcctggcacagggtctggtaaaaattaggtgttaagtgaaagtaagttcccttccaatgtctgggcttttgatcattgcaccaagctgcctctgcaaggcacacaagactctaggtgatctgattcctccctttttcaccccttcagcttcatctggggccacttttcccttgcccatgactctctgactcctaagcccatgactagtttcccttcagtaccaaagccattctaaattctctcctgcctctggatcttcatacttccttttccttctgcttgcaaccctttctcatgatcacatttcagagaagccctcctgaggaccacgctatctaaagtagtttcttgtccactgtgttcagcagaataatgacaccccgcaaagatgtggtttttatgaagacagaaacatctgtcttatttaccagctcacctgctacagtatggattatgtagcacatactcaatatttattgaatgcatatatgaatgaaaaattgaatgggaactttgaaattcatcctcatccctggaacccaagagtatgttaagtgacatggcaaagggcaattaaggcagcaggcgaaattaagtttactaatcagctgaccttagggagctattcctggaatatctggttggacccaaaggaatcataaagatctttaaaagtggaagagaggggcagaatcgaagagtcaaaggtaggagtgtgatgacggaaacaggtatgttactgcccttgaagatggaggaaggggccacaagccaaagaaagcaggcagcctttagaagctggaaaaagcaagaaaatggatgttctctagagcttccagaaggagcagccctgctgacatcttgatctttgcccagtgccttgatttcagctcagtaattttagcccatgttggacttctgaagtacagaactgtaagataatacgtttgtattgttttaagccactaaatttgtggtaacttgttccagcaacaataagaaactaatatacctgtatgccagcccagtatctaatatatatatatcgccctctttatttgctgcctaacactcagcacgatctgcaattatcttatccatttatgtgtcctcttgacttagtcaaatggggcttttatgaagacacaaatgtctatcttatttaccagctcacctgctagagtacgggttatgtagcacatactccttctttattcatttattaattatactttaagttctggggtacgtgtgcagaacgtgcaggtttgttacgtaggtatatacgtgccatggtggtttgctgcacctatcaaccacactaagtatttctcctaatgctctccctcccctagccccccaccccaccaacaggccctggtgtgtgatgttcccctccctgtgtccatgtgttctcattgttcagttcccacttgtgagtgagaacatgtggtatttggtcttctgtgcttgtgttagtttgttgagaatgatggtttccagcttcatccatgtccctgcaaaggacatgaattcctccatttttatagctgcatagtattccatagtgtatatgtgtcacatttctttatccagtctatcactgatgggcatttgggttggttccaagtctttactgttgtgaccagtgccgcaataaacatacatgggcgtgtgtctttatagtagaatgactccatatttttttaatgcatgcatgaatgaaaaattgaatggaaactttgacattcattttcttcatctgcagggcttgtttctgagagtgtgcacggagattgaagggcaggggctcatgtgacagtgtgaagcaggaattctgaccgttggccaaaccaagccctgaaactcaagttctgtttgggagtgagaggcaggttagaggagataaacacccagccttttaattttttttttccagcctgctttaaatcacctgtaaatctttagtggccaccaggaggtgaatgactcatgctaccttttctcagcaaaggctcttcaggatgggacactccaagtttttaactcccagcaacagttcggctcacagcgagaccgggccctctgctgtcactgaagtgtgtgtttgtttaattagggcgccgagtagagcctcatcctggtggcagatgttgccatgtgtagtataataaataaaagtctttataggacccagcaggcagtagagccttcagttagcagatggcgaaatattaaactggcagagcaataacttaactgcctgaatcagctggtccctgcccggatttgctccaacatgaatcaacttcatataggaggtgtcgctcagcctcagatgtgtaccctcacctgccctcgctcctggtccctgctaggaccatgtttgccttggcataccactattaaagtcagattactgggtttaataccattattaaagtcagatacataagtttttttataaccttattagctggtcaaagagaggtgcttgctgggctggaccgtagggttcttttacaggggaaggaaatgcagtaagcctgtggatgtcctctgtgccagtttctgcttggctccagattagccagacagtatgttacctggcccctgggccctcgtggtgcaggagaaggatcccacttggctccaggaatcctcctgtttaagaccaggaggatggttcagttagcccagggagaccccactggaggagagaacagggctttttgttctgaaaagacccaaaaaagggattgactgacatctattacattgctgcaggggtggagtgaggggcattggacttgtttactaaattccagattatacgactgatatttacagagggcttgctatgtgttgggactttggataagggctttgcagacgaacagaaacccaccccatctttaccataaccctgtgaggcagtaacaacgaacccttctagcgctgtgtgccaggccccgttccaagagcttaatgtacattgactcactcaactccccaacatgaaacattaaacccatttctcacatggggaagctgaggctctgagaggtgtgatgatttgttcaaaaacacacagctagaagataccggagctaagatgcaacccaattgtgtctaaactcagaggcggcagttgcctttgactccaggaggcataaaagtaaacttggacagaagatggtgaacccgtaggcaaaatgccacctagaaaatgaagtggggaactgatactaggaaagaggatataaaatttatatttgttgccatttattgccataaattcggctactttttaacagatatctgaaataattttctcctttaattcttacagaaagccttggaggcagcttcaattagaagctaattttactaattagaaaattggtatcagaaggacgattgaacgtgtccaaggtcacacagccagtaaggagaggggcctggactggagcagacctgtctgattcactcagacaggactggagcagacccttgctttgttcactcaatagttttttccaaaggctttttaagaagaggactttggagttgtaaagaatttagatacgtggaaatgagagaaaggccttccaggcagaggaaacaggatgaacaaagtcttggcaggtatggacaactctgtgtgtgtgtgtgtgtgtgtgtgtgtgtgtgtgtaggtaggtaggttggttgttggagacagacccagggaagccttgaatggcatgctgaaagaattggtctttctgcccgggcttggtggctcatgcctgtaatcccagcactttgggaggccgaggcaggcagatcacttgaggtcaggagttcgagaccagcctggccaacatggtgaaatcctgtctgtactaaaattacaaaaatatcagcccagcatggtggtgcagggttgcattctcagctactcgtgaggctgaggcaggagaattgcttgaaccccggaggcagaggttgcagtgagcagagatcatgccactgtactccagcctgggcaatagagggagactccatttcaaaaaaaaaaaaaaaaaaaaaaaggtgcttctttctctggcaaaggaggatgctcaagttttctaagtcaataattaagctcatgcaaacaaagggccctttctgatcaccatggtgggtttccactgcctgcttctccgctaacttctataacgaaaatgatactcaagacttttcttgccatcatggtcaataatgtgagggtttgagcacatcctcagagttaggctttggaatttcttgaattcctgctgtgtggggcgtgctggggagtctttggtctgagggctggctgctgctcgctttggccctttgatctcccagtgcccgggatctttcagtctagcttttcctgtgtcctgcattgccagtccccccaccctctggatctgtcccctttttgttgtctctgagctaatgggacagattccatggatgctggcctggacctctctttcttcagcctgtctcatgacctctaaggcctggcctgaggaggaggcataactctaggaggtcgaggtgagcctggcgctgcaagtatgcccctaatttgtgaaaccacagtcatagatatcacagttggttaatacactcgtccttggattctttcaaattcattgctcctgttcaaaaaacatttctctttttttcttattgcagtagtaatacatgcttattgtatgttatgaagaagatgcagaaaaatataagtgatgaaacgatagcccataataatcccacaaccccaagacaatcattattaaccttgggtatattttcttacagtcattcatacagacgtatacaaaacacacgtctgtctatatgaaatacttacgtgcttaaactcataccagatatatgattttgcattccatgtttccactcttataaaatcagtgcaatttttttacattgctaaacttctttgtaaaaatttatatagaaaaacactgtaggccaggcacggtggctcatgcctgtaatcctagcactttgggaggctgaggcgggtggatcacctgaggtcaggagatcgagaccatcttggccaacatggtgaaaccctgtctctactaaaatatgaaaaattagccgggcatggtggcacttgcctgtaattctagctacttgggaggctgaggcaggggaattgcttgaacccgggaggtgaaggttgcagtgagctgagatcacaccactgcactccagtctggtgacagagcaagactccatctcaaaacaaacaaaacaccataaaacaatattaaagggaaaaaagcagaatttgaattcatatgtttaatataatttcaattatgttagctaaaaacacatgggtacacgatgcctatgcactacaaaagtaccacacaggatggaagcagagactacaaaatattaatagaggttatctctaggggatgtgttttattttattcttgcatctttccatgttttccacgtttttcccacatattaatcatgaatttttctaatgagaaaattttgcatagctacataatagtccaagatatgaatataccattgtttatttaattattggcctactaaaggcctttgggtagtttcaaagcttttacatttataaataatgttgtgttaaatgttcctttatctgttcaacagatatttgagagtctatggcatgccttgtatcttggtgcctatatctgcatatgttatataaataatattttatttttgtggaaactgaagagcaaagaaatcaccgagttagttggggacacggatgggtctgtgcttttaggtctttcaattctgaggatttatctttgccagactgctttcctcaaacctctggtctccctttggcagaatggtggcaaattggaggttctcttgggtatattgagtcacagatctccttgaatagtgtgtgacactactcaagaagtacctacttggcccccagcctattgcctggtggcctccttcttgcagatgcacccattttgcagatgggtcaaagcatgtagtcttacagcacaaatacttgtctttgtggaaagtcatcctccctctgcttggctgctagactttcctgtgtgtccatcataggtgtggctttgtggcacccagtcaatctgattaagatggttcttgcttatcagcttggtgctatttgagatgatacattggaagtccacctcaaatatcacctcctccctgaaattatccagatactctcagacaaagttcacagctcttttttggatttttttttttttgtgtgtgtgtatggccttattttaaaaacatatctctccaaaccatggctgtgtctgtacatctttttctcatcaagtaggttattagctctttaaggtcagggaccacatgttatccactttggtaccctgtccatttgcttctgtttctcagtctagcgcttgccttcatctccactgccactattcaagtgcacaccttctatcaccacccacctagaacactgaaccagtgtccgacctgctgggactccctgcatctgctctcgtgccacttacaatccagttttcccatagcagtgaaagggattatttgaaatcacaaatcaaatgtgccatttctttccgtagctcagcaagatctggccctcgcctgcctctctgacatcatcccagtgaactcatccccattcctcacagcacttctctctgatcccttttatcacatcattctgcataacagtttggattattgcccagcaagtgttgatggcctccccgctccaattgtggatggtatttacttccctaccacatgattttgggcttggccatatgactcgttttggccaacaggatattagtgggtagaagtgaacagagatttgaaatgtgatagagtggttgggctcacctactttagttcttccatggccatgagggtaacatgccctgggtaacctgttggtcccagaagagtgagagatgcaaggaacagacatgaactaaacatatggcctggagccaagcccagcctagatcagccaaacccaggacaaaccatagttgcataaatgaggtacacatgcttgctgttgtggagttactggctgtatgctacccagcactgctgtggcatagttgactaacacaccctattttatgcacttcataattattattttgaactttccgtcttttctaatcaggacatagtttctatgataaaagagacattgcctattttgctctataattccagctatatatatgaaatcaccaataaatatgcatgtatgtgtgtatgtatgtatgtatttttgagacggagtcttgctctgtcgcccagtgacgcgatctcggctcactgcaacctctgcctcctgagttcaagtgattctcctgcttcagcctcccaagtagctgggactataggcacgtgcacctttttttatttttgtatgcctggctactttttgtatttttagtagaaatggggtttccccatgttagccaggttggtcttgatctcctgaccacgtgatctgccagccttggcctcccaaagtgctgggattacaggtgtgagccactgtgcctggcctgccaataaatatttattaaatgactgaatacccccggcatgcttagcacaatacctgtgcccgatcaatatttgctgaatgcagttggtgaaccatccaaagcagcctgtattgtgtcctaacatgtatatctttaaactcaacttggcacgtgggtgacacctctatcccctctcttcctctctctgatcacataaaagatcctccttgtaagaatacacacactgaaaacagatgatgtgtcaatgccgtaatttaaaccatgaatctgtacttgcttaaagatgaacttgtttggaagaaaaatgaggaaaatgcttgtgcccgtccaacagagtccccggataagtacatcaattttgcttcttagcggatccagcacataataaaagaaaactgctgaggtcagcagcagcagagaagccacacttcttattttcacaaacacagttttggggatggtaatcatatctattagcaagggtgacaccactgtgggcctggcagaaaaatgagctctcccgcattgcaaaatgagcaaagtggagatcgataaatcataaaattagttgagacatcatctatctttcatggctttccctttattcctgccacggtccctcaggacactcattcatttactgcattttattgttgggaaaacacgtcaaggtttggaggctgcattcagttaggggagcaggggccataatgtgtgtcattaattaggcaggtttgggaggttcaatccaaagtctggtctcaactgacttccataaattgagttttaggactgcttctgcgtcttgtgtgacttcatcaaaaagagaacgttattgaaatatgccctgagagggagagagagagaaagagggacatgtctgctcactctgtagaaacgataaatttagggacaaaccaggtgataagccagatgcaatctgagttgtctaaagattcttgctgttatctacatgtgattgaaataaatgtgagacacagagcttggagtgcatagatacgtcatctggtacctatattcttcatgtcaaggcatatagtaaacagattttttttcaaaaaattattgtgataacacttaacatgagacgtaccctcttaacaaattttaagtgcacaataccttgttgactctaggtacataatgtgcagcagagctctagaacgcattcatcttgcctgacggaaacttcacgcccattgatgagtagctcctcattttctcctccccacagccctggcaaccaccattacactcttttgttctacgcatttgactatttcacatgacccctgtaagtggaaataagaaatatttgtctttgtttgacagatatttaacttaccataaagtcctcaagatttaattcttgttctcacatcttgcagaattttctcctcctgctcctcctccccctcccacctcccccctccctcccttcccccccacttctcctcctcctcctcctcctccttctccttcttcctcttgttctgatggagtttcactcttgttgcccaggctgtagggcaacggtgcgatctctgctcaccgcaacctccgcctcctgcgttcaagcaattctcctgcctcagcctcccgagtagctgggattacaggcatgtgccaccatgcctggctaattttgtatttttagtagagatgggatttctccatgttggtcaggctggtcttgaactcctgacctcaggtgatccacccgccttggcctcccaaagtgctgggattacaggcgtgagccactgtgcccatcccaaattttattctttttgaaggctgaataatattccattgcgtgtatataccacattttctttacccattaatctgtcatttaggttttttccccattttggctgttgtgaacagtgctgcaatgaacatgttagtgctaatatttcttccacattctgattttaatttttatgggtataaatccagaagtaggattgctggatcatatgctagttctattttcaattttttgagaaacctccgtactgtttttcttagtggttgtaccattttgcattgccaataatagtgtgcaaaggtttcaatttttctacatcttcaccaacatttgttgtcttttgtctttttgacactagccaatctgacaggtgtgaggtgatttctcattgtggttttgatttgcaattagtgatactgattatttgtggtattggacattttttcataaacttgttggcttaactaaggaggtgaaagacttgtatactaaaaattataaaaccttgaaagaaacgaaagaaggtggcccggcatggtggctcatgcctgtaatcccagcactttgggaggctgaggtgggtggatcatgaggtcaggagtttgagaccattctggctaacatggtgaaaacccatctgtactaaaataaaaaaaattagccaggcatcatggtgcgtgcatgtagtcctagctactcgggaggctgaggcagaggaatcgcttgaatctgggaggcggaggttgcagtgagccaagatcacaccactgtattccagcctggtgacagagcgagcctttgtctcaaaagaaaaaaaaaaaaaaaagaaatgaaagaaggtataaacaaatggaaagacattccaaattcatggattggaagacttcatattgttcaagtgtccatactatgcaaagcaatatgcagattcaatgcaatccctattaaaatccaaaaggcatttttcacagaaatagaaaaaatgagtctaaaatttgtatagaaccacaaaaggccacaaatagccaaatcaaccttgagaaagaagaacagtgttggaagcatcacacttcctgatttcaaaatatattacaaggccacagtaattaaaactggtataaaataaaatatggtactggcataaagacagacatataggccaaaggaatacaatagcaagtccagaagtaaatctacacatatgtgatcaaatgatcttcaacaatggtgccaagaatatgtaataggggaatgattgtctctttaataagtgatgctgggaaaactggataaccacatgcaaaagaatgaaataggatccttatctaacaccatacatgaaaatcaactaaaaaaggactaaagacttacaagtaaaacctgaaactgtaaaactcctagaagaaaacataggggaaacacttcatgatgttggtcttgccaatgatttcgtgaatatgacaccaaaagcacagacaacaacaacaaaaataaatgatgagaactatgtaaaacgaaaaagtgtctgcacagcaaatgaaacaatcgagttaaaagacaacccacaaaatgggaaaaattatttgtagaccatctatgtaatgagttaatttctaaaatatataaggaatttctacaactcaatagcaaaaaaaaaaaaaaacctctaacaatctgattaaaaagtgggctaaggactttaatagacatttctctaaagaagatattaagtaggtttctaaaatcgtgatgtgtttttcatttgatgtgtgcatttaattgacgctcattactccatcaaaagcatcctgaaatcaaggaaacagtacttactagaatgtttcagtgatcgatttctgcctattaaaccaccccaaaacttaatgcattaagactaatttattattgctgtgattctgggacaaaacataactaactttttattcccctttcaaggtgtattttctgcagaacccccatctcagtaaatgccactatcatccactcccttgctcagctccttaaacttggagtcatccttgacatttttctttctctcatgcccctcatctagtttatccacaaattaccaagaaacacccacaagcctcctctcttcagcactacccccgtaatccaagccaccatcccatctcccttgggctattctggtagcctttataatcggtctcctgctttacctcttgccttattcagtctattcttcatatagaaaccagaatgatctttaaaataaatataatcagaggatgtcaacctccccaccacccggaccccacagcttatgactatccagcagctacctgttgtattcagaataagacccttataaaaccacttgctatagtctacaaaggccctgccctcctctcctcccttagctcatctctagccacactggccacactggccttccttctcccctttagcatgcatggacgtttacaccccagggcctttgcacctaatgtatgtgtgtgtgtatatatatatatatatatatatgtatatttgttgttgagaggaagtctcgctctgtcacccaggctggtgtgcagtggcgggatctcggctcactgcatgctccgccacccgggttcacaccattctcctgcctcagcctcccgagtagctgggactacgggctcctgcccccatgcccggctaatttttttgtatttttttagtagagatggggtttcaccgtgttagccaagatcgtctcgatctcctgacttcgtgatccgcccacctcggcctcccaaagtgctgggattacaggcgtgagccacccccacatccgcacctagggttcacaccgaaaaaaaatagtaggctctggagatgcaacagaccctgctttcattggagctttcagagagggaagacaagtgaacacatgaataaatgttaagaggtagtgagcattaaggagataaagtaggtatagagaatggagagagatgggaggtgtgaccccgtttcaatagggtggtgagtgaaggcctctctgaaaaggtggctttgagcaaacgcccaaataaatggaggggctgagccgtgcaggtatctggaagcaaatggggcaggggaaggagctgtttcaaaggatccaagatgggcaaatacctgcagggcttagaaatggtggctataatctgaaagcatgtagcaatagaagccttgcagctgaatacatgcatttgaggcagcaatgacttctttctagggggtttatgtgaggagggatttttctttttgggaaaaaccctgaggtacacgtattcaaaggaaatatttgttgacttggatggaaagggcctgtcttcagctttcgttctgctctgcctggctgcctctcagtgttaggttcaatgcttgaggctgtgccaagttgatttccctgtgagagcagacgcctgatagtagggcacagtgccagtcccgttgataatgaaatctttgcatccccgttgacacttctataaaggacagaagaggaactgtaagttcccattctgatcttttatttctgttttgtcaccctcaagaatacctgtcagaaagcttttgggatctggactcagatggacctgaatttgaagcccactgtgaattttactgcagtgggattttggtgagagctgctcaaacctgaacttgaggccaggcctggtggttcatgcctgtaatctcagcactttgggaggccgagacaggaggatcatttgaactcaggagttcaaggccaggctgggcaacatagggagatcctgtctgtaataaagaataaaaaattaaaaccctgaatttgagaggagcacgtggtgacagtgctcagatttgggttattcatgcccaatattgtggctctttctgtttttgttttcaaattttgttttatatttgtctttacagaacattaacattgttccaaactaataactaaataaaaaagccatcctcagagtaggtacagagtggttagttgccctggttggaggagtgggagagttctatcaccaatattgtttagaattgccagtaataataaaaatggatgacctttaattgctttttgttcatgtcataatactcgtgtatgaaattcatatatttttagaaataaccacgttgttttggaataattttagatttgcagaagttgcaaaaatagcacagataattcctatagttacccttcatccagttccccctaatgttagcatcttacatcaccatggtacatttgtcaaaagaaattaatattaatataacactattaactatagactttactcaaatttcatcagtttttccaccaatgtccttttttcctggatccaaaatttgatttagataccaaattgcatttaatagttgattgtattactgttttttaaattctctacagacaaggcacctattgactgcacctggcagaacaaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatgtgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcaacatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggcgtgtagggatgcctcagtcgcttacatgttgattgagtgaatcgtcggtttctttctggacactgacttcaaaaataaaataggatatgaaaatggctccatttgttgtcaccattttgtggggatcctatgtcctttgaagtggtcaggagtgggagaaacgtgataggggaagaaggagtggtgtggctgatggatttaacatgtgttcttttatgttggcaaggaagcggatgaccttaccccttgttcctcagatcctgtaaatggctttataacatgacccagggctgcttggtgtgggactagaccccagggtttgagggtctgaagacaatttaggttcgtgctggcaggatgtcttggctcagagacaagtatttctgtggggtgatcccagcatcctcccagcatactgctgctgttgctaggcagagaccccggagtggggagagggtgatagcatctggatcatccattcctacctaggtggttttggctcatagtaaaagggacctcagcacctatccgctgctcagcctcggagctgcaggtgtcagggatatcatgcactgtccaaaaagacatgcaaaacttaacacccgtgcattttcatggagagaccccgtggagcctctgaccagaggctgaaagaaatgtgtcattcaaaagaccagggaaccactgccaaggacccctacattcagcaacacatctatactcgtgcctgccacgtgtccgcacttagaggccattgtctcacctcagggtcaggagtgccaggtgaaagagcacacaggtctctgggcaaggcagagtttgaagctaggtctggaccaacgtctgagagtatgacttcaccccaggcgaggaagttcactttgagctcctggccagggagaaagcaagctctgggagacctaaactctgaatctcacttggcttttcagtctaatccgttgttgccaaagacatacttggcaatcccgaatcctcagagggctccatacgtgctgcgcttcagccttcgctcacggttcatcccacctggaatgcctttttctctccaaagatgttcccaagagccaagttaaatgtcacttccatttatcttcctccaaaaggaacatgtgttttacttcatctttctcctaaaaatgtggatgccttaatgagactaataatggttgttagtgcttgccaggcgtggagctaagagtgttacatatattatttaatctgagcaatcctgcatcatgggtactattaccagctccagtttttttgagacggagtccgttttgtcgcccaggctggagtgcagtggcatgagttcaagcgattcttatgctccagccttctgagtggctgggactaccagcacacatcaccacgcccggctaattttttttgtattttagtagagacagggtttcgccgtgttggccaggctggtcttgaactcccgtcctcaggtgacctgcccgcctcagcctcccaaagtcctggaattacaggcgtgagccactgcgcctggcccagctccagttgttcaggtgaaaaagatgaggcacagaattggaaagccatttgtccaagaggctaagaagtggtcacgtgagcatttaaatgtttttaagcctcagcctactcctctccaggcccttagcgtgtttcgtcctgcgttttcctggtctttcccagtgtttattagatgtctatagtgtccagacaatgttaggcagacgggacacaagggtgcacaaacaaacagtctgtgcccttattggaacctgttaatccctaaagggctaagcctccctacagcaagaaccctgttagtcacctgtgtatccccagcatctcgactctccacgggcatggcactatgctgtaaaaaaaataatccctgaccctcatggctatgggaaagcatgccttttaaagcataatccggctgggtgtggtggctcacgcctgtaaccccagcactttgggaggccgaggcaggtggatcacctgaggtcaggagtttgagactagcctggccaacatggtgaaaccccgtctttactaaaaatacaaaaatttgctgggcgtggtggcaggtgcctgtaatcccagctactcaggaggctgaggcaagagaaccgcttgaagcctggaggcagaggttgcagtgagctgagattgcgccattgcactccagcctgggtgacgagtgaaactccgtctaaaaaaaaaaaaaaaaaaaggataatccaatctaggtgcctctgcctcagtgttgcattcacagaattccgtggacccaaaaatcagtcttggaataggctgggatatggacaggacacccaggttctgcccctacacctatcccccacctggcttttttttttcttttccttgagacagtctggccctgtgagctgaggttgcaccactgcactccagcctgggcagcagagcaagactccatctctcaaaaaaacaaaaaacaaaaaaacaaaatggggttaagagaatgggctttggaatctagtggcttcactggttgcttgctgtgtgatctcgggccacttgctgtgcctctgtgcgtcagtttccttgtctttagtagagagatgatagtaacatttcctgtagtggttgtgaagattatacataatgtttgtaacctgctggagtggtcattagagctgttcaccaaatattcagattctccccggttggcacatggtgggagtgccttgtccatgtgactaactggccagtcagctgggagcagaagtgcctccttcaggcgggggcctttagtggctggcaggagacctctatggctcctctttcttttttttttttttaattaattttttttattatactttaagttttagggtacatgtgcacaacgtgcaggttcgttacatatgtatacatgtgccatgttggtgtgctgcacccagtaactcgtcatttacattaggtatatctccaaatgctatccctcccccctccccccaccccacaacattccccagagtgtgatgttccccttcctgtgtccatgtgttctcattgttcagttcccacctacaagtgagaacatgcggtgtttggttttttgtctttgcgatagtttactgagaatgatggtttccagcttcatccatgtccctacaaaggacatgaactcatccttttttatggctgcatagaattccatggtgtatatatgccacattttcttaatccagtctatcattgatggacatttggcttggttccaagtctttgctattgtgagtggtgccacaataaacatatgtgtgtatgtgtatttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgatggccattctaactggtgtgagatggtatctcattgtggttttgatttgcatttctctgatggccagtgatgatgagcatttttttcgtgtatcttttggctgcataaatgtcttcttttgagaagtgtctgttcatatcctttgcccacttttcgatggggttgtttgtttttttcttgtaaatttgtttgagttcattgtagattctggatattagccctttgtcagatgagtagattgcaaaaattttctcccattctgtaggttgcctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattaccaagtcaatcctaagccaaaagaacaaagctggaggcatcatgctgcctgacttcaaactgtactacaaggctacagtcaccaaaacagcatggtactgggaccaaaacagagatacagaccaatggaacagaacagagccctcagaaataatgccgcatatctacaaccatctgatctttgacaaacctgatgaaaacaagaaatggggaaaggattccctatttaatacatggtgctgggaaaactggttagccatgtgtagaaagctgaaactggatcccttctttacaccttacacaaaaattaattcaagatggattaaagacttaaatgttagacctgaaaccataaaaaccctagaagaaaacctaggcattaccattcaggacatagggatgggcaaggatttcatgtctaaaacaccaaaagcaatggcaacaaaagccaaaattgacaaatgggatctaattaaactaaagagcttctgcacagcaaaagaaactaccatcagagtggatatggctcctctttctttctgccatggtgatgggcgattatgcccaggagcggctgcttcatttgcctggcacaggagtgagggtgacaatgcagagatccagccacccagcaatgggtgtgtagcagcaagaaatgacccttttgtgaattaagcaactgcaatttggcgtttttataacctaacgtatcttgactgatacaaatgcttagagcaacctctgatatttagtaagggcttattcagtggcagaatagaaaagaatgggatctagagtaataaaagggattagccttctctttgtcagttagggatgtcaagagattatctgtagcaccctctgctgtcaacatgcctgtcttccatgaccagcctgtacccccctccctccacatgtttttgtttttcccagacagggtctcactctgtcacccaggctggagtgcaaatcgacctcctgggttcaagcgatcctcctgcctcactctccctagtagccgggactacaggcatgtaccaccatgcctaattttttattttttgtggagatgggacctcactattttgcctaggctggtctcaaactcctgggctcaagcaattctcctgcctctaccttccaaagtgctgggattataggtgtgagccattgtgcccagccacatggttcttcaatactcacccccaccccaaaccctctgacacatgcgtttagtcctggggtggggcacctgactcaacccaggttgaagatactttaggatattttgaacctgggagatgtgagggttgtctctttaaaatggtggaaattatgagatatttgggaacggcactactgatcctcctaatttatttttaattttttttttaggccgaggcgggtggatcacctgaggtcaagagttcgagactagcctggccaatatggtgaaaccttgtctgtactaaaactacaaaaattagcagggtggggtggcaggcgcctgtaatccgagctactcaggagactgggactacaggtgctcaccaccgcgcttggctaatttttgtatttttacaaagctttaaataaaaattgcttaaagctgaaaattgggtgggcgcagtggctcacgcctataatcctaccactttgggaggctgaggtggacagatcacttgagcccaggagttcgagatcagcttgggcaacgtgatgaaatacgatctctacaaaaaatacaaaaattagccaagcatagaggtacacacctgtagtcccagatactccactgaggtgggaggatcacctgagccgggggaggttgagggtgcagtgaggtgcgatcgcgccaatgcactccagcctgggtgacagagtgagatactgtctcaaaaaacataaaaataaaaaataaaagctgaaaaatttatatttaatattttgaaaacttaaatcttattgcatattattattaaataactttccagttctagtgttcaatgtcagtctaattgctcatctaaaggactgatattgcaacatacattttgtgtctcgatcttatatacaaattagagagtgatacaaattgtttaaatggctaaatgttcctcagctacagtgagtagccatattggtctcttttaaaaatttttattatttttatttaaacaaagttttaatttttttttgtagagacagggtctcattatgttgcccaggctggtcagccacaagtgatccttctgcctcagtctcccaaagttctgggattataggcatgaactaacacgcctgacccagattactctctaactcatgagtatgtctggaggcgcaatttggaacatgaagagaaacagaaaaatggactctcagtacttctgagaaatgatacttgttatacaagaatctactgcattcagcctccctgagaagaggaatttaagaattaatttctgcttcctcttacttaagtgtttcaacactcaagtcctttgcatactctgaagcaatgtgtgtctccaacattgggagcagctgcaacccacaaaccttcttgacataaaatagttgcattcattcattcatttatttgctctgccgcacaggctggaatggcagtggtacgatcttagcttaccgcaacctccacctccctggttcaagccattctcctgcctcagcttcccgagtagctgggattacaggtgcgcaccaccatgcccggctaatttttgtattttttagtagagacggggtttcaccatgttggccaggctggtctcaaactcctgacctcaactgatctgcctgcctcggcctcccaaagtgctgggattacaggcgtgagccaccacacctggccatagttgccttttgttttgagattttaggacaagagatgaatatgtttttttttttttttttttgagtcagagctttgctcttgttgcccaggctgcagtgcaatggcatgatctcgactcactgcaacctctgcttcccgggttcaagcaattcttctgcctcagcctcccgagtagctgggattacaggcatgcgccaccatgcccggttaattttgtatttttagtaaagatagggtttctccatgttggtcaggctggtctcgaactcccaacctcaggtgatctccctgcctcagcctccgaaagtgctgggataacaggcatgagccaccacgccgggcagaaatgagacatactttggggcctgaacagtgtttgttatgaaatggatgtttagggctgcagattgtgctgagccagtactgaacataagatcctgagtggacaggaacacctttgtggtcattagtgaatctgtttttaagagctgggagtggtggctaacacctgtaatcccagcattgtgggaggctagggtgggatgatcacttgaggccggagtttgagagcagcctgggtaacaaaacaagactctgtctctacaaaaaaggaaaaaattagctgggtgtggtggcatgagtctatagtcccagctactcaggaggctgaggtgggaggatcgcttgagcctaggaggtcaaggctgtagtgagttatgtttgtgccactgcactccagcctatttgagacagataatgtgtctcaaaaaaaaaaaaaagaaaaaaaaagaaaaaaaactcttggccgggtgcggtggctcacgactgtaatcccagcgctttgggaggccgaggcagctggatcacctgaggtcaggagtttgagaccagcctggccaacattggtgaaaccccttctctattaaaaatacaaaaatttgctgggcctggtggcacgcgcctgtaatcccagctactctggaggctgtgggaggagaatcacttgaagccgggaggcagaggttgcagtgagccgagatggcgccactgtacacactccagcctgagcaataagagcaaaactccatctcaaaaaaaaaaaaaaaaaaaagaaaagaaaagaataaaagaaaaatccattgaaaaaatcatacatttgtgagatggagagccaatcttgctaggaactgagggggttactggctgcaagggagatggggaaaacaagtcctggcctccacctaggggatctatagactcacagtgcaggaatttccccggagacagaggagcgctttaaaggtactgtgcggcccaaaatggtggagtagggaattccagggctccatccctcccccaacacaactaataaggtggcaaaaactgtcagaatcaacttctgaagtactctgggatctagctttttgttagctttcatttttttgagatggggtctcactctgtcccccagactggagtgccactgtgcaatctcagcccactgcagccttgacctcccgcctcagcctcagagtaggtgggatcacgggcgcaagccaccatgccaggctaatttttgtattttttgtagagacagggttttacaatgttgcccaggctggtattgaactcctgagttcaagcaattcaccagcctcagcctcccaaagtgctgggattacaggcttgagccaccgcacccagccttctagtttttaaaaagggaaacaaacaaacttataactagcacgggaaaatttggagaaagaaagctctgaggctgggcgcggtggctcacgcctgtaatcccagcactttgggaggcaaaggcgggtggatcccctgaggttaggagttcgagaccagcctggccaacatggtgaaaccccggctctactaaaaatgcaaaaattagctgggcatggtggcacatgtgcctgtaatcccagctactcgggaggctgaagcaggagaatcccttgatcccaggaggaggaggttgcagtgagccgagatagtgccactgccctccagcctgggtgaaagcaaaagtccgtctcgaaaaaaaggaaagaaagaaagctctcctgtgataagagagtgtgattgatggcgtttttgcttgctcatgtaacatccccccaaactccagatcagcagggaccatgaggatgtcagcctgcacttctggggctggttgctagcgtagggggagtacacagaatttactctcaaagaattgtggttgtaggctgggtgtggtgtctcacacctgtaatcccagcattttgggaggccaaggcaggtgaatcacgaggtcaggagtttgagaccagcctggccaacatggtgaaaccccatctctactaaaaatacaaaaaattagctgggcatggtggtgggcacctgtaatcacagctactcaggaggctgaagcaggagaatcacttgaacctgggaggcagaggttgcagtgagccaagatcgtgccactgaactccagcctgggtgacagggcaactccgtcttaaaaaaaaaaataaataaatttggggttataggtctgacgacttccccaaggactagcagaaaggtttctgagctttttaaccagggcattttcagggctggcatggcttcccaggtggctttagacaaaagcattgaaagacataggtattggcctcaataccctggggcaggggacaacacttgggacaagcaatagacagaccgagcagcctgggaaggaaaagtttggaaaaagagatgtgtgtctgtagaggcttttaaaagtgtctacataaaccaggaaatcaagaaagctgtgtgcaggcccatagtcagttgcaagctcagaaaaggcctaagaaactttgtgaggccaaggcggttggatcacctgaggtcaggagtttgagaccagcctggccaacatggtgaaatcttgcctttactaaaaatacaaaaattagccaggcatagtggcacacacctgtaatcccagctacccgggaggctgaggcagaaaatcactttacctgggaggtggaggttacagtgagctgagattgtgccactgcactccagcctgggtgacagagtgagattctgtctcaaaacaaaacaaaacaaaaacaagcaaaagaaaaggcctaagaagaccctgggctttcatctctttctggccttcagtctctgtgcaagcaggaagtgaaggctaaggcagagtataaatggcttggttaagggttgagagagtgccccaaacagatccaatttgcaaagactaggatagtgtttttcttttcttccttcctccctccctccctcccttctttcctttcttccttccttccctccttccttcctttctctcctttctgcctgcctgctttctttctctctctctttctctgtctttctctttatttctcctgttttcttgtttctttccttttattcttctttatttgttggcttcagccattttaggtagctctcaaaataccagctgactgacaagcaaaaagaacagaaacaaacaaaaagaacagaacagaaaaaaaaaaaaaaaaaccagaaacagaaacacaaagaatacagactttacaataatagtttggaaaatttaccaaacaagcaaaccacagcaacccacgatatacagcaacaatagaccctggggagggaggagaatctgattttcagtgttgccataaattgaaaatgtcaacaaaaaccctcatggcatggaaagaaataataaagttccactcatttgtggcaagaaagaaatgactagatactgtctttgtggcaacccaggtattggtcttactggcaatgactttttttttgagacagagtcccactctgtcgcccaggctggagtgcaatggcacgatcttggctcactacaacctctgcctcttggattgaagcgattctcctgccttaccctcctgagtagctgggattacaggtgtgcgccaccacgcccagctaatttttgcattttcagtagagacggggtttcatcatgttggtgaggctggtctcaaactcctgacctcgtgatccacccacctcagcctcccaaagtgctggattagaggcgtgagccactgtgcccagcccagcaatgacttttaaaaaaaattatttatttaatttttttttagagacagggtctccctctgtcactcaagctggagtgcagtgatgtaatcagagctcactgcaatctctatctcctgggctcagtgagtctcctgcttcagcctcctgagtaggctggaactacaagtgtgcaccacaatgccaggctagacaattactttttttttttttttttttgagatggagtcacactctgtcacccaggctggagtgcagtggcataatctcggctcactgcaacctctgtctcccaggttcaggtgattctcgtgcctcagtctcccaagtaactgggattacagatgcccgccaccacgcccagctaatttttgtatttttagtggagacaggttttcaccatgttggccaggctggtcttgaacttctgacctcaagtgatctgcctgcctcagcctcccaaagtgctgggattacaggcatgagccaccatgcccagccgacaatgagtgtaaattgactgtcttaaatatactcaaagagatgaaggaaaccatggacaaagtcctaaagagagagcactttgcagaagttgtggcgccttgagagccagcagggcagtgggccagtgagatgttgagttattactattattaattcaaatcacatgaatagcaaaccctcagagaacaagaagtctttgttgtatcacaagggctccatcagcagaggtggagtcctgaactcggcacagtgtctggcatatactaggtcttcaagaaagttttagagtaaacaaatgcatccacaatgcttttatgttgggtaaggtctttctagcagtcaaaattttctttctttctttctttttttttttttttcctccttgtgatggggtttgcgggaatgggaacaatggcatagaggaagaggaaaccaaaattatcttgagttagcagatgtctttctcctgtctcctttcttcactaagaagaacagtctttgctgggcatggtggctcccacctgtaatcccagcactttgggaggccaaggcgagtggatcacctgaggtcaggagttcgagaccagcctggccaacatggtgaaaccctgtctctactaaaaatacaaaaattaggtggggtgctgtgtggctcactcctgtaatcccagccttttgggaggctgaggctggtggatcacctgaggtcagaagttcaagactagcctggtcaacatggggaaaccccgtctgtactaaaaatacaaaaaaaaaaaaaaaatagctgggcatggtggtgcatgcctgtattcccagctacttgggaggctgaggcaggagaatcgcttgaacctgggaggcagaggttgcagtgagctgagatcatgctattgtactctggcctgggggacagagtgagactctgtctcaagaaaaaaaaaaataaaaaaataaaaataaaaaacctaaagaaacaaaaaaaaaaacaaaaattagccaggtgtggtggtgcacacctataatcccagctactcgagaggctgaggcaggagaatcgcttcagcccagggatgcagaggctgcagcgagccgagatggcaccactgcactccagcctgggcgacagaacgagactttgtcttttttttgtttgtttaaaaaaaaaaaaaagaaagaagaacggtattgtctttgggtaagcacaggcacagagttaaaaaaaaaaaaaaaagagtcgtgtctttgggactgagtggatgggcatgtgttctgagttagtgtgcccaggtgtggtgaaagacacggagaaaccactgcttgatgcgttctcttttgttgttcaagttgtgggctgctgtggggtggggttacatgtctgcatccccttcgaaaagcacacaatatggcaagtggaagctggagagagctcctaggagtgcctcgtgccaggtgaagaggttgcattgcgggtggtgggtaggtgcctagggagaggaggtccacgcctgttgtccttccagcacgatggctccaaaagcagagcgaagaggtgatgttcccacttcccaaggcatccaagggacggggcttgaagaatgcagcctagcaaccatgtgcgtaagactgtggggaaggagggcttgaggatgagcctgagagtcaactggactgtggggaaatagtgtagccttctttcctttgagcttcagttatctcgcctgtggtgatgatgacgatgatgataaagatgataccatacttctatggcacatactatgttccagatattgttcatataactcatctaattttcatagcagttttacaagatgagtactatttgtttttgtttttttgttttttttttttgagatggagtctcgctctgttgccaggctagagtgcagtggcgcaatctgggttcactgcaacctctgcctcctgggttcaagcaattctcctgcctcagcctcctgagtagctgggactacaggcacataccagctaatttttgtattttcagtagcgacagggtttcaccatgttagccaagatggtcttgatctcttgacctcgtgatccacccgcctcagcctcccaaagtgctgggattataggcgtcagccacagctcccagccaagatgggtactatttttatacctattttatagaagaggaaactgaggcatagagaagtcaagtcacttgatcatacagctagtgtgtggaggaggcagattcaaaccctggcttcggtcttagtcactgcattggcttcatgggcttatcatgaggattaaacgcgtgaacatgctcagtgtttagttcagtgtctggcacaggatcaatgttcagaaaatcctaacagctgctgtcagtatcagaacccaaacaaacaggtgggactttcgccaactctctaacatcacatgtgcttgtataatcagccactgtttttttcatgaaaaaaaatttttttgagacaggttctcgctttgtcacccaggcaggaaggcagtggtgagaacacagctcactgtagcctccacctcctgggctcaagcgatcctcccacctcagcctcttgtgtagctggaaccacagcatgtgccaccacgcccagctattttttaatatatttttttattttttgtagagatgaggtctcaccatcttgcccaagctgttctcaaactcctggactcaagcagtcctcctgcctcagcctcccaaaaggctgagaatacaggcatgagccactgcgcctggctaatcagtcacttgttgttgttgttttttgtttttttgagatggagtcttgctctgtcacccaagttggaatgcaatggcgcgatctcggctcactgcaagctctgcctcctgggttcaaatgattctcctgcctcagcctcccaagtagctgggactacaggtgcacgccaccacacccagctaatttttgtatttttagtagagacggggtttcaccatgttggccaagatggtctcgatctcttgacctcatgatccgcctgcctcagcctcccaaagtgctgggattacaggtgtgagccttaatcccaaagtgctgggattacgtgcctggccttaatcaatcacttttaaaggagagtggggaacatcatgttttgcaactattttttgaactcttggatatttacttggaacaaataaaaacacttttgtaccatgtgaaaggtaaaatttgctcaagccgtccctcatcctgccctggcctgcttccacatgcggctgggtgagctgaccccattctctgtttatttattgtttttgttattgtattttattttacttttttgagacagagtttcactcttgtcacccaggctggagtccaatggcatgatcgtggctccctgcaacctccgcctcccagattcaagcgattctcttgtgtcattctcctgagtagctgggattacaggtgcctgccaccacgcccagctaatttttgtatttttagtagagatggggtttccccatgttggccaggctggttttgaactcctgacctcaggtgatctgcccgcctcggcctcccaatgtgctgggattagaggtgtgagccaccgcgcccggcccattctcagcttcttgatggcttccccctactgggacattgatcacttattcatgacattgactggtcatgagccactcctccgccagcccttggaggatccaagtgattcacaaatggacacaaggaatatgattagtcctctgtgagtgattctgaggggccgtggtatagagagagagaggggaaggaggatgggaaaatgccggcagttccctccccaacccattctgacagtttgctggttagagaaaaatccccatgtcagagaatttttttctttgtttatttcctgtgaaatagaatgtgggtctggcattggggaggactctagtaattcatattttctgcttatttggctcctggctgaacaggaatttacattacttaatgtctgggtttttcctggggaatcaaaataagttttctattcaattattaagcaaatttcacagccaaataatcctcttatttttacaagtggtattttccctggcagagggttttctggcttctctgggtacttgatccgtctcctctcttctgtttcctctgtctttgtctggctatgaaggaagctaaagcccctcattcatggattaggggcttctcaatggcagttggcagactttggctttgcaagctagagatgaatcttttttttctttcttttttttttttttcgagacggagtcttgctctgttgcgcaggctggtgtgcagtggtgcgatctccactcactacaacctctgccttccaggttcaagctattctcctatctcagccttccaagaagctgggactacaggcatgcaccaccacacctaatttaaaaaatactttagtaaatggctaatttaaaaaatatttttagtaaatgggaggttttaccatgtcggccaggctggtctcgaactcgtgacctcaggtgatctgcctgccttgtcctcccaaagtgctgggattacaggtgtgagccactgcgcctggcctagagataaatcttaatgtccgccagccatggggtaagagtccactccctctttctgctcttcagtctattgactttgggcacaggcacagctgcagctctagtaggggttgggcctggagtcagtggagacaaaatgtgaaggtaacaggacagtgcacggggcccagtgtgctctgcctgggctgctcagggaagaaaaatcacacacacacacacaaataacaaccctttttttggcagaagtatagtgaaagatctctacgtcttggccagcatttgttatctttttgcttctttgaaaatagccatcctgggccagatgcagtggctcacgcctgtaatcccagcactttgggaggctgaggcgggtggatcacctgaggttaggagtatgagagcagcctggtgaacatgatgaaacctcttctctactaaaaatacaaaaattagctgggcgtggtggcacgcgcccataatcccagctactcgggaggctgaggaacaagaatagcttgaaccctggaggtagaggttgcagtgagctgagattgtgccattgcactccagtctgggtgacagagtgagactctgtctcaaaaaataaataaataaataaattaaaaataaataaataaataaaggaaacggagtcagtgtgttgaagagatatctgcactcccatgttcactgcaatattattcacaatagacaaggtatagaatcaacctaagtgtccatcagtggatgagtagataaagaaaatgtgatacacatacaccaatgtggtatatatactcttcagccttaacccatctccataaaattaaggaaacaaagaaggaagtcctgttattggtgacaacgtggatgaacctggaagacattatgttaagtgaaataaatcaggcacagaaagacaaataccacatgatctcacttatatgtggaatctaaaaaagttgaactcactgaagtagagagtagaatggtggttaccagaagcaaggtgagggtgtctgtgagagggttggggagacattggtcaaaagataaaaaatttcaattagccaggaggaaaaagttcaagaggtctattgtgactagttaataaaagtgttctaaccacaaaaatgatccatatacaaggtaacatatatgttaattagctttatttagccattccacactgcgtatatcaaaaaatcatgtacaccataaatataattattattattttttgagacagagtttcactcttgttgcccaggctggagtgcaatggcacgatctcagcccactgcaacctccgcctcctgggttcaagcgattctcctgcttcagcctccctagtagctgggattacaggcatgcaccaccatgcccagctaattttgtatttttagtagagatggggtttatccatgctggtcaggctggtctcgaactcctgacctcaggtgatccgcccacctcggcctcccaaagtgctgggattataggcgtgagccactgtgcccggctcataatttttatttataacaaaaagtaaagtgaacctcctgtagacagagtacagttggatcttgttttttcaacctattcacctactctatgtcttctaattggggaatttaattcatttatacttaaagtaattattgatagataatttacttagtagaagtataactttgagcctgttatttaccttttctaaatgagttttcatttctgtgaaatgggcacaattaaagaggccgcctcctgggactggggtcaggattagttgagatagtctgtgtaaggctaggatggtgcttgacagccagtgttaattattattttttgatcctgtgggatagggcaacccagatactccggtgggaaacacttgcaaccagagaaccttgactcaaaatcttggtcctacttggtttgaaggatcccattgcatttgcattgctgccccttctgagaggttattcacactgataaaccccattttgcaacttacacgtgcaggattcagctaattggacagcagtggacactgaacctaaggtgaaaaatccaacaaatagagaggaccaactgaaaaattcagttgctttcttttgaagaatctgaatacgagacacagagaaaggattagtagtcagtattgagggcagaaacagaaacacagagaaggaaagttataagaggaagctttgagtcagcagaagctatgggtgaataggagccatgaattgacaggaattatgagtcagcagaaacttgagtcgtggcaagagccacaagtcagcagaaactatgagatagagagtagcatggagatagcagaggaataggccaagacccggagatgctgcgtcaccatcttggtggagcctagagggcagagctaggatggtcccctgaattacagagctgctgtcagtgatgagtgtaacctgaagatgttccagcctctggcagccctgactgggtggtgagactttggccttccagctttcataaagtaaactgagaatatttctgtttctggccaacttacaagaatctgactgacacactacccatatcaaactcctctgagactcagttttcttgcctgtgaaatggggacagctaaatatacaagttgaatgggttgagaaaacaagatccaattatattctgtctacaagagactcattttactttttaattacaaataaaaattatatgtatatatgatattttgatatatgtatacagcatggaatggctaaatcaagctaattaacatatatgttaccttgtatacttgctttgggctgcttagcatcccttttttggggataccagcctttatttgacatctgccagtaacaggattctacctctaaggtggccacataatccaggccgggcccgtcagagcctcattgtagaaatttgccttcaggtcaggaggtggaaaccctgagagagttcctgggttctgggatattctaagctgtccaggctcctgtgttttctttgtttttagagacggagtctagctctgtcacccaggctggagtgcaggggcacaatctcggttcactgcaacctccgcatcctgggttcaagtgattctcctgcctcagcctcctgagtagctgggattacaggcatgcgccactatgcccagctcatttttgtatttttaatagagatggggttttgccatttttggctaggctggtctcaaactcctgacctcaggtgatctgaccgccttggcctccgaaagtgctaggattacaagcgtgagccaccatgcctggccggctcctgtgttttctaaggccagtttattcaactctgttttctttctgagagtttccgaatggagtcatcccttggtatccatgggggattagttccaggactttccatggataccaaaccccacagaagctcaagtccctgatataaaatgatgtagtctttgcatttaactatgcacatcctgctgtatactttatttttatttattattattatttttgagatggagtctccctctgtcacccagactggagtgcagtagcgcaatcttggctcactgcaacctccgcctcagctaggttcaagcgattctcatgcctcagcctcttgagtagctggaactacaggtgtgtgccaccacgcccggctactttttgtatttttagtagagatggggtttcaccatgttggtcaggctggtcttgaactcctgacctcaagtgttctgcccatcgcgacctcccaaagtgctgggattacaggcatgagccaccatgcctggccctcctgtatacattagattatctctagattactcataaaaatgaatacaatgtaaatgccgtgtaagtagttgctatactgcattgtttagggaatcatgacaagaaaaggagtctgtatgtgtttagtacagatggtttttgttgtcgattaaaaatatatatatattttatagagacggggccttgctatgttgctcaggctggtcttgatcttctggcctcaagtgatcctcctgcctcagcctgccaaagtgctgggattacaggcatgagccactgtgcccagccttcctgaatatttttttaattctcggttggttgaatccatagatgcggaactcacagaggcagagggccaactgtagccttcctacagatatttttatcttgttaaagtaataaccctaacctgacccacacctcacaggtctgttgtgaagtgacataagccagcacataagtggaaaagcttggtgaatgatttaaaggaatcttctggcctggtgcgggggctcacgcctgtaatcccagcactttgggaggccggagtgggtggatcacctgaggtcaggagtttcagaccagcctggtcaacgtggtgaaaccccgtctctactaaaaaaaatacaaaaatcagcccggcatggtgacgggtgcctgtaatcccagctactcgggaggctgaggcaggagaatcgcttgaacccaggaggcggaggttgcagtgagccaagatcgtgccactgcactctagcctgggggacaagagtgaaactccgtctcaaaaaataaaaaaaggaatcttctggcctctgtttcagttgaacaaagtgaggtctagagaggggagaagtgagcagttccaggtcgcatgggcggtcaggggtgaaaggggagtggggacgtgaactccaggcgggtgctctttcgcgcctcctggtcgctccctccccttccctccccttccctccccttccctcctcttccctcccccgctctccctgatgtgcctgccttccctacctaacagctctgagttctgcctacctgaattagcccaatgttttcaccctttgaaagaagattctaagccgaaaccagcccccagttccccgtgggctttgcccactccttgccaagcactctgagtgctaccctttctctttctgaatagggtgagatacttgacgctgccctgaatcgaagtcaaacgggggctcctctctgcagtaccacagagctccctgtaggtggcagggtaggactgcaaatgtcctggaatattggtccctgagcgcaagcccagactggagctggggtacagcatttacttgccgtggggaagaggaggacgccggagggaggaggaaggaaagtagaagtgttgccagtcttgaggcaaaagagagttgatttgagggccgaaggacaggaatagttggtgtacctcatccgtctatctctccatccacctacccacctatatacccaactaccctccatccatccacctactctccattcacccacccactcacccatccacccatccacccacccacccatccatctacccatccatccatccatccatccatccacgcattcatccaaacacccatctatccatccacccacccatccgtccatgggttcattcatccatccatctaccaatccactcatccatccaataaatatttttgagcacctgtgctaaatgcatatacacacacacatatctatgcacacacatacatacacactgatatatatcacacacatgcatacacacacacggagaataaccggtactgccttttgttgagtgtcaaggttgcttttatctctccagctggagatttctgcacctgtctgtagcatccattactagcatcccattcccaatattattattcactcctttacttccgaatataaagcagatgtcatctggggccctttttgccccttctgatttcaataaaattttccccaacgtcctgtcttcctcctcctcctctatcccattcctgaggcatctcaagtcttcccttggatttctgtcaactcctgacttttctgcctctagagctttggctcctagtaggatatttctgacctgcagcatatcatattctttgtttttaaaatttattattgttggccaggtgcagtggctcatgcctgtaatcccatcactttgggagaccgaggcaggtggatcacctgaggtcaggagtttgagattaacctggccaacatggtgaaatcccgtttctactaaaaatacaaaaattagctggatgtggtggcatgctcctgtaatcccagctactcgggaggctgaggcaggagaattgcttgaacccggagggagaggtttcagtgagtcgagatctcgccactactccagcgtggacgacagagcaagactccatctcaaaaaaaacaaaaacaaaaccaaacaagcaaacaaaaaaaaaaaaacaagaaaaggcagctcagagaggtcaagtgtctagcttgaggccatacagctaactgggtcagaactgagatttgaacccatgtatgtctgacctggtgctgggctcttttctgtagaggattcatccagccccacatacctggtctagaagaagggaagtggtgggagaggagcaccccagagagaggagcccgaatcatggggctgcaagctggtcctgggtcccatggagccatggggtgaggaagtggcaggggctaccaccaaactcagatgcgggcccaaggctggttgggggagaggaccctggctgtgggtgcccatctgccagcttgtatgaaggagtaggcggggtaggtgggagaagggaagtggtgcttcggtgggaccacaggaaacgctagattttggttagtagttggaaagtaccagcaatttctctttcaacagaaaaccagaaggaggtcaggtttttcttattaaaacagagacaaatgcagactttgcaaaggaagcagggatttgcagagtgaggctggaagtcaccgaagctgagtgatattccccagagaaaggttttacattcatgtggagtgggtcagaggaccttgagttgagctgatgagcagccacaggatggcaccaggttttcacgatatggagagaaggggacctggtggtggtttggccaccgtgtcctgtttcctgaagaacagagggtgtacgtgacagctggggcctcatagccagttactgccagcaggactccatctcaattcagatcttacttcatgggactacacagaaagaaggaaagccaggccgggcatggtggctcatgcctgtaatcccagcactttgggaggctggggtgggcagatcaatagaggccaggagttcgagaccaacctgaccagccttcaccaatggtgaagcccatctctactaaaagtacaaaaattagctgggcgtggtgacgggcgcttgtaatcccagctacttgggaggctgaggcaggagaatggcttgaacccgggaggcagaggttgcagtgaggcgagattgcaccactgcactccagcctgggtgacagagcgagactcggtctcaaaaaaagaaaaaaaaaaaaaaaagctgggcttcgtgaagggctcacacctgtaatcccagcactttgggaggatcactttgggtggattgcttgagcccaggagtttgagaccagcctgagcaacatagcgagactccatccttacaaaagataagaaaacaaaagacagaaggagtggtttggagctatgcaagtgtccctcttggctctggcaatttctgggtggataaccttgggtagcacccttctctttgaatctaagtttccttatctaaactggcgatgataagacctcccttgctatgttgttataaaattacttgtgtgcctagcccagagtaggtgtgcaatgaatgagtaaatggatgaatggctaaattccacacatatttatggagtgctaagtctgtgtcaggcattaccttggggacacagctggaagtgaacaagccccagtcttcggtttttaggagcccacattctggcagaagagacaggaagtagctgggcagggtggctcatgcctataatcccagcacttcgggaggctgaggtgggctgatcacctgaggtcaagagtttgagaacagcctggccaacatggtgaaaccccatctctactaaaaatacaaaaattagccaggcatggtggcatgcacctgtaatcctagctactcggggggctgaggcagggaaatcgcttgaacccgagaggtggaggttgcagtgagccgagatcgagccaccacactccagcttgggtgacagactgaaactccatctcaaaaaaaaaaaaaaagagagccaggaagtaagtgagacagataagatcaacacagagcatgctaaacagaaaagtaggaaagacatactattcagtgttggggtgggtggggagattaatatttcagaaagggtagcctgggaagggctcattgagaagctgactgttgaataaagattggcaggaattacgcaaccagccgtgtagatctctgggagaggagaattccggggagaagggacagtcagtgcaaaggcccttaggccagagcatgcttggggttcaagaaacagagtgagtgccagtgtgcctgaagcccagtacagaagggagaaggttgtcggagatgaaggcaaagaggtaatgacgggtgggttagagtttgcagggcctttggaagctgtgagaaggattttggctttttttctgggtcagaggggagccagtgcaggagtttgagcagaggagtggcatattacggttctccagagaaagggaaccaacaggatatacacatgtctacattaatcaattaattattttgagggggttctccagagaaagggaaccaacaggatatacacatgtctacattaatcaattaattaattttgagattgagtttcgctctttcacccaggctggagtgcagtggcacgatctcggcctactgcaacctccatctcctgggttcaagtgattctcatgcttcagcatcccaagtagctgggattacaggtgcccgccaccacacctggctagtttttgtacttgagacagggtttcaccatgttggccagcctggtctcgaactcctgacctcaggtgttccacccgcctcattcttcccaagtgctgggattacaggcatgagccaccatgcccggcctatattaatttctttacagagatttattataatgaattggctcgcatgattatggaggccgagaagtcccaagatcggcagctggcaaacaggagacccaggagaactgatgatttagctccagtgtgaggcccaaagaccctgtgagttcccaggagagccaatgacataagttctggtcctaacgcgagcagacttgagatgcaggaaaagccaatgtttcagttcaagtctcagggtggaaaagcacagtgtcccagcccaagcaggcaggcagcaggagttctcttgtactgtgcctttttgttctatatgggccttcaacggattggatggggcccacccacattagggagggcgacttgctctattcagtctgcagttcaaatgtgaatctcacccaggaacacccttacagacacacactcacaataatgtttgaacaaaaatatctgggggccaggcatggtggctcacacctgtagtcccagcactctggaaagccaaaatgcgtggatcacttgaggccaggagtttgagaccagcctgagcaacatgacaaaaccctgtatctataaaaaaaaatacaaaaattagctggtatgatggcaccacatgtggtaccagctactcaggaggctaaggtggaaggatcgtctgagttcagggaggttgaggctgcagtgagccatgactgactgtgccaccgcactccagcctgagcgacagagcaagaccttgtctcaaaaaaaaaaaaaaaaaaaaaaaatctgggcagcccgtggcccagtcaaactgacacatcaaattgaccatcccaagtggcttcactggatgtagctttctacaggctctctctggctgtggtgttgagaatagtatgaaggtaggggtagggttggggagtcagaagcaggaaggtgaatttggtggctaccatatagtcatccaggtaagtgtggtggtggcttggactaaagtggtagtaagaggtgtgacgaggttattagattctggatgtattttgaaaggagtgcagatggggtgagagagagaagaagagaaataatgggtgacctgtggtttttggcttcagcaccttaaagaatgaggttgccactgattgagaagggagtatcaggagtatggcggacacgttgagtgtgagaaatgtaagctttggaggagatgtggggtcagcaggtagatgtccatgcctggagtccagcagagcagcctgggccagacagctggatttgggagctgtcattagcacctgcctggctgtcttcattattgcatcaagagtggctcttggttgcaagtaacagaaaacctggctgcaggccagacatggtggctcacgcctgtaatcccagcactttgggaggccgaggtgggtggatcacctgaggtcaggagtttgagaccagcccggccaacacggtgaaaccctgtctctactaaaactacaaaaattaaccgggtgtggtggcatgtgcctgtaatctcagctactcaggaggctgaggcaggagaatcgcttgaacctgggaggcagagtttgggtaagctgagattgcaccattgtactccagcctgggtgacacagcaaaactccatctcagaaaaagaaaacttagttgccttgagcaaaaacagaaattattggaaaactctaggggtccacaaacccaccaggaagctggggatccaggctggggaaatgagtgggggccaaggaggctgtgaagatctgagcagcggcagccacagaaaaggccccggcaggagcaatccggtcctaaaacccccatggctaccatgtggataggccctcctgcggccccttgctgggatcaccgctcatgatgcagagtctgaggagagcagctcattggttcaaccaagccacatgaccttcaggctggggtgcagggagggaggcctggccacttagggtttccattttcttttttctgagacagagtctcgctctgtcacgcaggctggagtgcagtggtgtgatctcagctcactgcaacctccgcctcccggattcaagtgattctcctgcctcagcctccccagtagctatgattacaggtgcgtgctaccatgcttgcctaattgttgtatttttagtagagacggggtttcaccatgatgaccaggctggtcttgaactcctgaccttaagtgatccacccgtctcggcctctcaaagtgttgagattacaggcgtgagccactgcacccagcccactgagggtttcctagtggaggaggaggccaccatcccctcattgtggtgtttataatggggaactcccagaggagccaccagggtaaaagaggaagagatgagatgttggactggcataaaaaaagaaaagcagaccaaaactccagcgtgacagcagcaaagcccatcacaactgcatcataattatcatcagcagcaatagcagctggagtgatttcttttctttttttgagacagggtcttgctctatcacacaggctggagtacagtggtgtgatcgtagctcactgcagcctcgacctcccaggctcaagcagtcctcctgcctcagcctcttgagcagctgggactacaggcacaagccactataccaggctaagttaaaaaaaaaaaaaaaagtgtagagatggagtctcacttaggctggtcttgaactcctggcctcaagcaatcctcctacctcggcctcccaaaatgctgggattacaggcaggagccaccttgccaggctgatcttttaaattctttcagcgtcaaagccaaagttttctcaatgtcctaaaaggccccaggccctctgccctccctcccctgctaccccgccctgtggcctctctgacctcatctcctgttgttcctgccttgctcattcttccccagcctcactggtcccctggctgcggctccaaaacgctggccactcctgccccaggacacttgcctttgctctcttccgtgcccttcccagacatccccacgacttgctcccttactgccttcaggcttctctctctctctctctctcttttttttttttttttggagatggagtctcactctgttgcccaggctggagttcagtggtgtgatcttgcctcactgcaacctccatctcttgggttcaagtgatccttctgcctcagcctcctgagtagcgggggttacaggcgcatgccaccatgcccggctaatatttgtatttttagtagagatggggttttgccatgttggccaggctagtttcaaattcctggcctcaagtgatctgcctgcctcagcctcccaaagtgctgtgattacaggcatgcgccacggtgccccgctgagacttttctccaatgtgaccttctcagccagacatccttgatgatgccatttacatttgcaatgctccctctatcccatctcctcccaggaatgcctcttcatgtctttgctttttttttttttcccccacagaacttctcatcatcttcatgctacatatctctgtttcttgtgtatctccctcctccatgtggatgggggtttccagaaccgagcctggtatggagcaggcggtcaggatttgctcttgaatgaaggatgggggttcactccctggagctatgttgggagccctgttctgaggagctctggcttcgtgggtccccaggacccagggtaagacagtccactccttgggcaatgactgggaccagtacctggggaggttggggcccttcatcccaactcagtcccatccttgagggaatcaactgtgactcacagctaacagggtgagcagagctgcttcttcagtcacgaatgaaaataaccttgtctctgtaaacaaacagctctcaatttattcattgggaagaaagaagtgtgtgtggaaagaaggaggcactttcctggggggcggagtgtcagagtgttagacttgagttactcagagtaattgattcacgatgctgcgtgtcaggggtgttacatctaatcgggagctgtccatacaatttctcactaattgtcactgggcgccataacaggataatgactgttggggcacaagagacttggatgtggtgagccaagggtatcattttgatttttgttttgagatgtgctggaactcagatgaccctccttaccgaaaggctccatccctttaaatttttttttttttttttttaagagatgatgtttttctgcgctatgttgcccaggctggtctcaaactcctgggcttaagtgatccttccacttcagtctcccaagtagtggggaatgcaggtgtgagccactgcacccgactgaaaagctcattctttttttgttgagacagggtctcacgctgtcacccagacttggagtgcagtggcgtgctcacggctcactctagccttgacctctcaggctcaagctatccttccatctcattctcccaggtaggtgggactacaggcatgtgccaccatgcctggctaatttttttattttttgtagagacgggggtctcactatgttgcccaggctagtctcacactcctgagctcaagcgatcctcccaccttggcctcccaacatgctgggattacaggcatgtggaaggttcattgtttagccagagttttgttctggaccggagacaatctagagggatgcagacctgggcttggaccaccagaggtctggctggacccctgggggccagaagtgcctagttgaggggtatcttcttggactcgttacttactcctcactttgaacctgtcaccaagtgtgtcagttttgcctctaaagcatctgtcagctctgtccacttctctccactcccactgccaccccctgctttcacctggtgaccacagacgctgcttagcttctgctctgtctcttattcccttccctttgcctctacccgggagcatacatgtaatggtgacagttccctgcataacacactgcagcggtcccattcccttgaggatgaagaccaaaatccttaacatggctcaagagatcccacaaccatctggcccctgcccacttctcagcctcactgttcaccattttctccaggcaaaaggaaggaccagtgacctaagaatgccatggggctgctgccctcattttgcactctaggattttgaccttattatttcctgtgcatgggatgctttcttcccctccctccctccctttcttccttccttccttccatccatcctctttctttctctctcctctccctctctctctctccctccctccctcccctcccctgcctcccttcctcctcctcctccttctttcccctctctctctctttctttttgagacagggtctcattctgtcacccaggctggagtgcagtagtgtgatcgtggctcactgcagcctcaacctcctgggctcaagtgatcctcccaccctagcctcctgaggagctggataccactgtgtgcagtgagtgcatgccactgtgcccagctaattttttgtattttttgcagagatggaggttttgccacgttgcacagtctggtctcaaactcctgggctcaagtgatctgcccacctcggcctcccaaagtgctgggattacaggcatgagccaccgcacctggcctaggagctgcttcttagatcttccgcagctctttctcatcaccagctaaaatgctgtattctggtagcattgtctttatcctcctctggactgtatctctcttgaagtcttccattccagttcatttctcctgagcctagtacaataatacatagaaagcgctgggatatttttaaaaatactaatgtttagaatcaattttaattccttctgtaaaaaatatacgtattttgcctttttaaaaaaatgcaaaactgggccaggtttagtggggcatgcctctagtcccagctacttgggaggctgaggtgggaggatggctggagcccaggagttcgaggctgcagtgagccatgattgcaccactgcactccaacctgggcaatagagtgagatcctatctcaaaaaaaaaaaaaaaaaaaaaaaaggaaaactcaagtccttttagtgatcacaccaagttcctgcaccttgtcgcttttttattttattttattttatttttttgagacagagtcttgctctgtctcccaggctgaagtgcagtggcatgataccaacttactgcaacctccgcctcctgggttcaagcgattctcctgcctcagcctcctgagtagctgggattacaggcatgtgccaccatgactggctaaattttttgtatttttagtagagacagggtttcaccatgatggtcaggctggttttgaactcctggcctcaagtgatccttctgccttggcctcccaaagtgctgggattacaggcgtgagccatcacgctcggccagcccttgtttttatgaacatcgtgtatccttaaggaccttcaaatacttctgcatccatttgtatgcatctttagttttgttctgaaaacctcaagatatagcacgctatgtgtatagtttgcaacttgaatttttttcactcaacactgtgtttctgagaccaatcctcgctgatacatagagagctagttaattcctcctgccttctgcatagcatctcactatgttattaattgccttttgttttctcaagctatttctgtgttgatgggcatttgtgttgtgtctactgccttgctattgaaaatagcacttcagtgcgtgcaccgcgtaggcctctgtgtactaccgtgaagtgtttcctgaggccagtagttctcaacttggctgcagacagaatcacctgaacgttttttttttaacaatcacaccaactctctgcctttccccaaattcttaattgaatggttcagggtaggcatcggcagttttagaagctccagggtgcttctaaatgtgcattcagggttgagacctgctgttctggggtgtacattggggatgttggtgttgcaatgactgggccaaaagaagaacccaaccccgtgttttaccaggctctgcccaattgcctttcaaggtgactgaactgatctacatcctgctggcagtgtgtgagcgaataatgactgttttgtgtgaacaagtgactaccagtcactgcaggtcagtgaaccagagcgttctccactgcacaaactgcctccaagtggctcatcaccatgggctacagcccacaaacgtctgagcttggaatgctttgtgtccttaggtggcagcttggtgcagctgaaaaggtgccaggctgctaatgggacaattcggagtccagttcagacccaggttctaccttgctatgtgtcctcccaggtcacatccccacactgagcctcagcatccctgcccttggagggaggagagctggaaactcacctgcggtcattttcatgtttctcttctgtctgagccacacgttacttgcagcctgtggtctgagcatgggcgttagagcccagtcctgaatagtttctgcactgtgggccctgttggtatctggggaagcctattacccttctcagagcaatgtttctttttcttctcttttctttcttttcttttctttcattttttgtttgagacagagtctcgctctgtcactgaggctggagtgcagtggcatgatcttggctcactgcaacctctacatcctgggttcgagtgattatcctgccttagtctcctgagtagctgggattacaggtgcctgccaccacgcccggctaatttttgtatttttagtagtgatggggtttcaccatgctggccaggctggtctcagacagctgacctcaggtgatccacccgccttggcctcccaaagtgctgggattacaggcgtgagccacctcgcccggccttttttttttttttttttttttagagacggagtgtccctgtgtccctctgtcacctaggctggagtgcagtggcttcatctcagctcactgacctccgcctcccaggttcaagtgcttctcctgcctcagtctcccaagtagctgggactataggcatgcaccaccacgcccagctaatttttgtgtttttcagtagagatagggtttcaccatgttggccaggctggtcttgaactcctggcctcaagtgatctgcctgccttggcctcccagagcactgggattacaggtgtgagccactgctcccagcctctgagcaatgtttctaaatatgaaatccaaaggcttgtgaagacaactgattatatggaaatacagctgatataaatattacaaaattattacaaaaatattacaaagccaaactgtgatatagcaatacccatgcctctttattaacacaccaaataaggcgatctgatggtgggttggcaacattattacgattgcagtttaaagcagtgatgagtgtaaatgatattccaacatctttgcaacaaatgtaacaggacatgaaaatatctgtgattcctgttggtgacaaagttacaggttctgttgacacgacggcagtttgctgcctacactcataatggaaagaattgctacattgcagtttgatgttagtaaaattaagaggtctattttttcttccgagttcattgagttcattgattgcaggttactggcccttgctagagttatatagacttgagtttctttcttttttgtgagttttttttttttttttgacggagtcttgctcgtcgttcaggctggagtgcagtggcacgatctcggttcaccgtaacctccacctcccgagttcaggcgattctcctgcttcagcctcctgagtagctgggattacagcatgtgctaccacgctcagctaatttgtgcatttttagtagagacagggtttcaccatgttggtcaggctggtctcgaactcctgacctcaggtgatatgccccctcccctccttggcctcccaaactgctaggattacaggtgtgagccattgtgccctgcttttttgtggctttttaaaaatttttattttgtagagacgaagtctcactgtgttgtccaggctggtcttgagctcctgagctcaggtgatctttctgcctcagactcccaaaatgctgggattacaggcataaaccaccatcccaggctagacatgggtttcaatctctgctctatagcttcctgtgtgggtgcatttgggtaaattccttttctttcctgagtctcagtttcctcaactgtaaaatgcatgtaagacagtgagctcctagggtgctgggaagagtaaatgtgacaaatcaaattcaacacacatttgtagagaacttttgatgtgctcagggccattttcggtgccaggatgctggaccgaatgagaagggcaaaatccttgcccctctggagtttacagttcgggggcagagacaatgaataatgaggcagataagtaaataacggtttcagataatactaagggcaatgaagaaaatagtacaggtgatatgaaagggaacaaatgcctggtgcaggtgacattaaatagggcaattaggtaataatacagacagaaatgaacaatattgatgcataagacgagagaatgtatttgaagtatcagctcggcacctggtacgtggtgtatgttccatttgtgctggccacggtgatgatgatgatgatgccatctctccggctacactgcgagcacagatcacagctctctgtagctgatgctggctctacccactgtattcggggctggatgaaggtggggccatggaagcgttctacacaagaactcagcagtcctgttggagccagattggaaggaagcaggtctgattaaaggaagataaagtcttctctctgctaagtctcgcagggagagctaggcaatcaataggtctcgcagatcagtggagggtgcttggaatctggcagcatggggctttttaattaaacctataactgtgagaaaaggtaactgccttatttctgcagcttgtgtttctgtctgcctgccagaaactgaacaaatcaatgcacttccagaggttctgaggatcttgacaagggggcctctggttttgggatggccagaccctgcagggataaactctcgagtggccagggtgtcaggtaccaattctggagggtcaggtgttgccttttacatttaaatacccatagcaggtgtgattagcaactgcaattcaggggaaggcgaggccccttcccagccagcagcagcttgccttccaggattttataccaagctggccccctaccaccacaagatgtcaacattcctttttttaatagaagattttcttttattgtgggccaggcatggcggcttgctcctataatcccagcactttgggaggccgaggctggcagatcacttgaggtcaggagttccagactatcctggtcaacatggagaaacccctgtctctactaaaaatacaaaattagcttggcatggtggtgtatgcctgtaatcccagctactcagaaggctgaggcacgatcatcatttgaatccgggaggcagaggttgcagtgagctgagatcacaccattgcactccagcctgggcaacagagtgagtctccatctcaaaaaaaaaaaaaaaaaaaaaaaaagattttcgtttatcatgaagtagaattatgctgtttagggtatggtccatgcaccagcatcacagcatcatctgctgggaatgtgtcagagatacagaactccagccccaccccagacctactcagttagaatctgcattttaaccagatcatcaggaattcatatgcatattgatgtgtgagaggcactgaaattgaacatacatatgagacttagaagacaaagaagccaaatgccaatatgcagaccttatttaaatcctgagagagttaagaagttatctatgagataatttgagatttgaacatttgcagatattaaggaattattcatttcctaggtgatagggaggttttatttcaaaaaaaaaaaaaaagagcccttttggccatgcgcgatggctcatgcctgtaatcccagcactttgggaggctgatgtgggtggatcacctgaagtcaggagttcaagcccagcctggccaacatggtgaaatcccgtctctactaaaaatacaaaattagctaggcgtggtagtaggtgcctgtaatcccagctactcaggaggctgaggcaggagaattgcttgaacctgggaggcagaggttgcagtgagccgaggtcttgccactgcactccagtctgggcaacaagaatgaaactctgtttcagagaaaaaaaaaaacccttttcttttagagttacacatgaaaatacttagagataaaatgatttcatgctcgcatttgttttaaaatactggtggagctagacaaagtcttgacgtttggacacagcacgaatgactgtgagttgatggtatggggaactgtgtcacgacccaggcagacacagtacacagtatactgtttacttagtatatgtttcaaattccccacggtaaaaacctaagatgatgatatagaatattcacatagaaaatgcatgaaacaggctgggcacagtggctcacgcctgtaatcccagcactttgggaggacaaggtgggcagatcacctaaggtcaggagtttgagaccagcctggccaacatggcgaaaccccgtctctactaaaaaatacaaaagttagctgggcatggtggtgggcgcctgtaatccccgctactcaggaggctgaggcagggagaattgcttgaacctggaaggcagaggttatagtgaactgagatcacgccactgcactccagcctgggcgacagagcaagattctgtctcaaattaaaaaaaaaaaaaaaaaaaagaaaaagaaatgcatgaaacaggaaggtgttgtgatgagcattagttcaagtggacatccataaatctgttaccaggtcattaccggctcctgccctctgtcagaacctctgccccagagtaatttcttccctcccattctctggggcgctctcacccctagctgcctatggaatcgcctgggaaaactttacaaaacaatgcagttgagcctcctccagtccaatgaaaacatactccctgggagtgcgcacaggtgattctaatgtgcgaccttagctgccctagcttttcaggtgaatgccatatttgtgcttgaatttctcaacgagcttactgctgcttacatccaacaggcaatttcactttctcatcaagggactgagttgctggactgttgtataagcacaggttacattgcaacccatttttttccttttttttttttttttgtttgagactatgtttcgccgtgttgcctaggctggactcaaacttctgggctcaagtgatcctctctcttcagcctcttgaggagatggggctttagctaccgtgcctggcttgcaacccatttttgaaactaatgggtttttgtgtatttgtgataaatgtgtatctaccacatattgagtgctttccatttctctggaactctgctaagtactttattttatttaatccccaaaacgattgtggggtcagcatccctgtccctattatactgatgaagaaacaggctcagagagactatgtggcttgcttcaggtcacccagtttaaaaagtgctgagtgtggattgggttcatagctctctgacttaatgctcttaagcatcattttgtgccgttcattcagggtcttgattgaagagttgagggccagttagccacccacaatgaactggaagtaaacatggagaggtcgtcacagtgtcactcgaggcacacttaagtggtgtgccttggagctgagtttccgtctttgtcaaatggggacagcactgttttgtcttctctggctgacaacctcttactcatctctcaaaagtgcgtcagttgtcacagaatggggaagccggaaagctcctctgaatttcaagggacctcctggctaaagcagaattagtcatgtcctcctctagcctcacagaccacttgtccaggtctctgagagcagtcgacaggagccctacacttgtcatgtgagacactggcgcgtctaagaacaggtgctgttttgtagctatttctctgtctgcagagtccagcccaggggctggagcatggcaggggcccctgcatgtctgcaatttgaatgaaagacgagggtactgctcaaacaccaaagctttggtcagagcctaggatgtactgacacaggaccctttgggcagagatatatcacacacagccacaggagagtggttaggaacctggactctgaatgaagactgcctgggttcaagtccaagctctgccacttacaagctgaatgaccttgggcaagttatctcacttccctgggcctccctttcctcatctgaaaaaatggctacattgcagccttgttataaggattgaatgggtgggtgcagtggctcatgcctgtaatcccagcactttgggaggccgaggaaggtggatcacaaggtcaggagtttgagaccagccaggccaacatagtgaaacccgtctctactaaaaatacaaaaattagccgaaaaattaaccgggtgtggtggcacgtgcctgtagtcccagctactcaggaggctgaggcaggagaatcgcttgaacctgggaggcagaggttgcagtgagccgagaccatgccattgcactgtagcctgggtgacagagtgagagactccatctcaaaaaaaaaaaaaaaaaaagaaacttaactgggcatggtggaatccacctgtagtcccagctcctcaggaggccgaggtgggaggatcacttagcccaggagtttgaggctgcagtgagccactgcactccaacctgggtgatgtagtgagaccctgtcttaaaagaagaagaagaaaaaagaatgagtttgtattttaaaagcacttcaatgatgcctggcactctggtgccaggggccaaaggaaaagttagtaataccaatcatttcctgaagactgtgatatttgtttatcatgggtatttttgcattaattttgcattaattttttcattctttttcgtttttaaacatattgcatccaagtgttatttatcttgatgactgggtgtttggtgcctccttaaattttgctcccggggagaatgtctcacttgcctctccctcatcccggtcctggcacctaagaagcaacacatcagttctcatttgtctggagggagctcagcatcattatatgtatttaaagaaaaagatgaatgtgtatatattaccaatacttattcagaatctacaaaactctgagcactggggatgggactgtgtgatggttaataccgagtgtcaacttgattggattgaaggatgcaaagtattgttcctgggtgtctgtgagggtgttgccaaaggagatgaacatttgagtcaatggactgggaaaggcagacccaccctcaatctgggtggataccatctaatcagctaccagcatggccagaataaaagcaggaagatggacatggaaggacttgacttgctgagtcttctggccttcatctttctcccatgctggatgcttcctgcccaacataagactcaaagtcttcagtttttggactcttagacctacaccagtgtttgccaggggctctcggaccttaggccacagacggaaggctgcaccgtctgcttccccacttttgaggtgttgggacttggactgatccactactggcttccttgctcctcaacttgcagacggcctatcgtgggactttaccttgtgattgtgtgagtcaattctccttaatacactccctttcatatacacatatatcctattagttctgtccttctagagaaccctgactaatacaggctgggaatgagacattctcagccacggtctttgacctcaaggagttgacagatcactgattattgttaccacttattgagcatttactgtatgcaagacatggtgctagtgatgtttttattaatccttgtggtgacctttccagaaagaatcattacattcattttacagatgaagaaattggactcagagcaattaagccacttgcctgaagtcatgaagttatgagctggggtcaggatgtgaacccagtctccctatctatctatctatctatctatctatctatctatctatctatctacctatctatctatctatctatctatctatctatatcagggtcttgctctgtcacccaggctgggatgcagtggtgtgatcatagctcactgcagcctcaacaccctaggctcaagcgattctcctgcctcagcctcctgaggagctgggactacaggtgcacacaaccatgcctggctaatttttagatttttattgtagagatgggggtctcactatattgcctagctggcctcaaactcctgtggcaaagtgatcctcccacctctgtctcccaaaatgttgggattacagttgtgagccaccatgcctagccctgtgaacccagtcttttagactttctaccacggtatttgggtaagtccagagctctgtccccatcttctgcaagaacatcttgaaagctgaagttatcagatggatttttctgggagttccattgctgagttcctctgattcatgtctcaggaagctggagtctagacgtggcggggcctgtgggaggtggccctccccttttcagagtggatctgtgcagccatctgccatcacccattcctgtgggggaaaacacagattttcctgtgttaaaaaatctctgagacaagactttggcaggatctgaacagactggcgaagtggctccaggatttcctggaaaaggatgagaagggggaaagagagggcaaaggagaggaggagagagtgggagggaaagaaggaggtcagggagaagaaaaatgagcaggaagagccagcagacagcctcccaggtggatgtctttgaaggtaactgaaatgcatggtggggttttcccaaagggtttctgttagacatttcccactcccagtagggaaactggcttccctaatcagggaagggcagttcagggcagtggagcagtgggtgtcgataatgcccatcttgcagactagttgcgaagttccagtgagattgaatatctgaagtgtagtgttggcacacaataggtattcaacaatgtcagttcagttctctccttttttattttttatttttatttatttatttattttttgagatggggagtctagctcttgtcgcccaggctggagtgcaattgcccaatctcggctcactgcaatctttgcttcccaggttcaagggattctcctgcctcagcctcccgagtagctgggattacaggcacccgccaccatgctcagctaatttttgtatttttagtagagacggggtttcaccatgttggccaggctagtctcgaactcctgacctcaggtgatcttcccacttcagcctcccaaagtgctggggtaacaggcatgagccactgcgcccagctagttctctccttttttaaagacaggctcttactctcttgcccaggctggagtacagtggcacaatcatagttcaccacagcctcaacctcgtgggctcaagtggccctcctgcctcggcctcctgagtagctgggactacaggcatgcaccaccacaccccactaattaacaaattagtggaacgtagtggcaggcacctgtaatcccagctactccggaggctgaggcaggagaatcgcttgaacccaagaggtggaggttgtagtgagctgagattacgccactgcactccagcctgggtgacagatcaagactccatctcgaaataaaaagaaagcaaaaggttccttcattctcctgcctttatccattcactcagcacagtgagcacctaagtgtgccaagcactgtccaaggtactggagatataacagtgaacaaaacagacaaaagcccctgccctcgtggagctgagattctactgcggtaggaaaaagtaaaaaagaaatagataatattataggaacttagagagctgtgaaagctaaggataaacaaagcagagaaggaggatgaggggatgttagggatattggtttcctagttttttctgctataacaaattacagcatgaatctaggggctttaaacaacccatatgtgttatcttatagttctggaggtcagaactctaaaatggatcagcagggctgtatttcttcgggaagctctaggggagaaaccatttccttgccttttctggtttctagaggcttcctgcattccttggatcatggccctacgtcattctgatctacatcactcctcagtctctgaccctcttgcttcccttttataagagcctttgcaattagattgagccatacagataatctaggataatctcctcatctcaaaatccttactttaatcacatctgcaacctcctttttaccatgtaaagtaacattcacaggttctgggtatcagcatgtggacatatttggggagggggtagttgtgaattattctgtctaccacaggaacagagattttagataaggtggccaggaaatagcttatttatttatttgtttttagagacagggtctcactctgtcacccaggctggagggcagtggtacaatcatagctcactgcatccttgaactgtgggctcaagtgaacttcccacttcagcctcctgagtagctgggactacaggtgtgtgccatcacacccggctattttctttttttgtagagacagggtcttgctatgttgctcaggctggtctcaacctcctaggcccaagtgatactcccgcctcagcatcccaaagtgttgggattacaggcacaagccaccacgccttcccagaagaacttattgatgtgacttttgagtagggacctgaaggaagtgacggatagacacctggggagagaaccttccagggagaggaaatgttagtgcaaaggctctgaggagagagtacaatgagtgtctgtgtttgaggaccagcggggaggccagaaaggtcacagcagggagatccaggggcagaaagacaggaactgaggtcaaagaggtcctatgggtgggggtaagggagaggtcatgaaaggccttatagatgattgtgagaaaaatgtcttcctctgaatgagacggaaaaccataagacagtttctctaagcacctgttcaataactgactatgaaagaaaatctgggccaggcacagtggctcatgcttgtaatcccagcactttttgaggctgaggcgggtggatcacttgaggccaggagtttgagaccaccatgggcaacatagggagaccctgtttctgcaaaaataaaaacaaaaaattagcctgatgtggtggcgcacacctgcagttccagctatttgggaggctgaggtgggaggattgcttatgcccagcagtttgaagtttgaggctgcagtgagctttgatggtgccactccagcttgggtgacagaacaagaccttgtgtttctaaaaaaaacccaaaaaaacccaaaaaaaactaaaagagataagtgaaaagagaagtgcaaaatgaggtgtaaacatgtaaaaaggtgtaaggaaatatggaagggacacaattgacaagagaccagaaaattcatagaatgaagtcttcaatgtgtgaagggaaagggctaacataattatgtttcaaagaattcaaacaaatcactaagacaagtccctgaatctgggtagaaaaacaagcaaaggggtgcgaaccgtcaactcactaaagagaaaatgcaattagctaagcacatgggaaaagtcagcctaactagtaatcaaagaaatgcaaattaaaacaacaaaccgttatattttcacctcataaagattctgaaaatgagaatcctggctttggccttggtggaatgaaataggtgcaagaaccctggcagtgggaattggaaatctgattattttgggaaacagtttgacactgggtagcaaaaccttaaacatgggcatcctcattggcccaataagtcaatttttggcaatctagcccaaggaaataattttaaatctggagagagccttatgcattgctgccaaacaggagaaacaactaaactgtgagcaataggttaaataggccacggtgctcattcttttgatatttttgtcaatcatatgaattaggtgccagttatgtgccaggcactgttctaggtgccaggaatacagcagtgaacagaacatcttgaactccttgcccttcatggggttctgattctagtgagggagcaggagagcaaataagaacagatatgaagatgctacatgatgggggacaaagtagggcaatgtcacagagagtggaggggactgcagggtggacaaccaccagtttgctggggacattcagttttaaggctggggcagccctggacaaactgggatgagctagtcacactaagagggtcatccttgtgatgggagtggtcagggtcttgtcctctgaggaggtaggatttggttagggactcaatgcaatgagggagtgaacgatgggagtgctggctgagtaggtttccaggctgacagaacaatacctgcaaaggcccggaggaaggagtgttcctggggcaatgtgagggacttgcacaaggctggagtgtctggggcatagcatgaaggaggatggtggtaagatatagatttcagagagggaaactcttgactcttgcagggaaaggaagaagtttggattttattttaaatccagtgaaagcctatggaggttaagcagggaagcaacatggtaaaatttatgcttttagaaagacgactctggctgctgtgtggagaaggtgatgcaggacaagtaagccccaaagttggggcttagcttgggagggttcttggcttcacccaggaaagaattccagggtgagcggtggtggtggacacttttatttttttgagacagttttcactcttgtcacctgtgctggagtgcaatggcaagatctctgctcattccaacctctgcctcctgggttcaagtgattgtcctgcctcagcctccagagtagctgggattacaggcacccaccaccatgtctggctaatatttttttgtatttttagtaaagacagggtttcaccatgttggccaggttggttttgaactcctgaccttaggtgatccaccccctcccaaagtgctgggattacagatgtgagccaccatgcctggcctagacacttttattgaagcagcagtgcacagcagcagcagagggactgctcctcacagagcagggctaccccataggcagtgtgcccagagtagcagctcagaggcagttctgcagtcatatttatacccacttttaatgatatgcaaattaaggggggatttatgcagacatttctagaaaaaagttggtaacttccgggttgttgggtcattgccatggaaaggggcagtaactcctgggtgttgccatggcaatggtaaactgacatgccacgctggtgagagtgtctgttggaaagctgcttccactttggccctgttttttttttttttttttttttttttttttttttttttttttttttttttggtatttattgatcattcttgggtgtttctcgcagagggggatttggcagggtcataggacaatagtggagggaaggtcagcagataaacatgtgaacaagggtctctggttttcctaggcagagggccctgtggctttctgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttggggataaggttacagattaacagcgtcccaaggcagaagaatttttcttagtacagaacgaagtggagtctcctatgtctacttctttctacacagacacagcaacaatctgatctctctttcttttccccacatttctcccttttctacttgacaaaaccgccgtcgtcaccatggcccgttcccaatgagctgctgggtacacctcccagatggggtggcggccgggcagaggggctcctcacttcccagacggggcggggggcagaggcgccccccacctcccggatggggcagctggccgggcgggggctgcccccacctccctcccggacagggcggctggccgagcgggggctgccccccacctcctggacggggcggctgccaggcggagacgctcctcacttcccagacggggcggccgggcagagacactcctcacctcccagacggggtggcagtcaggcagagacactcctcagatcccagacggggtcgcggctgggcagaagcgctcctcacatcccagatggggcagcggggcagaggcactccccccatctcagatgatgggtggccgggcagagacgctcctcacttcctagacaggacggcggccgggaagaggcgctcctcacttcccagactgggcggccgggcagaggggctcctcacatcccagacgatgggtggccaggcagagacactcttcactttccagacggggtggcggctgggcagaggctgcaatctcggcactttgggaggccaaggcaggcggctgggaggtggaggttgtagtgagccgagatcacgccactgcactccagcctgggcaacactgagcactgagtgagcgagactccatctgcagtgccagcaccttgggaggcccaggcgggcagatcactcgcggtcaggagctggagaccagcctggccaacatggcgaaaccccgtctccaccaaaaaatacaaaaaccagtcaggtgtggcagtgtgcgcctgcaatcccaggcactcagcaggctgaggcaggagaatcaggcagggaggttgcagtgagccgagatggtggcagtacagtccagccttggcttggcatcagagggagaccgtggaaagtgggagacggagacgggagagggagacgggagggggagggggagggggagggcagggggagggggagggagaggggccctgttttatagctagtcttcaatttggtctggtgtctgagccccacctctggagttgagtcctgcctcctacctctaaggcatgttggtggatgcagggtagtgggcagaatagaatcatgtagaccccttagaaggttgttgtaatctagggcagtggttctcaattttaaccatgcatgagcatttcatgcaggggttgttaaaactcagcctcctgcccctggagtctacgtctggagtctgcatctctgactagctcccaggtgatgccagtgctgctggtcctggaccacattttgagtagctaaaagctaggagagagataatggggacttgcagtaaggtggtacccctgctgaggttaggaagagctctggtctgggatgcattttgaagtgaaactatcaatctcatttcagttcccttttaatctgcttacaccaaggagaatagctcaatttgatactagtatgtttctaagacttttctgtattttagctaacagaaagcaggcctcaaagtgtagagcaggctgggcgcagtggctcatgcctgtaatcccagcactttgagaggccgagacaggtggatcacttgaagtcacgagttcaagaccagcctggccaatatggagaaaccccgtctctgctaaaaatacaaaaattagttgagtgtggtggcacatgcctgtaatcccagctacttgggaggctgaggcaggagaattgcttgaacccgggaggcagaggtttcagtgagccgagatcaggccactgcattccagcctgggcgacagagcaagactccatctcagaaaaaaaaaaaaaaaagaatccaatagtgtgatagtggacaaaagaatccaatagtgtgatagtggacatgaaaatacttcatggactacaaagctcttcaccctgctatctgcttcatctttgtggggcaggctgggtgcatcaccagactcctagtcaagtgctctctcttattgttcatggccttgtgttgccccagtcctgggggaggggctgacttttctgcaggactataggaaaggagaatcatagacatatgtccacttgtcagttacctgtgtttccttcttgtgctctgggcagccgatgcactttcctgattgctgtggagcctactaggatctaggaatgaatattgtgcctggctttgggggttcaaaactctccctcttggctcttgagctgcttacttgagcccattcccactctgtggagtgtacttttgcttcaataactctgtgctttctttttgtttgtttgttttttgagatggagtctcgctctgttgcccaggctggagtgcagtggcgcgatctcggctcactgcaagctccacctccagggttcatgccattctcctgcctcagcctcccgagtagttgggactacaggcgctcaccaccatgcccggctaattttttgtattttagtagagacggggtttcaccgtgttagccaggatggtcttgatctcctgacctcgtgatccacctgcctcagcctcccaaagtgctagaattacagacgtgagccactgcatccggcaaatctgtgctttcattgatttactctttcattgctttgtatgttttgtctgagtctttgttcaaactgccaagaacctggacaccctccactggtaacatattttggcgttccagccaggggacaataacgggaaagactccatctatgctacctgatcccccgcttggctgcatcctcaaccactggtatcaatttgaccccaataatctaaggaggaaatgcttgatattcttttgcaatagtttgtccccaatattgcttggaatctggagtttgttgttgaatgggaaagtgggatggtgttgtatgtatccaagcttttgtgctgctgttctaagcagggtcaggcctggttagcatgtggtgctctcttttggtgctgtttggccccggtgttctttggaatttaaaaatcaaactggcatggaaactgctttaccccaaaattttggttcacagccttcactggattacctactggggcaaacagagtgtaaccatgtaaaaccggcgagcttgtattgctatctcatggctagagttccaaggtaaaagccatttggatcttcatttgtgtgcgtgtatacatgtctaaatgtgtttatttgtatgtagacttactgttatatgttgtgcctaccacattggcttataagtaagagagtgcccataacttaataagtccaagcaattttcaagttcacgtgacttaagtaaatctttacgaaactagctagctttaaaattattggtaaatacaaatagaaatgtcttcagaattggcaacatacatttttatctgggttttatgtttttgtctttgctagatattttgaggtgtcaaggctatcaggctgggcgtggtggctcacatttgtaatgccagcactttgggaggccgaggtgggcggatcacctgaggtcaggagttggagaccagcctggtcaacatggtgaagccccgtttctactaaaaatacaaaaattagccaggtgtggtggcatgtgcctgtaatcccagctacttgggaggctgagggaggaggatcacttgaaccagggaggtggaagttgcagcaagccaagatagtaccactgcactccagcctgggtgacagagggagactcactgtctaaaaaaaaaaaagttataaagctattaacccagccaaaacaacaaaaacaaaaaactgtcccttttgcctttggttcactcttggatccagatggaaatctccagctgttctggtgttctggaccaagaagtttgagaaaataagaatccatggacaagaaaattttgaggtagtggttcagagttctggctcgtggcctcagttccaatcctggttctatccttgcttggtgtgaggccttaggaaatctccttgtgtcagtctgggtcctccgagaagcagagcttgctttgagactcaacatgcaaggattttttttttttgagacggagtctcactctgtcgcccaggctggagtgcagtggcacgatctcagctcactgcaagctccacctcccgggttcacgccattctcctgcctcagcctcctgagtagctgggactacaggcgcctgccaccatgcccggctaatttttttgtatttttagtagagacggggtttcaccgtgttagccaggatggtctcgatctcctgacctcatgattcacccgccttggcctcccaaagtgctgggattacaggcgtgagccaccgcacctggcctaacatgcaagggttttgttaggggaaacccttgtgtgaaaggagttagacagtgatgaagcctgactccaagggaggagaagagagaatgttggtggaactgtccgtgctgtgcggtctaaagaaaattggggtttccaaagtcagttgtcaagggcccctgtgttttctaggaatgagctgccttagtttctgtgctgccatacactattgatgggtgagatggattttaaatctagctgggcccttgctctcttatgctccccatagctggaggtcagtggcaggtgcattcttgtggccacgcatcacttaacctctcatgggattgttactacaatcaaatgagacaaggtgtgtaaaacacttggtacaagatctggcataaatactcaacatattttaactattatgattacccagttattctttcgaagccaacaagaaagttttcttctccttttgttatcaaccattccctgcatcagaggctgctaattcagtcagattccctgtaaatgagtgatgtgggccaagtgtaagacattagagagtgggagggactatggtaaactagaaagcacatgaaacatctaaaatggtttgaaaaatagctgggcgtggtggctcatgcctgtaatcctagcactccgtctcaaaaaaaaaaaaaaaaaaaaaaacccaacccaaaaccaccccaaaaaccccagtgaggttgattttcccacccccccaaacccattaataaatttgttgtgtatttgacgacatggagagacctggctggttgatttctggttttgtgcacagcttcagtgttgtcttttctgagaggttttgaatgtggacatcgggattggatggcatgggttgggatcttggctctcccacttgccagccatgagatattgggcaaattatgaaatctcgggcaaattatgaaatttcctggtaactcagtttttccatctgtaaaatggggataataatgattctcccctcatgaaatttcaatgaggatttaatatacagaaggagtttaggacagtgtctggaacatagtaaggctgagtaagtgttgatgttattctggggttgagagaaggagcaagaacaaccttgggttgctggaggctctcatggtttttcctcatcatttcattccacttaagcctaaaacaatatgatcggtataacacccagacaggaatgagtttctcttataccggtgatataatcatatataataatgccacttacataagcttccttagctccttgttaaggccacccacactccgttccacttcacactgttaaggaatgtttctcccacagggaaaaagacacccagctctatgctaattaccactttaaagcagggaccaaggggtgtgagggggggaaaccagcaaaggtgtctttggcagtgctcttgatttgggagagtaaagtctttagtttggaagcagtgagtcaggcctggggacctcagaggagccagaggcaacccatggtgtcccccagattaggcaggcccaacctacgccttaggtgaaaagtgtctgtgagccagccctctgcagacaaatgctaatctgccatttcttttattgcttaaaaaaagagagtctgagacatattctacgtgtgatacaagctcattgtggaaaatatggaaaatagatgggaacaaaatgaaagtgtaaaagtcagaagtcatgagcgatgaatatagtcaagctaacagaaaaaatataaaaagtcagaactcattcagctgaaagtgtcagaaatcaattgcaaactggtttagatgattcaagagaatatattggcccacagaacaaggctgtcacagaggtggatcaggcatggctgtatccagggctcaaacgttattagcggaatgccatcttgcttgctctgtctctatttcatgaataggccttctccagatggtggaaaaggtagacattatcaattccagattaatctccaccaactgaacaatgctactagaaaggaagaggctcttcccagtgctcagataggaaagtctcagggagggacttgattggctgaagatgtaccacgtgtgcatccttgaaccagtccctgtggttggggatgtaccacctgtgcatccttgaaccaatccctgtggttggggatgaggtgctctgattggccagatcagtgagtcaatggccaggggagatgaaatcaaggaatggtccacttaaataggtcctccacagggagtggtgattctgttccaaaagaaagagaaggaaatgaattgatgaaaacaatggatattgctatataagaagcatataacatctgtaatcccagcactttgggaggctgaggtgggcggatcacctgaggtcgggagttcgagaccagcctgaccaacatggagaaaccctgtctctactaaatataaatatatatatatttagctgggtgtggtggcacgtcccagctactcgggagactgaggcaggagaattgcttgaacctgggaggcagaggttgctgtgagccaagatgacaccattgcactccagcctgggtaacaagaacaaaacttcatctcaaaaaaaaaaaaaaaaaaaaaaaagaggtcaggtgcagtggtcacgcctgtaatcccagcactttgggaggctgaggtggtcggatcacgaggtcaggagatcgagaccatcctggctaacatggtgaaaccctgtctctactaaaaatacaaaaaaattagctgggtgtggtagcgggcgcctgtagtcccagctactcgggaggctgaggcaggagaatggcgtgaacccgggaggcggagcttgcagtgagccgagatcgcgccactgcactccagcctgggcgacagagcaagactctgcctcaaaaaacaaaacaaaacaaaaaaaagagaagcaaatgacaagtttccaatacttgcaccatctagaaataatgactgttgacttcttaatgtaaatcctcccagaattcacttccccttatttagctatacttataagcatatactagatacatagaacattgagatatcctatgcaaacttttgtaagctgattttgattgccttgtttaaaaatatcatttagatattttgaaatataagtggcatatcttctgggtagaaaaattagagaatatggacaaacaaaaataaaataactttttttaaataatttttttttttgaaacagagtcactctatcacccaggctggagtacagtagcatgatcttggctcactgcacctccacctcctgggttcaagcgattttcatgcctcagtctcctgagtagctgggattacaagtgcatgcaaccacgcccagctaatttctgtatttttagtagagacggggtttctccatgttgtccaggctgggattgaactcctggtctcaagcaatctgcctgcctcggcctcccaaagtgctgggattacaggtgtgagccaccacacctgatctaaaataacttataattggctggggttaatagtaagacttttaagaagccagattaagggcagggttgagatagaggaagaataatttgtcagagctcctcttatgataccctgtagtccctctttgcagtgctttgcacatttgtaattttacattaattactcaaagtggcttatttaaaataattttattctctaagtgttgctttccttaaaagaaataagaaaaaaaacccagaaaaaaagtgacctaaaataattttattctgaactatttcaggcacacaaaaaactataaagaccagtacagtgaacaaccatttacccgtcactcagtttaaaaaatataacaaagacaatcaagtccttctgtggacccctcttaatctcgtgctcctttctctcttccttccttcccaatgggatctctatcctgcagttgtgtcttatatttcatgcctattttgtattcttattgaatatatgttatccattatcaacatataacattatgttgcatatttaaacactttaagtagactaccactgtatgtattgttctcatggcttgctttttggttcattgttatgattttgcaatttatttttatttttatttatttatttatttttgagacagagtttcattcactcttgttgcccaggctggagtgcaatggtgtgatttcagctcactgcaacctccgcctcccaggttcaagtgattctcctgcctcaacctcctgagtagctgggattacaggcaggcgccaccatgcccagctaattttgtatttttggtagagatggggtttctccacgttggttaggctggtctcgaactcccgacctcaggtgacccgcccgccttggcctcccaaagtgctgggattacaggcgtgagccactgggcctggccgattttgcaaagtgttaatgttgatacaggttatgtttcatttattttctactattgttagtgttaatctgttagtactagcatccatggtagaactcaatcataattaatctatctattctgcagatggacatttaggttccttttttttttttttttttcttgagacagagtctcgctcttttgcccggctggagtgcaatggcgccatctcggctcactgcaaactccacctcctgggttcaggtgattctcgtgcctcagcctcctgagtagctgtgactacagcacccaccaccacacttggctaatttttgtatatttagtagagatggggttttgccatgctggccagggtggtcttgaacttctgacctctggtgatccgcccaccttggcctcccaaagtgctgggattacagtcgtgagccactgagcctggccgtctcccttcccttcctttcccttcccttcccttcccttcccttcccttcccttcccttcccttcccttccctcccctcccctcccctcccctcccctcccctccatctccctctcctccccttccttctttccttccttccttccttcctctttctctttctttttctctctttctttctctccctctttttctttttttcttctttcttttttttggagacagggtcttactttgtcacccaggctgaagtgcagtggtatgatcatggctcactgcagcctcgaccccccaggctcaagcgatcttcccacgccagccttcctgagtagctgggattataacaggcttgcaccgctatgcctggctaatatttgtattttttgtagagatggggtttcaccatattgtccaggctgggcttcaactcctgagctcaagcaatccacccaccttggcctcccaaactgctgggattataggcctgagccaccgcacctgacctgtttctatttttctattacaaacagtgctgtagtaaatattcctgtacaggccaggcacggtggctcatacctgtaatcccagcactttgggaggccgaggtgggcagatcacctgaggttgggagtttgagacagcctaatcaacatggagaaaccccatctctactaaaaatacaaaattagccaggtgtggtggcgcatgcctgtaatcccagctacttgggagactgaggcaggagaatctcttgaacctgggaggtggaggttgcgataagctaagatcacaccactgcactccagcctgggcaacaagagcaaaacgccatctcagatatatatatattcctgtacatttctccttgtgcaaactgatagagcttctcctggtctagggtatgtacctaggagtggaattgctgggctgtgggggttatacttcttcaactttactcaatttcaccaagttgctctgcacaacagttgtaccaatttacactcttacctgcagtacatgagaattccagtttctccgacatttggttttgtcagactttttatctttgccagtttgatgtgtgtgaaatgcagtctgctggcacccagtgttcaatcctgaagagctggatgcataggtcttgttcaccatggttcccccagcactttgcgcagcacctgaaatatagtaggtattccatattttttggctgactaattgagcagcagttttctggctcctctcatgtaaaattccattacaatttgttggagaagccatttgttctgcagggagtcctgttttcatctcactcttcccaattcaaaaccaggaaaccgggccaggcgcagtggctcactcctgtaatctcagcactttgggaggccaaggcaggtggatcacgaggtcaggagttcaagaccagcctggccaatatggtgaaaacccatctctactaaaaatacaaaaattagccgggtgtggtggcatgcgcctgtagtcccagctacttgggaggcagagacaggagaatcacttgaacctgggaggcagaggttgctgtgagctgagatcgccccactacattccagcctgggtgacagagcaagactccagctcaaatcaaccaaccaaccaggaaaccactcagggactaagcagagaaaacagcttttgattgccctgtttgcctttttgttagaactgcagttctcaaaactttcccatacctcagaaccacgtggagggcgtgttaaaatgcaaatcgctgggatccatccccccagaatttcttgttcaggaggtcgagggtaaggtctagggatctgcttttttttttttttttttttttttttttttttttgagacagggtcttgctctgtcacccaggctggagtgcagtggtgcaatctcggctcactgcatcctcgacctcttgggctcaagccatcctccccactcagcctccctagtagctgggactacaggcatgtgccaccacgcctagctaatttttgtattttttgtagagatgagtctctctatgttgcccaggctggtctcaaactcctgggctcaagcaatccacctgccttggcctctcaaagtgttgggattacaggcatgagccaccatgtccaaaataagatttgcgtgtgtaataagtacctgggtgattctgatgctggtgctgctggtctgggaactacactttgagaaccaccggatctgaggaacattcaatccagacattttggatatgatcaatgtggagtgtccttaaagagactgaatgcaaaacttgaaaagccactcccaaagtgtagagtggagggaagaatataacatctaactccacttagccggagtaggaaaaggagaagtctggaatgtttaagacagttggcagcatttatagagactgatataattcagtaagaatatattgggcaccaactgggttgtttccttccttcttctcttctcttctcttctcttctcttctcttctcttctcttctcttctcttctcttctcttctcttctcttctcttctctctctctttctttctctctctttctcccttcccttccctgcccttccctcccctcccctccccttcctttcctttccttccttcctttccttctctcctcccctcccctcccctccccttcccttccttttttttttgacagagtctctctcttgtcacccaggccggagtgcagtagtgcaatcttggctcattgcaacctctgcctcccgggttcaagcgattctcgtgcctcagcctcctgagtagctgagactacaggtgtgtgccaccacacccagttaattttaatttttattttttgtatttttagtatagatggggttttgttatgttggccaggctggtctcaaactcctggcctcaagcaatccacctgcctcggcctcccaaagtgctgggactacaggtgtgagccatcatgtccggccctgactgggttgtttccatctgctcgcaagtcttctacgtgctttcaagccaggatctttttttccattgatacttactcctgagatcaccgcaatcttctcttcttcctctacctcctccccttctcccccccccccctcctctcctcctcctcctccttcttcttctttttcctcttcttccatgaattaaattcagatgtggacttggctatgtgttgaaactataataaagatagctagcatttattgaggtcttggttgccaaatgcttttgttagtgttatctcacttcatcctccctcagacttcaggagataggtaccatagttacatccactttgtggatgaagtttagaggttacacagcaggtaaataacaaagctggggctgcaacccaggtcaccccaattccaatgtcttgttctttactgaaactatgtaccatacatctgtgattcttagcttccttattaattaattcaccaaatgttttctgagcacctcctaggtgctaggccctttgctgctgatatgggcaaatgagacagacaaaattcctggtagcacgacaatatgttttggccctgtgtccccacccgagtcttatctcaaattggaatccccataatccctaagtatggagggagggaccaagtggaggtcattgaatcatgggggcagtttccctcatgctgttctcgtgatactgattgagtgctcatgaaatgtgatgatattatagggcagtttccctgctcctgctcattctctctggcctgccaccatgtaagatgtgcctacttccccttcccccatgattgtaagtttcctgaggcctccccagccatgcagaactgtgagtcaattaaacttctttcctttataaattacacagtcttgaggctttctttccttttttctattttgtgagacagagtcttgctctgttgcccagactggagtgcagcggcatggtctcagctcactgcagcctctgcctcccaggttcaagcaattctcctgcctcagcctcccgaatagctggtattacaggcatgtgccaccacacctgggtaatttttctgtatctttagtagagaggggtttttgctatgttggccagtctggtgtcgtactcctgtaatcccagcactttgggaggcttgaggaaagtggatcacttgagtatttctttatagcagtgtgagtcatctcctattactgtttttttttttttttttttcaaaaagatgggatcttgctgtcacccaggttggagtgcagtggcttgatcatagctcactgcagtcttgaccttccaggctcaagcattctcccacctcaacctcccaagtatctgggacaacaagtgtgtgcaatcatacccgcctaattatttgtttattttttgtagagatgaagtcttgctatgttgcccaggctgttgtagaactcctggactcaagcaattctctcacctcagcctcccaaagtgctgggattataggcatgagccactgcgctggccacaatctcctattactctcatctatagaaggaaatgagactatccctctttgagggttgctgtgaggtttagggaaatgtgctcttggtacccagtagatgctcaataagcattacgctaggtatatagtaggtgctcaataagtgttgtgcttggtatatagttagtaggtgctcaataagtgttggctcctgatttccttcactcccaggagctggtaactctctatttgtgtacgtgggggagaatgaagccaattccaagagactacgatgttctcctagaaaaaggcattgcaccatctttaacatttgtgcagcccaccctctattagctcatctgagcaaatgcttattttcctggtctctggggacaagacttaggctcttttcatttgcctcctcaccctctccccatctccctattctagccagtatcacagaatatgcaacatcttgacaaaccaaaggcactgggcaatgctttaggaaactgtgcaatttagagagatgaacaatgaagaaatatcagctctaggcagcttgtgtgatggaaaataggagaagataagataaatgtgcagcttagaagggagagttctcacaggtaatgagagaaaatcaggagccaacatctatttagaggtattttccttcaagcatctggagcttttgaagaacctggataggagaaatctacattttaggagtgtaggctattttgtaatttccatctttgaaggcttcaactccatctttgctgtctgtgtgctagttatttctttttcaggctcaattttaataatttccttttttttcttttctcccaggaagagggtttaactctgcaacataatcagtgcacagaa

SEQ ID NO: 1181 - DNA, 18486 bp, Homo sapiens
ataggacctgggatttaggatttatcagtccagattcactttaaagaaaaggatgctacttgtattagttagcatttgctacagtaacaaacaccctatacatcttagtagcttttagtcatgcatattttcccctatgggtctgtgtgttgctagtggccatgctaggctcagctcaactccacatttcttgttgttctgggtcccagtctgaaggtacagcatgatctgggttatgcaagtctcatgcagaggggagaaatgtgagaatttctgatgaaccgtagaatcccagacactcacatctcgttgaccaaagcatatctcatgagcaagccaaagtcaatgagaggtggatacatattcttcctcctaaatgcactgggaagtcacttgaaaatgaatggggatttataatcctagaatggaaagggagtgaattgctgggaacaactatcccatctatgacccactgtattttaagcacaaggggatttattacatggaaatgggcgttcacaaaactgtcagaagtgttgaagatgtgggatctaggactgggtctgtatcctcttatgcctttagaaaacagcaccccacaaggagactgaaacagatgctgagtgccaatttactcataactacagcaaattaattcctgggaagaatcctataaggttgggatgaatctcctgaagctgctgatgatcagtagagcaatctgttaaagaagctctcacctgtgtctcttctttcttttacaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggtaatggggtggaaaagaggcacagagtgagacaattttgttgacttttaaaattcatccattaattcagtaaatatttgttaagtacttattacatgtaaggcactgtaataagctatggacaagacactcgtcttccatgaaggcagtatggtatgggagagagacagcatgagcttggaaggaagaaaggcacaggaatgtggcaacctggtaactcccaggcagccaacacacagtttgtttacactatatgtagactgcacatgctctgttgtgacctcccagggtgaaatgaggacttttggtctggggtcgtagaagaggcgggtttgaatctaataatagcaaatcaagcctgggcaacacagcgagactctgtctctaccaaaaatgtttaaaacaaaattagccaggcatggtggcacatacctgcagtcctagctactcaggagattgaggtggcaagattgcttgagcccaggagttggaggctgcagtgaactgtgatcacaccaccacactccacagagtgagattctctctcaaaaaagtggggggcaaatcagcactgaacaaagactgagtcttcccagaaagttaggtcacgtgtccctgtcaatagaggtgtgcaagtaagatagctacgaggtgacagttatcaaaagggcttcaatatgagacatccaagaaagaaaaagatgaagaaatttctgagtttccttcccagccctgagcgtctagaattttaatccattcactgctgatccatcaattgccttcacctgaagtcctatgactctttctgtaggatggaaggattcattctggctagggtaggggaaggggtggagctaccagcgtgaacttaatacattggtgctcaaaaagagtcacgattatgacatgatgtcctaagttccctacactatgaaacagtcttagtgtggagattgcaaatgccttgcctctaggctgaagacggccctaggtgtgggtactcttaaaaaaaataaggttcaacattttaaaattgaaaattttcaaacagaaatttagatttctggattttttaaagttatacttcctttaaatattgaggaaggccctttaaatattcaggaaggcccttactaccatgactcaccattctgaatccataaaagtaaatttgctatataaacatcaaaaaatatttccattcacaaataacaccattagcaaaataaatgactaatgaaaaccatggagaaaatattcaactcatataacagcaaaaaagttaataatataaagtgagcttgtagaaaccaagaataaaaaggtgcaactcattataaaaccaggcaaagtatatgaacagatagttcacaaaaaagtgaactcaaatggccattaaatataaaaatttctcaccctccctcataataaaagtaatgcaagtgataattttgctgaaataacttttatgcacctgtcttgttagtcaaatacaaaaggttgtttttttctttcagaaaaaatagtttaattatcacaagacatcttagtggaaggatgggaaatatttctcaaatctgcccccttgaaagctcagagactagggttttcaaagataatttggagggcagggggctaaggaatgggtgctactgattgcttaggaatgaaattatagagatgtgagaaatgtcttcaagtgctgagtttgtttctgggtgaggcagacacaggacaggtaaagtcagttccttgctgtagaatcacaggtctaggtagtgtcagtaacttttccagaatgcaaatgtctgaaaaatatctcaaaggtcagtcttagattttacaatagtgatgttaactacaggagcaactggtgaagttacaaagtgtgacttctggttacatgactcctaagcagtaagcaagctagggaacaatggctggttattgcttaactatgcttatagcttagcagaattgagacccctaccatctaccataattctaatgctgtggaattgcattaatttcacaaaggggtttaggtccctgaacaagaagggagttggtttcaggaagagactgttgtcatccttgctttaaagttaaattataaactaaattcctcctatagttagcttggtctatgcccaggaatgagcaagaacaaaatacaaatctttaacaactctattagcaaggctgtgaggaaacagacactctcatgtgttaccaaaaagtgctataactctgatggaggcaaattttgaaatatctaataaaattgctgacatgttttgtttttgattttgcatcattactctcaaactatgatctgagaacccctgaggatacatgagactctttcaggggatatgcgaagggtctattttacaataaaacagagaaattagaacccttatgcatcatgatgggtatgtaaaatgttacagctattatggaaagcaatataacattttctcaaaaaattaaaaaatagaattcccattcagcaattccaactctgggtatacaccaaaaaaaacttaaaatcagggtttctgaggaatatgtgtacactcatgttcacagtagctttattcacagtagttggaaggtcaaacagcccaaatatctatcaacaaatagacaaaaaataaaccatcattctcagcaaactatcgcaaggacaaaaaaaccaaacacagcatgttctcactcataggtgggaattgaacaatgagaacacatggacacaggaaggggaacatcacacactgggcctgttatggggtggggggaggggggagggataacattaggcgatatacctaatgttaaatgacgagttaagctgtgcagcacaccaacatggcacatgtatacatatgtgacaaacgtgcacgttgtgcacatgtaccctaaaacttaaagtataataataaaaaaagaaatatcaggcaaatccaaccaaaaaaaaaagagaatattgtatttttcaatgtgagaaggacatgagaattggaagggcaggagcaaagtgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgtgagccaattaaacttttttctttataaattacccagtgtcagatattcctttatagcaatgcaagaacagcctaatatagtaccttatataaatgaaatcacacagtatttggttttttgtgtctggctaatttcacttggcatgtcttcaaggtttatccatgtaatatatgtcagaatttccttcctttttaaggctgaaataatattccattgttatgtatatgcaacattatctattcatcaaacattcaggtcaaatcttgaatgctctgttgcttaaaaatttcttctctcagattccctaagtcattactcttacgttaaaacttccacagatcactaggctatgaacacaatgcagccaagttctttgctaaaatataggaaggaggacctttgcttcagttcccgaaaagttccttatttgcatttgaaatctggtcagcctgcatttcattgtccataattctatcagcattttggtcacaactatttaaccagtgcctaagacgttccgaacttttcctcatctttctgtctcttctaagccctccaaactcttcgatttcttcccatgacctagttccagagttagttctacattttcaggtatctttacagcaatatcccacttctggtaccaattttcggtctcagactgttcttgtgttgctgtaaaggaatacctgagactaggtaacttacaaagaaaagagatttaattggcccaaagttctgcacagtgtataggaagtgtggtgctggcatctgcttctgatgagggcctcaagaaatttacagtaatggtggaagatgaagaaagagcaggcacaataaagggcaagatgaggagcaagacagagagtgagaaggtgccactcacttttaaacaaccagatcttatgatctcatttatcaccaaggggatggtgctaagccattcatgagggtcccacccccatgatccaatcacctcccaccaagccccacctctgacattggggattgcatttcaacatgagacttggagaggacaaatattcagacaatatcatgtatctagaatagtcaaattcatagagtcggaaagtagaatggtgtttatcagggcctaaagggagaggggatgacgggtgattgtgtaacggggacagagttttcattttggatgatgaaaaactcgggagatggatggtggtgattgttgcataacaatgagaatgtacttaatgccactgaactgtacactcaaaaatagttaaaattggaaatgttatgtgtatttttactacaaaattaaaaaaagtaaatagatagagatacatatataaataaatctaaagtgatatttgcctttttattctaattctttcacgagtatacaatagcattttccagaaggtacatgttggtactcacaacagagtgaatgcagaatcagatgagaggatccaatgtttttctactaagacgttaaagggaattgcagaataaatagacgcaataaataaataaaataatgccactttcctcattattttttcattttgaaaagtttactttatcattataaaaaaattatgcatgctaatatataatgggtttattacagttatttctaaaagcatacatttacaaaaattctgttttaatatctactatggtagatattgacagatataactcatataaataacaagtctttagaattttcaataccttttaagattgtatggaggtgctgagataaaaaaccttactaagcaccaacttggcaatcccaagacttggaatttatcctacctgcttgtgtaccaatgccccctgatcaacagggcttctctttcctcaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggttggtaactgactacctggacagagaactgtcttccttgtgaagaaaactgatagcagagaaatgcagccacctctctcaaaagaagtctcctccttggagcatgctgtcctgtatcatatgaagaaagacatctccctacttccacttatttaagcaaactatgtgccaagcacttatgcagggtgaacaacaacaatgacatagtttacatattcatgggacttacagaactttggagaaagctcttaaactattaattgcacatgtaagtatttaatcagaattatgataattggtatgagaattctattaaaatctataaaaataaatttggcagactgtgacctgcaggccaaatcctgcccaaagcttgtttttgtaaataaagttttattataacacagtattatatgtggctgcagttgcactacagtggcaacttgagtagttggaacaagagagtgtcttatccacaaaacctaaaatatttactatttggccctttgcagaaaaagtttgccaatgcttttctaaaagaagacttgaattaaccaatatgaggagcaactaagtctcaatggaagtgatatttgagctgagatctgcaggatgagtaggattttgccaagagatagagaggcttgtgccaagcaaagggaacagcatatgtgaagatgtaattatctgatgatttcttcttgtccacttcccagaaaagccaaacactgaaaacagtaggagttgtggtagagaagagtttaataattgcatagacagccaagttgaaggatggaggatgtttcttaaatccacctccccaggaaatcagagactagagtttttcaaggatgctttggcttccaaggggctaaggaatagtaaatgctgattggtttggctggggatgaaaacatgggttgaagctgtcttcttgtgttgagtcaactcctcagagatcacagaactagttgagttagtttcttggtatcagttactgatctgggtagtgcaagctggtccatcagaatgcaaggtctgaagaacacctcaaataccagacttagggtttaccataatgatgtaatctataggagaaattggggaggttacaaatcttgtgacctctggctccatgactcctgaactataattctaaccttgtgacaaatttgttatttttctaaaggcagtttcaatctccaagcacggacacagttagtttcaggaaagagctattatcatttttattttaaagttagactataagttagatttctcccatagttagcttggactatgtccagggatgagcaaagatagatagcttgtgaggttggaaacaagatgaagtcagctatgtcagatttccctcagtgtcataatttttccaaaggcagtttcaaagccacagaggagggaaacttgaaaattataaaagaacctaaaaggatatctatgtgcctgaagtccaggccataaaagaaagtagtggcaatagaatgaacatgtagaggtggccaggtgctaaactggcagtgccttgtggtccttggtaagagttgtggacatttatccagtggtgaatgggaaatgattgatggattgagtgacactcaaaccattgatgcattgagtgacactcaaaccattgatgcactgagtgacatgatcctcctctgtttggatggtcatattggatgctcaatagggaatgggatgaagaagacaatagtggggttggaaatctcagataagaggtgaagcgatggtgatggcttcagtttcgttgaggtagtagagatggagataagtggatttaacaggcaattggggggtgaactaataacagggttattcaaaggagatgcgagggagagagagagaagtacagacatttcagcaagtgggtggatggtgctttctttcactggagtgaagaacacagatatagaaagaggtattagtgtgttaggaaaatatcacaagttcaatttgggcatgttgagtccaggatgtccatgtgatgttcaagaagtgataacaagttggatttaaggctctaaaatttgacatggagacagaaatttgagaatcatcaacttttacattaaaaggatgagaagtacagtggtatcaaaaagaaccccaagaaactccagcaacctccttcacaaactgccctttccacctctgcttgcacacagcctaatcccaactaaaagctccaacccacctcatattctggggacaatgggctgagcatgagaaagcaatgggtaaagagaaagacatgaatgcagccaggaattagaaactatcagaggcgaccaaaccaactgcaggaacttggaagcctgtggaaagagagaacaagccagagagaaaggtgacatactgaaattatagccagaaggaaaggagaacccagaggaagagatgtgtctattgttctgtgtctgactcaattggccaccatggtagagaaacatttgaggatatttacaggtatgcagtgagaatcccaaagtgttgagagtgggaagaaagtgagctaaggttaaaagctatttaacaggacaggcatgtggtttaagcttcacaaaaaatgaaacctgtgtagttattctgttcttttctttctttcttttatttttttgagacggagtctccctctgtagtccaggctggagttcagtggtgcaattttggctcactgcctcccaggttcaagcaatcctcctgcctcagcctcctgagtagctgggattacaggcgtgtgccatcaagcccagataatttttgtatttttagtaaagctggggtttcgccatgttggccaggctggtcttgaactcttgacctctaataatccaccctccttggcctcccaaaatgctaggattacaggcatgagccaccatacctggccctaagtctagttattctacagaatattttaataatcaaaggagtctcattaaaataggaaacaagaacaagaatttaggaaagtgataatcatggggtataaaacctcatttatgtgcaaggaataagtctaatgttttaagataaattgtacagcatgctaaacacagctaataattcagtactgtaaatttcagtatcattaagagcaaaactttctaatgttctcatcacaaaaaaatgttaaatacttgaggtgatggatatgtgaattagcttaatttaatcatctcacattgtcttcaaaaattataataccactttgtacccaataaatatatacaactatactttgtgtgtacatagatatgtaaaactgaaggcactctcatctaagaaaaatgcatttaatgtcccagggatgaaataaattgccaggacctagagctattggtgtttcaagaccatggacagttccaagtgcctttcctcatgattctttaattatcatatgagagttttgaatacagcaaactcctgtagaaaattttttttgaggggtgagagtgggtgaggagaattgtatgtgtcttagactatcaacaatgtgacattagcaattcaatttcttttctttgtctcagtagggcccttaagactctgacaacccagggaatcctaggtttcattcactcccttgtccttagttcccttttttattgacactctctattggtcattacttcctcatcctctccttccccacttgctcgctgcttgatgtttatctcaggcttctctagggacaaagaaaatcatcctttccaattctctaaattgttggcttctttaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaagtgagtatctacatgtctcagcctgggttttaactaaaactggaaacagagccaagcacttaggtgcaggtgctttattgaggaggtgcagaaagaacagcatgggactaggaagagtgaagctgggaagaaataaaagctaacacaagggtattttttttttttttttttttttttcaaatcattgcaaggactaaatggggcttgatctgcctggaccttctgagcagcatatagaatgcctcccaggattgtcctctaaaggattgaaaagcactgatccattagcatctggtccccacaggttcagggttgtcctgggggtgttattgcctccacacttctgggctgcgcactcatgcgtgaagagtggctcagagttccatgctatggtaaaacagagaaactatggggcacaaagtgaatcacttgtgatgcacactggaaacaacatgatgttaacaccaagtgggttgaaacccacccagaacaatttactggaactatgactcaaatcaggggtgaggccaaggtcatgagggaaaacccaagagatggctgatataccaagtttctgggctcttctttccacctcttgtatctctaagagaggctgatcaagggcagaggactttccatgtgttgatagcatggaaagaccttgatagtccttccaaaagccgatagcaagactggctggattaatgattttctctgtcaacatgtctgaaatccctctagcaggggcacatatgataggaaacttgaagggataacttcagcttttcctttctaatgccatggtctttaaggtagctgtcatggaaataaacaccatcatgcctgcttttaaaggctcaaaatcaggacactggagatgtccaagagatatgtaggtgcttccagggaatagaagagaatgccaagaaagtacttggaaaacttgtattaattccacccctcctgtccacttggtgtcatgccagagctcttcacaacaattagattagcatttattgagttcttactaagcaatttgctcatttctttggtggtagagataactctataagacttgatctcactttttttgcagatataaagtcagacacagagacgttaaataagtagtttaaggttgcattgataacaaagtgtgaaacttcagtagttttcaaacccaactctgattgactcagactcccatgatcttaatcactcagcagcctctcttgtgaggtgggtccatcaacttgcccttttcagcacagtgggtggtgggaaaagatgggtcactttgatatctggtgtccagtctagctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctgggtaagctgagctctttctctctacagagaattacatgagttttggagttagaaggagaatgagacccaattatatattaagtcaggtcaaccggggtcccaccttctgaacattcatctcctgttgatacaggatgtgtggatagaacaacttttcttcccccttcctacttatacatagacatatgcctataaacctgcaggcagatacacacacacctctgcacacacacctccctttcctcccctacaccttagtgtcccacgcatcctaagcatgcacccacctatatgtacatgtgttttgtctgtgttttcagttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaaggtaagagaggatccagtttgcagcagttattcagagtgagcccgaggtttgcacacttcaatttattgtagtttgtttcaattcatctaatttttgctaaacccctgccatgtggtgaacagtgttcagtaaacgagatggaaatggtccctgacctcacagagctcatgttctggggtaggagagaggcacatatatagataaaaggagtatgttcaggagaaagatattgtaggtcatttgttcactcaacaaatgtaacgggctcttccgctggtgtcacctatcagatagatgctggtgaaccacgtgtaaaagggaaagctggagtattggaggggatgccatctcgctctcatgagtgtgtgtgtgtgtttgtgagtgcacatttcatttccttttttatttgcagcataacacacaaactgaaggtaaagtacacagagtgccaccatcctatgtgtacagtttgaaaataatttagctgtgttagatactgtcttagtcagcttgggctactataataaaataccatagtctaggtggcttaaataacagacatttacttctcatagctctggaggctgtaagtctgagatcagggtgccagcataattggattcctggggaagccctctcttcctggcttgctgatggctcccttactgctatattctcacatggttgagagagacagtgctggtatatcttcctttttacaaataaaggcactcatgctatcactggggcacctgcttcattaccttgcataattacccctaaaagccctgcctccaaataccatcaagttgagggttagagctttaatatagggatttaggtggggacacaacatccaattcatatcagacacccctgtaaacaccaccagataaagacatgaaacattcccaccactgcagaaggtgttcataccccttctctgacagcatctgccccccataagttaatcattcatttgatacctatcaccatagattaattttatctcttcttggaatttcatgtaaatggagccaaattatatgtaatcttttgcatttggcttcttttactcaaaatattctctgtgagattagtccacgtgttgcatgtatcagatgtttgttgttttagctggctgcaaagtatttcattatgtgaatctgtaaaaatgttcccccatcctattgttaatgaactttgggttatttccaatttaagatggttttctagaagcaattcagaagaataaatggaattttttcctgtagaacttgatggtacagccattaagtaagacccacagactgcagctatgcattatcctgtagcaacaaagcaatgaaaatgacctcattttgcttatgaagatacaccctatgttggactctatgatagagggattgggttatttccctgctgtgcccccagatctctaatggcccatccagacatctatttggctgcagcaaaggttcaagctaaggcatagatgacatcttcaaaagtcaaaaagtcaggtgtgatctggattttcataggaaattatcttcaaataatactgtcattctctgttttaagcaaattcttactctgtgtccttctcaaaaggacttgaactggtttttattaagttccaccattaaaaaaatgaaaacagacataaaattataaagcccattgggaaaatttaggttggaggtgtagggtggaaaagactaaggaaattaaggagaaatatagcaaatgagtatgtagttacaagctgagcttctagtaaggcaaagcaataaggaatatgggatcattttcatagcttatatctgtgtatcaagcacacttgaaggaaattattgcatgatactcacatttgtcattttttctagaccttttgcttaaaccattgccatggtttgaatatttgtgccccccaaaactcatgatgaaacttgtaaaccaaaaataaaatcctaaggccccatcccgccagccatctgaatggacttcctccttagccagggttcttttaaaatttaacctgagagactgtttcaggccatgataggaagtgggagtgggacatgcctcattatacctctctggtattaacatcaatacagactttaagtctgattaaaaaaaaaagattacaacctgttctgtctaaagcctagtgccagtacctaaaagcttcctctgcaaataagaacttgggtctccacaattatttatcttaactaaggcattcctttctattgatcccaggtctttagataaactcaaccaattgtcaaccagaaaaatttaaatctacctataagctggaagcccccgcttcaagttgccccacctttctggaccaaaccaatgtattttttaaatgtgtttgattgatgtcttatgtctccctaaaatgtataaaaccaaggtgcaccctgaccaatttgggcacgtgttctcaggacatcctgagggctctgtcatggccatggtcactcatgtttggctcagaataaatctcttcaaatgttttacagagtttggctcctttcatcaacaaactcaatccccagtgtaacagtagtaagcggtggggcatttaagagatgattgggcctcatgagggattaatggattaatgggttatcctgttagtgggttagttttggagagtgggtctgttatataaaaagccagttttgctctacctcgtgagcccctttacaatgtgatgccccgaccctccttgggactctgcggagtccccaacagcaagaaggctctcaccagatgcagcttcttgaccttggactttccagcccctagaactgcaagaaataaatttattttcttcataaattactcagtctccggtactcagttacagcaaaagaaaacagattaagacaatactctattacattctgcataaagaaaagcatgggatggagatggtgttatacgacaggaatacatgctgcaaataatgatcccactacttgctgactaggtgaccttggagcagctacttaaccttgtacatcatgggtttcccctctgtatcatgaggatgatagcacacactccgtgaggttattgtaaaaattaaatgagataacacaggacatggcaagtattcagtactaggtctttttgcagcacttgttttgaaatgtctatagatgtctttagcttttcaaagaacttttatatctaaaatatattccaaaaatattttcaggaaaataaggctggaaacaatctattataaagctggctacagaaagttaaggaacttaaccaagacagctgctgtgctcaggcagctgatcttcccttagttgctggggggtgatctactcctaggggtgtgttaacgagggcaagtcttaaactggcaggaacagacatccaggatttgacaaaaatgtttcaaattagccttagactttttcactacaataatatgtattcatttccctgttatttgtgtcttcagggtgcatgagagttgtggggctcatttaacctgaatcagacatagtaaacaagctagggttttcatccagacctctacaactccatagctcacaattgtaaccactgtgcatagccataagttggcatttgacctggtgaccaatgtctcacctggctcttgtcttccagacactctccagttatccaatcaagagtatgatgggtgcccccattgtttaccggatgttgctacagcaggatctttccaggtgatggggctttgaggattggtaagagagtctggccccatccccctgactccctcacatacattcatgcctatctatctgaatctctcgcacacagagagccccatgaagccatttgcatcatcaaagcacccagaaacccagtctaggcctgagtggactttggttccagggaggctgagggcaaacatttatttctcttcttcagttacaagttcccccatctacagaactgcgtcactgtaggggagtcccttcttccagaaactctggagaactggagggcccagacaggactggacatccgagaatcctatggccagacagaaacggtacctgttcccaggggaaccatgggctgtgtgcactttttgggcttcaaaattctctttgacaataaaaattgttagccaccatgtatcattcatctattcgagaagtatttattgagcctctatgaagggacaggtactgagtattgaaaattccgcacagaacaaaaaaggcaaagttcctgttttctgggagattacattccagtgagatttggggagagagaaaataaactaagaaatatctagcatggcaggtggtgagaaatgcgatggaaaaagtaaagtagatgacatggggtgagaagttggtaaatcagatatggtagtcagaaaattcctctgtgatggggaaacattttagcagagaccaaagtttatcaaacatgtcaagcactgtacaaagctacttagactgaagtgaggaatgggaagaagaacccaccatgactttactgcacctcctgacatatcttcttggaactcttgaggtctcatgtgcacaatgtggatttatgctattctatactattttacttatcaaaactacatggggaatacttttccccaactcttcttctcctttttccagtgcctcttacttgtgactctcagcacttcttgcctcttcctctccactctcttaccctgcatccttctttggctaatgagtacccttggaagaacttttgcagaaggttgacggcagctctgtggtatgaaagagccaggaagagctctgcaaatatgaataaggacaatggagttgtggcaagcataccctggcaggggcctcccaccattcagaggaggacatgtttaggatatgcttacaaggacactcaggttcccatgatcttaatcactcagcagcctctcttctgaggtgggtggataaacttgccctttccagcacagtgggtggcgggaaaagatgggtcattgtgatatcttttgtccaggctagatctgagaaaatgacaatctatgtctctgtcagtgaggcatccaccactcatttgttattctgttgggaaggttcatttcagggttcaagcagaactggtgctgccatgggagatactttaaaaagtatattttactgcttgaggaaatggatacttcattcttcatgatgtgattatttcacattgcatgcctgtatcaaaacatctcatatattccataaatagatacacctatgtacccacaaaaattcaaaataaaaataaaagtagtatattttaggccttacagattgcatattggtgatcccatatagtttgaaagggctttgggtatccatagtgtcgtattaaaatgtggttccccctaaaagagattataatgtgattgttaggtcctcttcctggggagtggtagatgggttgcttcctgaactaacaatttagcgaagcccctaggattgtggttccagtaatggggagagagccagggaatgaggagcagggggagccaccaagtgcaggccaagttcaggacagtgtcaggacctgctctgcagaaattttttctttttctgtgaccttgtacctcctcctgaggtttgctgatctgtctgcttctttccacagggattaacttgcatggtttccaagacaatgaaaatcaaaccaggatacatgggaacggctgcttcctgttatgatgtacaggtttgctcgggacactgaggagggaggaagttaggggaaacactgattttcagtgatttatgttttccattgtttattgagtcaaaaataatagaaagtactgatattaagataacataagaaaaaaaggaggtagggaggttgggggaaggaaagagtgagggaaggaaggaggaaaaggggaaatgatttatattcttaccatccagaaggacccactttgaatagctagcaaattagctagacagtacacaagtatatatgctttaaaaacagaaatggggtgaatcttgacataatattttgtaactagcttttatcatttaacaatttaggtaaggatcttttcagttcaattaatgccaacctgcagcatgat

SEQ ID NO: 1182 - DNA, 25825 bp, Homo sapiens
ataggacctgggatttaggatttatcagtccagattcactttaaagaaaaggatgctacttgtattagttagcatttgctacagtaacaaacaccctatacatcttagtagcttttagtcatgcatattttcccctatgggtctgtgtgttgctagtggccatgctaggctcagctcaactccacatttcttgttgttctgggtcccagtctgaaggtacagcatgatctgggttatgcaagtctcatgcagaggggagaaatgtgagaatttctgatgaaccgtagaatcccagacactcacatctcgttgaccaaagcatatctcatgagcaagccaaagtcaatgagaggtggatacatattcttcctcctaaatgcactgggaagtcacttgaaaatgaatggggatttataatcctagaatggaaagggagtgaattgctgggaacaactatcccatctatgacccactgtattttaagcacaaggggatttattacatggaaatgggcgttcacaaaactgtcagaagtgttgaagatgtgggatctaggactgggtctgtatcctcttatgcctttagaaaacagcaccccacaaggagactgaaacagatgctgagtgccaatttactcataactacagcaaattaattcctgggaagaatcctataaggttgggatgaatctcctgaagctgctgatgatcagtagagcaatctgttaaagaagctctcacctgtgtctcttctttcttttacaggcctgaatatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggtaatggggtggaaaagaggcacagagtgagacaattttgttgacttttaaaattcatccattaattcagtaaatatttgttaagtacttattacatgtaaggcactgtaataagctatggacaagacactcgtcttccatgaaggcagtatggtatgggagagagacagcatgagcttggaaggaagaaaggcacaggaatgtggcaacctggtaactcccaggcagccaacacacagtttgtttacactatatgtagactgcacatgctctgttgtgacctcccagggtgaaatgaggacttttggtctggggtcgtagaagaggcgggtttgaatctaataatagcaaatcaagcctgggcaacacagcgagactctgtctctaccaaaaatgtttaaaacaaaattagccaggcatggtggcacatacctgcagtcctagctactcaggagattgaggtggcaagattgcttgagcccaggagttggaggctgcagtgaactgtgatcacaccaccacactccacagagtgagattctctctcaaaaaagtggggggcaaatcagcactgaacaaagactgagtcttcccagaaagttaggtcacgtgtccctgtcaatagaggtgtgcaagtaagatagctacgaggtgacagttatcaaaagggcttcaatatgagacatccaagaaagaaaaagatgaagaaatttctgagtttccttcccagccctgagcgtctagaattttaatccattcactgctgatccatcaattgccttcacctgaagtcctatgactctttctgtaggatggaaggattcattctggctagggtaggggaaggggtggagctaccagcgtgaacttaatacattggtgctcaaaaagagtcacgattatgacatgatgtcctaagttccctacactatgaaacagtcttagtgtggagattgcaaatgccttgcctctaggctgaagacggccctaggtgtgggtactcttaaaaaaaataaggttcaacattttaaaattgaaaattttcaaacagaaatttagatttctggattttttaaagttatacttcctttaaatattgaggaaggccctttaaatattcaggaaggcccttactaccatgactcaccattctgaatccataaaagtaaatttgctatataaacatcaaaaaatatttccattcacaaataacaccattagcaaaataaatgactaatgaaaaccatggagaaaatattcaactcatataacagcaaaaaagttaataatataaagtgagcttgtagaaaccaagaataaaaaggtgcaactcattataaaaccaggcaaagtatatgaacagatagttcacaaaaaagtgaactcaaatggccattaaatataaaaatttctcaccctccctcataataaaagtaatgcaagtgataattttgctgaaataacttttatgcacctgtcttgttagtcaaatacaaaaggttgtttttttctttcagaaaaaatagtttaattatcacaagacatcttagtggaaggatgggaaatatttctcaaatctgcccccttgaaagctcagagactagggttttcaaagataatttggagggcagggggctaaggaatgggtgctactgattgcttaggaatgaaattatagagatgtgagaaatgtcttcaagtgctgagtttgtttctgggtgaggcagacacaggacaggtaaagtcagttccttgctgtagaatcacaggtctaggtagtgtcagtaacttttccagaatgcaaatgtctgaaaaatatctcaaaggtcagtcttagattttacaatagtgatgttaactacaggagcaactggtgaagttacaaagtgtgacttctggttacatgactcctaagcagtaagcaagctagggaacaatggctggttattgcttaactatgcttatagcttagcagaattgagacccctaccatctaccataattctaatgctgtggaattgcattaatttcacaaaggggtttaggtccctgaacaagaagggagttggtttcaggaagagactgttgtcatccttgctttaaagttaaattataaactaaattcctcctatagttagcttggtctatgcccaggaatgagcaagaacaaaatacaaatctttaacaactctattagcaaggctgtgaggaaacagacactctcatgtgttaccaaaaagtgctataactctgatggaggcaaattttgaaatatctaataaaattgctgacatgttttgtttttgattttgcatcattactctcaaactatgatctgagaacccctgaggatacatgagactctttcaggggatatgcgaagggtctattttacaataaaacagagaaattagaacccttatgcatcatgatgggtatgtaaaatgttacagctattatggaaagcaatataacattttctcaaaaaattaaaaaatagaattcccattcagcaattccaactctgggtatacaccaaaaaaaacttaaaatcagggtttctgaggaatatgtgtacactcatgttcacagtagctttattcacagtagttggaaggtcaaacagcccaaatatctatcaacaaatagacaaaaaataaaccatcattctcagcaaactatcgcaaggacaaaaaaaccaaacacagcatgttctcactcataggtgggaattgaacaatgagaacacatggacacaggaaggggaacatcacacactgggcctgttatggggtggggggaggggggagggataacattaggcgatatacctaatgttaaatgacgagttaagctgtgcagcacaccaacatggcacatgtatacatatgtgacaaacgtgcacgttgtgcacatgtaccctaaaacttaaagtataataataaaaaaagaaatatcaggcaaatccaaccaaaaaaaaaagagaatattgtatttttcaatgtgagaaggacatgagaattggaagggcaggagcaaagtgacatagtttggatatttgttttctctaaatctcatgttgaaatgtaatccacagagttggaggtagggcctggtggaagacatttggatcatacgggcaggtcccacacgaatgacttagcaccatccccttcgttatgagtgagttcatgagagatcttgttgttttaacatacatggcacttccccacgctctctctcttgttcctgcttttgccatgtgatgcacctgctcccccttcaccttcttccatggctgtaatcttcctgaggccctcaccagaagcagatgccagcaccatgcttcctgtacaccctgcataactgtgagccaattaaacttttttctttataaattacccagtgtcagatattcctttatagcaatgcaagaacagcctaatatagtaccttatataaatgaaatcacacagtatttggttttttgtgtctggctaatttcacttggcatgtcttcaaggtttatccatgtaatatatgtcagaatttccttcctttttaaggctgaaataatattccattgttatgtatatgcaacattatctattcatcaaacattcaggtcaaatcttgaatgctctgttgcttaaaaatttcttctctcagattccctaagtcattactcttacgttaaaacttccacagatcactaggctatgaacacaatgcagccaagttctttgctaaaatataggaaggaggacctttgcttcagttcccgaaaagttccttatttgcatttgaaatctggtcagcctgcatttcattgtccataattctatcagcattttggtcacaactatttaaccagtgcctaagacgttccgaacttttcctcatctttctgtctcttctaagccctccaaactcttcgatttcttcccatgacctagttccagagttagttctacattttcaggtatctttacagcaatatcccacttctggtaccaattttcggtctcagactgttcttgtgttgctgtaaaggaatacctgagactaggtaacttacaaagaaaagagatttaattggcccaaagttctgcacagtgtataggaagtgtggtgctggcatctgcttctgatgagggcctcaagaaatttacagtaatggtggaagatgaagaaagagcaggcacaataaagggcaagatgaggagcaagacagagagtgagaaggtgccactcacttttaaacaaccagatcttatgatctcatttatcaccaaggggatggtgctaagccattcatgagggtcccacccccatgatccaatcacctcccaccaagccccacctctgacattggggattgcatttcaacatgagacttggagaggacaaatattcagacaatatcatgtatctagaatagtcaaattcatagagtcggaaagtagaatggtgtttatcagggcctaaagggagaggggatgacgggtgattgtgtaacggggacagagttttcattttggatgatgaaaaactcgggagatggatggtggtgattgttgcataacaatgagaatgtacttaatgccactgaactgtacactcaaaaatagttaaaattggaaatgttatgtgtatttttactacaaaattaaaaaaagtaaatagatagagatacatatataaataaatctaaagtgatatttgcctttttattctaattctttcacgagtatacaatagcattttccagaaggtacatgttggtactcacaacagagtgaatgcagaatcagatgagaggatccaatgtttttctactaagacgttaaagggaattgcagaataaatagacgcaataaataaataaaataatgccactttcctcattattttttcattttgaaaagtttactttatcattataaaaaaattatgcatgctaatatataatgggtttattacagttatttctaaaagcatacatttacaaaaattctgttttaatatctactatggtagatattgacagatataactcatataaataacaagtctttagaattttcaataccttttaagattgtatggaggtgctgagataaaaaaccttactaagcaccaacttggcaatcccaagacttggaatttatcctacctgcttgtgtaccaatgccccctgatcaacagggcttctctttcctcaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggttggtaactgactacctggacagagaactgtcttccttgtgaagaaaactgatagcagagaaatgcagccacctctctcaaaagaagtctcctccttggagcatgctgtcctgtatcatatgaagaaagacatctccctacttccacttatttaagcaaactatgtgccaagcacttatgcagggtgaacaacaacaatgacatagtttacatattcatgggacttacagaactttggagaaagctcttaaactattaattgcacatgtaagtatttaatcagaattatgataattggtatgagaattctattaaaatctataaaaataaatttggcagactgtgacctgcaggccaaatcctgcccaaagcttgtttttgtaaataaagttttattataacacagtattatatgtggctgcagttgcactacagtggcaacttgagtagttggaacaagagagtgtcttatccacaaaacctaaaatatttactatttggccctttgcagaaaaagtttgccaatgcttttctaaaagaagacttgaattaaccaatatgaggagcaactaagtctcaatggaagtgatatttgagctgagatctgcaggatgagtaggattttgccaagagatagagaggcttgtgccaagcaaagggaacagcatatgtgaagatgtaattatctgatgatttcttcttgtccacttcccagaaaagccaaacactgaaaacagtaggagttgtggtagagaagagtttaataattgcatagacagccaagttgaaggatggaggatgtttcttaaatccacctccccaggaaatcagagactagagtttttcaaggatgctttggcttccaaggggctaaggaatagtaaatgctgattggtttggctggggatgaaaacatgggttgaagctgtcttcttgtgttgagtcaactcctcagagatcacagaactagttgagttagtttcttggtatcagttactgatctgggtagtgcaagctggtccatcagaatgcaaggtctgaagaacacctcaaataccagacttagggtttaccataatgatgtaatctataggagaaattggggaggttacaaatcttgtgacctctggctccatgactcctgaactataattctaaccttgtgacaaatttgttatttttctaaaggcagtttcaatctccaagcacggacacagttagtttcaggaaagagctattatcatttttattttaaagttagactataagttagatttctcccatagttagcttggactatgtccagggatgagcaaagatagatagcttgtgaggttggaaacaagatgaagtcagctatgtcagatttccctcagtgtcataatttttccaaaggcagtttcaaagccacagaggagggaaacttgaaaattataaaagaacctaaaaggatatctatgtgcctgaagtccaggccataaaagaaagtagtggcaatagaatgaacatgtagaggtggccaggtgctaaactggcagtgccttgtggtccttggtaagagttgtggacatttatccagtggtgaatgggaaatgattgatggattgagtgacactcaaaccattgatgcattgagtgacactcaaaccattgatgcactgagtgacatgatcctcctctgtttggatggtcatattggatgctcaatagggaatgggatgaagaagacaatagtggggttggaaatctcagataagaggtgaagcgatggtgatggcttcagtttcgttgaggtagtagagatggagataagtggatttaacaggcaattggggggtgaactaataacagggttattcaaaggagatgcgagggagagagagagaagtacagacatttcagcaagtgggtggatggtgctttctttcactggagtgaagaacacagatatagaaagaggtattagtgtgttaggaaaatatcacaagttcaatttgggcatgttgagtccaggatgtccatgtgatgttcaagaagtgataacaagttggatttaaggctctaaaatttgacatggagacagaaatttgagaatcatcaacttttacattaaaaggatgagaagtacagtggtatcaaaaagaaccccaagaaactccagcaacctccttcacaaactgccctttccacctctgcttgcacacagcctaatcccaactaaaagctccaacccacctcatattctggggacaatgggctgagcatgagaaagcaatgggtaaagagaaagacatgaatgcagccaggaattagaaactatcagaggcgaccaaaccaactgcaggaacttggaagcctgtggaaagagagaacaagccagagagaaaggtgacatactgaaattatagccagaaggaaaggagaacccagaggaagagatgtgtctattgttctgtgtctgactcaattggccaccatggtagagaaacatttgaggatatttacaggtatgcagtgagaatcccaaagtgttgagagtgggaagaaagtgagctaaggttaaaagctatttaacaggacaggcatgtggtttaagcttcacaaaaaatgaaacctgtgtagttattctgttcttttctttctttcttttatttttttgagacggagtctccctctgtagtccaggctggagttcagtggtgcaattttggctcactgcctcccaggttcaagcaatcctcctgcctcagcctcctgagtagctgggattacaggcgtgtgccatcaagcccagataatttttgtatttttagtaaagctggggtttcgccatgttggccaggctggtcttgaactcttgacctctaataatccaccctccttggcctcccaaaatgctaggattacaggcatgagccaccatacctggccctaagtctagttattctacagaatattttaataatcaaaggagtctcattaaaataggaaacaagaacaagaatttaggaaagtgataatcatggggtataaaacctcatttatgtgcaaggaataagtctaatgttttaagataaattgtacagcatgctaaacacagctaataattcagtactgtaaatttcagtatcattaagagcaaaactttctaatgttctcatcacaaaaaaatgttaaatacttgaggtgatggatatgtgaattagcttaatttaatcatctcacattgtcttcaaaaattataataccactttgtacccaataaatatatacaactatactttgtgtgtacatagatatgtaaaactgaaggcactctcatctaagaaaaatgcatttaatgtcccagggatgaaataaattgccaggacctagagctattggtgtttcaagaccatggacagttccaagtgcctttcctcatgattctttaattatcatatgagagttttgaatacagcaaactcctgtagaaaattttttttgaggggtgagagtgggtgaggagaattgtatgtgtcttagactatcaacaatgtgacattagcaattcaatttcttttctttgtctcagtagggcccttaagactctgacaacccagggaatcctaggtttcattcactcccttgtccttagttcccttttttattgacactctctattggtcattacttcctcatcctctccttccccacttgctcgctgcttgatgtttatctcaggcttctctagggacaaagaaaatcatcctttccaattctctaaattgttggcttctttaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaagtgagtatctacatgtctcagcctgggttttaactaaaactggaaacagagccaagcacttaggtgcaggtgctttattgaggaggtgcagaaagaacagcatgggactaggaagagtgaagctgggaagaaataaaagctaacacaagggtattttttttttttttttttttttttcaaatcattgcaaggactaaatggggcttgatctgcctggaccttctgagcagcatatagaatgcctcccaggattgtcctctaaaggattgaaaagcactgatccattagcatctggtccccacaggttcagggttgtcctgggggtgttattgcctccacacttctgggctgcgcactcatgcgtgaagagtggctcagagttccatgctatggtaaaacagagaaactatggggcacaaagtgaatcacttgtgatgcacactggaaacaacatgatgttaacaccaagtgggttgaaacccacccagaacaatttactggaactatgactcaaatcaggggtgaggccaaggtcatgagggaaaacccaagagatggctgatataccaagtttctgggctcttctttccacctcttgtatctctaagagaggctgatcaagggcagaggactttccatgtgttgatagcatggaaagaccttgatagtccttccaaaagccgatagcaagactggctggattaatgattttctctgtcaacatgtctgaaatccctctagcaggggcacatatgataggaaacttgaagggataacttcagcttttcctttctaatgccatggtctttaaggtagctgtcatggaaataaacaccatcatgcctgcttttaaaggctcaaaatcaggacactggagatgtccaagagatatgtaggtgcttccagggaatagaagagaatgccaagaaagtacttggaaaacttgtattaattccacccctcctgtccacttggtgtcatgccagagctcttcacaacaattagattagcatttattgagttcttactaagcaatttgctcatttctttggtggtagagataactctataagacttgatctcactttttttgcagatataaagtcagacacagagacgttaaataagtagtttaaggttgcattgataacaaagtgtgaaacttcagtagttttcaaacccaactctgattgactcagactcccatgatcttaatcactcagcagcctctcttgtgaggtgggtccatcaacttgcccttttcagcacagtgggtggtgggaaaagatgggtcactttgatatctggtgtccagtctagctctgaaaaaatgacaatctgtgtctctgtcagtgaggcatccaccactcatcactgtgtggagactggaagccaggaagcatctgccatctacttcactagtgggaccagtggtcttcccaagatggcagaacattcctactcgagcctgggcctcaaggccaagatggatgctgggtaagctgagctctttctctctacagagaattacatgagttttggagttagaaggagaatgagacccaattatatattaagtcaggtcaaccggggtcccaccttctgaacattcatctcctgttgatacaggatgtgtggatagaacaacttttcttcccccttcctacttatacatagacatatgcctataaacctgcaggcagatacacacacacctctgcacacacacctccctttcctcccctacaccttagtgtcccacgcatcctaagcatgcacccacctatatgtacatgtgttttgtctgtgttttcagttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaaggtaagagaggatccagtttgcagcagttattcagagtgagcccgaggtttgcacacttcaatttattgtagtttgtttcaattcatctaatttttgctaaacccctgccatgtggtgaacagtgttcagtaaacgagatggaaatggtccctgacctcacagagctcatgttctggggtaggagagaggcacatatatagataaaaggagtatgttcaggagaaagatattgtaggtcatttgttcactcaacaaatgtaacgggctcttccgctggtgtcacctatcagatagatgctggtgaaccacgtgtaaaagggaaagctggagtattggaggggatgccatctcgctctcatgagtgtgtgtgtgtgtttgtgagtgcacatttcatttccttttttatttgcagcataacacacaaactgaaggtaaagtacacagagtgccaccatcctatgtgtacagtttgaaaataatttagctgtgttagatactgtcttagtcagcttgggctactataataaaataccatagtctaggtggcttaaataacagacatttacttctcatagctctggaggctgtaagtctgagatcagggtgccagcataattggattcctggggaagccctctcttcctggcttgctgatggctcccttactgctatattctcacatggttgagagagacagtgctggtatatcttcctttttacaaataaaggcactcatgctatcactggggcacctgcttcattaccttgcataattacccctaaaagccctgcctccaaataccatcaagttgagggttagagctttaatatagggatttaggtggggacacaacatccaattcatatcagacacccctgtaaacaccaccagataaagacatgaaacattcccaccactgcagaaggtgttcataccccttctctgacagcatctgccccccataagttaatcattcatttgatacctatcaccatagattaattttatctcttcttggaatttcatgtaaatggagccaaattatatgtaatcttttgcatttggcttcttttactcaaaatattctctgtgagattagtccacgtgttgcatgtatcagatgtttgttgttttagctggctgcaaagtatttcattatgtgaatctgtaaaaatgttcccccatcctattgttaatgaactttgggttatttccaatttaagatggttttctagaagcaattcagaagaataaatggaattttttcctgtagaacttgatggtacagccattaagtaagacccacagactgcagctatgcattatcctgtagcaacaaagcaatgaaaatgacctcattttgcttatgaagatacaccctatgttggactctatgatagagggattgggttatttccctgctgtgcccccagatctctaatggcccatccagacatctatttggctgcagcaaaggttcaagctaaggcatagatgacatcttcaaaagtcaaaaagtcaggtgtgatctggattttcataggaaattatcttcaaataatactgtcattctctgttttaagcaaattcttactctgtgtccttctcaaaaggacttgaactggtttttattaagttccaccattaaaaaaatgaaaacagacataaaattataaagcccattgggaaaatttaggttggaggtgtagggtggaaaagactaaggaaattaaggagaaatatagcaaatgagtatgtagttacaagctgagcttctagtaaggcaaagcaataaggaatatgggatcattttcatagcttatatctgtgtatcaagcacacttgaaggaaattattgcatgatactcacatttgtcattttttctagaccttttgcttaaaccattgccatggtttgaatatttgtgccccccaaaactcatgatgaaacttgtaaaccaaaaataaaatcctaaggccccatcccgccagccatctgaatggacttcctccttagccagggttcttttaaaatttaacctgagagactgtttcaggccatgataggaagtgggagtgggacatgcctcattatacctctctggtattaacatcaatacagactttaagtctgattaaaaaaaaaagattacaacctgttctgtctaaagcctagtgccagtacctaaaagcttcctctgcaaataagaacttgggtctccacaattatttatcttaactaaggcattcctttctattgatcccaggtctttagataaactcaaccaattgtcaaccagaaaaatttaaatctacctataagctggaagcccccgcttcaagttgccccacctttctggaccaaaccaatgtattttttaaatgtgtttgattgatgtcttatgtctccctaaaatgtataaaaccaaggtgcaccctgaccaatttgggcacgtgttctcaggacatcctgagggctctgtcatggccatggtcactcatgtttggctcagaataaatctcttcaaatgttttacagagtttggctcctttcatcaacaaactcaatccccagtgtaacagtagtaagcggtggggcatttaagagatgattgggcctcatgagggattaatggattaatgggttatcctgttagtgggttagttttggagagtgggtctgttatataaaaagccagttttgctctacctcgtgagcccctttacaatgtgatgccccgaccctccttgggactctgcggagtccccaacagcaagaaggctctcaccagatgcagcttcttgaccttggactttccagcccctagaactgcaagaaataaatttattttcttcataaattactcagtctccggtactcagttacagcaaaagaaaacagattaagacaatactctattacattctgcataaagaaaagcatgggatggagatggtgttatacgacaggaatacatgctgcaaataatgatcccactacttgctgactaggtgaccttggagcagctacttaaccttgtacatcatgggtttcccctctgtatcatgaggatgatagcacacactccgtgaggttattgtaaaaattaaatgagataacacaggacatggcaagtattcagtactaggtctttttgcagcacttgttttgaaatgtctatagatgtctttagcttttcaaagaacttttatatctaaaatatattccaaaaatattttcaggaaaataaggctggaaacaatctattataaagctggctacagaaagttaaggaacttaaccaagacagctgctgtgctcaggcagctgatcttcccttagttgctggggggtgatctactcctaggggtgtgttaacgagggcaagtcttaaactggcaggaacagacatccaggatttgacaaaaatgtttcaaattagccttagactttttcactacaataatatgtattcatttccctgttatttgtgtcttcagggtgcatgagagttgtggggctcatttaacctgaatcagacatagtaaacaagctagggttttcatccagacctctacaactccatagctcacaattgtaaccactgtgcatagccataagttggcatttgacctggtgaccaatgtctcacctggctcttgtcttccagacactctccagttatccaatcaagagtatgatgggtgcccccattgtttaccggatgttgctacagcaggatctttccaggtgatggggctttgaggattggtaagagagtctggccccatccccctgactccctcacatacattcatgcctatctatctgaatctctcgcacacagagagccccatgaagccatttgcatcatcaaagcacccagaaacccagtctaggcctgagtggactttggttccagggaggctgagggcaaacatttatttctcttcttcagttacaagttcccccatctacagaactgcgtcactgtaggggagtcccttcttccagaaactctggagaactggagggcccagacaggactggacatccgagaatcctatggccagacagaaacggtacctgttcccaggggaaccatgggctgtgtgcactttttgggcttcaaaattctctttgacaataaaaattgttagccaccatgtatcattcatctattcgagaagtatttattgagcctctatgaagggacaggtactgagtattgaaaattccgcacagaacaaaaaaggcaaagttcctgttttctgggagattacattccagtgagatttggggagagagaaaataaactaagaaatatctagcatggcaggtggtgagaaatgcgatggaaaaagtaaagtagatgacatggggtgagaagttggtaaatcagatatggtagtcagaaaattcctctgtgatggggaaacattttagcagagaccaaagtttatcaaacatgtcaagcactgtacaaagctacttagactgaagtgaggaatgggaagaagaacccaccatgactttactgcacctcctgacatatcttcttggaactcttgaggtctcatgtgcacaatgtggatttatgctattctatactattttacttatcaaaactacatggggaatacttttccccaactcttcttctcctttttccagtgcctcttacttgtgactctcagcacttcttgcctcttcctctccactctcttaccctgcatccttctttggctaatgagtacccttggaagaacttttgcagaaggttgacggcagctctgtggtatgaaagagccaggaagagctctgcaaatatgaataaggacaatggagttgtggcaagcataccctggcaggggcctcccaccattcagaggaggacatgtttaggatatgcttacaaggacactcaggttcccatgatcttaatcactcagcagcctctcttctgaggtgggtggataaacttgccctttccagcacagtgggtggcgggaaaagatgggtcattgtgatatcttttgtccaggctagatctgagaaaatgacaatctatgtctctgtcagtgaggcatccaccactcatttgttattctgttgggaaggttcatttcagggttcaagcagaactggtgctgccatgggagatactttaaaaagtatattttactgcttgaggaaatggatacttcattcttcatgatgtgattatttcacattgcatgcctgtatcaaaacatctcatatattccataaatagatacacctatgtacccacaaaaattcaaaataaaaataaaagtagtatattttaggccttacagattgcatattggtgatcccatatagtttgaaagggctttgggtatccatagtgtcgtattaaaatgtggttccccctaaaagagattataatgtgattgttaggtcctcttcctggggagtggtagatgggttgcttcctgaactaacaatttagcgaagcccctaggattgtggttccagtaatggggagagagccagggaatgaggagcagggggagccaccaagtgcaggccaagttcaggacagtgtcaggacctgctctgcagaaattttttctttttctgtgaccttgtacctcctcctgaggtttgctgatctgtctgcttctttccacagggattaacttgcatggtttccaagacaatgaaaatcaaaccaggatacatgggaacggctgcttcctgttatgatgtacaggtttgctcgggacactgaggagggaggaagttaggggaaacactgattttcagtgatttatgttttccattgtttattgagtcaaaaataatagaaagtactgatattaagataacataagaaaaaaaggaggtagggaggttgggggaaggaaagagtgagggaaggaaggaggaaaaggggaaatgatttatattcttaccatccagaaggacccactttgaatagctagcaaattagctagacagtacacaagtatatatgctttaaaaacagaaatggggtgaatcttgacataatattttgtaactagcttttatcatttaacaatttaggtaaggatcttttcagttcaattaatgccaacctgcagcatgatttttaatgatgtagtaaatagtatatatccactgctgtttatgccttttattggaccaagggatgatgtcccagttttcactagtaaaaatacactataatgaatgtgtagtagctaaagttttattgctttctcttgttgttttttgagaactagaatttgtgtttgtgtatctgtgttatgtgtatagttctgtatatctaaagtgtaacttagactctattcagtgtcatatccagttacttgccatgccattcactatgataaccatttgctaagcccctttcttagtatcttatttcattcctataaaaatcctgtgaaataagctgtcagtatctgttttatgggcgaaagcactgaagcccagagtttaagtagttcaaagtcagctagtaaggtagcagagtaaatttgagttttgatctgcccgatttctaagtccacaggtgaggcaggtctcaaagataagaggaggctattactttatctgagctcctagagccaaaagcatctccccaggctcatctgggccagtctcaataaaaggattcacctaaactattccaggcagatagatcagagatctgagtttaagactcttgggttcccctggcttctggttgttgttttcagtctccactagagcaagagggtctttcatttgaccaattcagcaatctcatgatgccattgaagccatctcctgctgtgtgcatcattcttccaatctgcttctttctccagatcatagatgataagggcaacgtcctgccccccggcacagaaggagacattggcatcagggtcaaacccatcaggcctataggcatcttctctggctatgtggtgagaaactgtgctcctcctcctctgttccccagtgaggatgggagcactaaacgggatgagggaggacaaatgttctgaaacttccaagaggcactagatgtggagacaaagactgtccagttttcaagaatgtatgctttgccagtggaagaaaagtggctattcagccttgccatcctcagcctatcactgtgatctcattggaagacttatttttcttcagttagcccttagactcctcaagaactctctgtttcatgcccaaaatattattgaccctgaactatacacagcaccattcccccaagggctgcctttccctctcccctaggtatcatccccatgctctatgccattgatcttctttagagccatgccaggcactttacagtaagacttcaccatctagttggaggaatccctatcttcagatcttgggaaggtaaagacagataatccttgaatctggccacctcacttgacaggtgaggatggtggagccagagattacaagacttgctcaagctcacaaccattagaaagtggacagagaagaccccaagggcatgccttctgatccctgagagaattgattaataaactaaataaacaataaatcaaataataatagtttctaccatttattgaatgcatatcatgaggcaagcattgtcctataaacacatttaatctttaaactttaaactcatttaaactttaaactcgtttaatcctcccagccaccctataaagtttttggactcagtttgctcgagttcaaaaccctgctctactatgtattgcatgatcttagggaagttacctatctgtcatgtctcagtttcctcatctgtaagttgtgtgtcgtgagtgtgttaaataaaagaattgttgtagatccaaatgattattcctattatacagatgaggaaaactgagcctcagtgatcagggcagagccacactgtccccttctccaagcatttcctttgtgtggtcccactctattctcaaatgccagtgaagtactatgtcatgggcttctccccatttgacagaaaaggaaacagactcagaagcgtctgtggggcagactcctaaggccacagaggctccatgatgcccatgagaaagtcaatccagtggccaagaaacctggcttctggtctcagttctaccttctgtaatggctgtttagcttcagactaacctcttgatgtctctggtcatcagtatccctatattcccaatgatagagtgaggctaagaatcctttatgccaccatatataatccagtaactgaacttccagtctggagcccatgcccctatacctgagtcagataggaagatgcactgacaagggataaacctcaagccttttcattgcttataagcaagtgcctcagctgaatagacggacccagctattgtagaaatatgcacattagccagggtcccagggggcttcctggctaatgtctctagaactttcaaatttaacaaagaagctaagaaaattacctaatcaaaatgatagctttgagtggtgctatggagtgagcagagattaggatatctatgaaaggagagatggaatcaattggggaaaatgccctaagcatggatgaatgaatacatcaataatatctatcagactggacctagaggagtagctgagagaccctgggtggaataacttcaataaatgggaaagatccagttctgcctgtggcctagggttggctggttcagggcatgtctgccatgttcaggttatacactgcacacctgcagttttaataagactcatagcatttgttcatggcagccccagggcaggggatttaggctttgcaggcacaatgactctgtctttctgtggtcaccaggacaatcccgacaagacagcagccaacattcgaggagacttttggctccttggagaccggggaatcaaagatgaagatgggtatttccagtttatgggacgggcaaatgatatcattaactccagcgggtgagcttggtttctgggttgggaagggaaatctgggtctttactctggctggttccagacttctggaatggcctagaggttcggtgtccagtgttctctgaaggacaggttcttctgcaggtaccggattggaccctcggaggtagagaatgcactgatggagcaccctgctgtggttgagacggctgtgatcagcagcccagaccccgtccgaggagaggtgatggggaagcagtagcctgggggtgaacacatatgaacacaagggcagtgtagtatgatggtttaagaacagggactgtggggctgaacactctgagacccaatcttggccctgccacttactagctatgtgaccttgggcaagctacttggcctctctgtttctcagtttccccatctgtaagatgagggattgttatgagggttaaatgtgctaatatttgtaaagtacttaagtatggtgatttctaaaaaaactaaacagaactaccatacgatccagcaatcccactactgggtatttatccaaaggaaaagaaatcagcatatcaagaagatgtccacactcccatggtaattgcagcactattcacaatacgaagatatgggatcaacctaagtatccagtggatgaaaggataaataatatgtggtatatatacacaatggaatactatttggtgttaaaaaagaatgaaatcatgtcatctgcagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaacttttataaagtaaagtgcttggttgggaggccgaggcagatggatcacgaggtcaggagtccaagaccagcctggccaagatggtgaaaccccatctctactaaaaatacaaaaattggccaggcatggtggcaggcatctgtaatcccagctactcaagaggctgcggcaggagaatcacatgaacccggggggcggagtttgcagtgagccgagatcgtgcccctgcactctagcctgggtgacagagtgagactctgtctcaaaaaaaaaaaaaaaaaaaaagaaagaaaaaaaaagaaaaaaagaaagtgaagtgcttggaacaaggcctagcacatagtaagtactatataatgtctattttgatgaggctggaaggattctatcctgctgtttggtatttgaatcagagtctgattcccgaccagaagaacagaggagggatttgagccaaaggacagagcccgtgtgccacagagttcgcagtgaaaataaagggaaaaagaaagacccctataaagccaggcttatagaaataggctcagatggggtctagtggactttgatgtgtgtgtaggaaaatattaaggtgggatgtgtggatcagtgtcctagcacattcccgcagggtgtaagcctggcactatcatacctctggtacgtacagaatacatcatacagaaaattatgggaaccactgagcagtgaggccatgggggatcccctgctgagaaaatcctgtgtgcccagctctgagctagccctgctgtatatgatttcattttatttaccgtaagttaaatttggcaattttatccccactttacagatgggaacactgaagtttggagaagttaacacattgtttagggttatggttttcagtctatttttctcttttctccccctgtatcttctttctccttatctgtctctattgttattggagtatgaggtgagcctagtctcaatcttttgtccacctgctcctccaataaatgacttcagagagagctgtaacctcattcatgtccccagttttctccttttcccttgacctggatcaccgggggtgcaaatgaggagatacaagggtgatggaagtcttaatgccaatttcacattattccaggagatgactacacactctaatcccttctctctggccttcatcttttttgcaggtggtgaaggcatttgtggtcctggcctcgcagttcctgtcccatgacccagaacagctcaccaaggagctgcagcagcatgtgaagtcagtgacagccccatacaagtacccaagaaaggtaaggcctttgagctcccaagtcactcaaacttgagaaatagattgttttcctgttatatttatcttcttcaggaggaggacagtcctctaattttaaaaagtcttcctggctgggcgcggcagctcacgcctgtaatcccagcactttgggaggctgaggcgggtggatcacctgaggtcaggagttcaagatcagcctggccaacatggtgaaaccccatctctacccaaaatgcaaaaattagcccggtgtagtggcatgtgcctgtaatcccagctactcaggaggctgaggcatgagaatcacttgaatctgggaggtggaggttacagtgagccgagattgtgccactgcactgcagcccaggtgacagagtgagactctgtctcaaaaaaaaaaaaaaaaaaaaaaaaaaaaaaaaagtctttctatgatcaagaaagcccagaaagacaatctagcttgatgcctgaaaaatgacctcagcttttgactcactctgaattaaaagccaaatgctatcaagggaataagttctagccagtatcttacctgtattcccattctctgcactgggttcttgctatagtattcagggttgtgcaacgctcagttgcaagtgacagaaatctagcttgacatttattgctcatgcaattgaaaagtccaggggtggggaaagctttcattatggctagtcccaggcattcctaggatgtggtcaggtgtctctctttcaccctttgactctctttcctttgtagtggtttgatttcttggaatgctttttctttgtggctctatcagctccaaacatatattctcagcagcttagaaaactccagtagaaaatgagcatgtttttctccaaaggcctcaacaaaattctctgggttgactctcactggaccaacttgggccatgtgtccattgctaaatgaatccctgtagccaggccaatgtcacactgattagccaagtcatcctcagagaaagtgcaggggggatgggggagagagctgccctaccccatgacatggactgagagggaggggtggctccccacaggaaaagggaagtgttcttacgagaaaagacaaaagcatagttttcagcttctttcattctgggacagagaactgaggcacagaggttgacaaggcaggagaacccagttattggatttgggtcccagataggagcttgtcccagagaaagaaaaaaaattgagtctagggtagaaggtgagagcaactatgctgagcttagagtcccttagattcttatgtagcccagatgccacctgcctttcctcagcacaggctaattgtcataggtcttctgagaagcaggccatggggaaagaggttaccacgcaagaggcttattagggagtgttttggaatcaacccctgggggaagggagaggaagggaaagaaaggagcagaactgagcagacggtgaggttgcactgtgacttagtctcaatgggaactccagccaatcccatgggagttctggagctagtataacctttcagtgttgtcctaaggcaaggtgaggaagggaagggggtctttacagtcacaggtggatcaggtatagatgtgtaggctgccctgggaaggagtgtgaccttggacaagacagctgtctctggctgaggcaatcctcatattggtctggcagtggggtgggacttctttgtccctggaggaggatctcagctgcatatcagagtccaccacatggacttgcagcctctgagaatgaggcagcatagcacagtctcaggaatcagactgttgggttcaacgttcacctccaccagttactcaataacctctgtgatcctcagtttccttatttgcaaaatgagaataatgctgttaccccttcacagattgttaaggatgagttcatttaagaaggcatcagacacttagaagagtgactggcacataataaacatttaataagtattta

SEQ ID NO: 1183 - DNA, 8160 bp, Homo sapiens
ttcatttctgtcgtgaggaacagcagcactcgttcagttgccgagcactagcggtactagttcagcggccgctagtccaagtacctctagcggtactagtccaagtgccgggcactagcagtactaaccagtccagttgccgggtgttagtggtactaaccagtccagttgccgggtgttagtggtactaaccagtccagttgccgggcactaacagtactaatcagtccagttgccgactgctagcggtactagtccagttactgggcactagccatactaaccagtccagttgccgggcactagcagtactagtccaagtgccaggtatcagtggtactaatcagtccagttgccagccgctagcagtactagtccagttaccgggcactagccatactaaccagtccagttactgggcactggtggtacagaccagtccagttgccagccactagcggtactagtactagtccaagtgccgggcagtagcagtactaaccagtccagttgccaggcgctagcagtactaaccagtccagtttccaggcactagtgatactaaccagtccagttgccgggcactagcagtactaaccaatccagttgccagcactagcggtactattcagtccagttgccaggcactagtggttctaaccagtccagttgccggcactatcggtactaaccagtccagttgccagcactagcggtactattcagtccagttgccagcactagcggtactattcagtccagttgccaggcactagtggttctaaccagtccagttgccagcactagcggtactattcagtccagttgccaggcactagtggttctaaccagtccagttgccggcactagcggtactaaccagtccagttgctggcactagcggtactaaccagtccagttgccaggcactagtggttctaaccagtccagttaccaggcactagcggtactaaccagtccagttgccagcactagcggtactattcagtccagttaccaggcactagcggtactaaccagtccagttgctggcactagcggtactaaccagtccagttaccaggcactagcggtactaaccagtccagttgccggcactagcggtactaaccagtccagtttccaggcactagtgatactaaccagtccagttgccggcactagcagtactaaccagtccagttgccggcactagcagcactcgttcatttgccgggcactcgcagtgctagttctttctacggatggaccagtttcttgattcttccgcctgttggcagacattgggttgtttccagttggggctgttttggaagcagctgctgcgggccgcctgctgtgcgtgtctggggctgagccgatgtgtccttttctcctggggaccctcctgtcagagcgtcttcatttctctttccacagcttcccttttctggctgcttttgaggtgtttcgtgatgggatgccttggtggagtgatgctgtgtttctttgctcagccgtgttgagcatctcggatctgcggcgtttcatcaagtttaacatttttcagcaattattctacagatatttttcttccttgctccctttcagcagttccaggacccatgtactcaactgccggatgttgtctcaccgcttacaaaggcttttccctttaaggttttccacgtttctttagagacggtttctgttgccatgtcacgagtttttcccgtgcagcgtctaacctgtcagcaccccacgcaggacacccctctcctcaaacatcggagttttcatgtctagaaattccgccagcgtggttttgtatcctcatgcccctacttaacatggggcgtgtgtgataacgattgcggtgactgtttaaatcctcctcgctaacggatgggacgtgtgtgataacggtggcagtgactgtttaaatcctcctcgctaactgcacccctgctgccagctctggaccagccacagtgttgcacagtcccctcgtttggggcagggacggtgcccctgcgtgatggtggcctgtggccggatgcctgcctgtgggctttgttggatgctgggtatcgtggtcctcctggagatcttaaatcttgttctggggtgtggctgagttcctgggaacagtctgttcctttcaggccatgccttcgtgatgtccagcagacccacagcagtgcctgccccgggtggtgctccccagactgccaggccctgagcgctgtgcctggtgagtggccatgcctcctggcagcaggctgtcccaccctcctcctaatggcttgttgctggcctccaggagcttcctcacagttgcaggtgcttgaggggccgtccacagcctctggcatccactccatcctaggaactctggtgcttgttcccttgacacccaggtctgccccataactcagggaattcactggctccggctacgttcccctgcccgagcctcggcctggaagctctccgggtagtgagctgggcacttgcagggccccctcggttggcagcattttattttgaaataattacagatttaggagaagttaaaataagtagaaagacagtccagaggggcctgtgtgtccttcgagtccagttaatttctcctttcgctggctgtgcttgctgtcatatcgaagaaactgctatgaaatccaagatgatgaagatttgccaccactgtgtttttttctataagttttctagttttagctcttaaatgtaggagtgtaatccatgtttggctaatttttgcatctttcataaagtgagggtcctactttatttccctgcatgcagttatccagttttcccagcaccatttggtgaagactctcctctcccactgagtgatactgacactcttgctgaaaagcatttgattacggtacctggaggtttatttctgggctctctgttccatcccattttctctatgtctgtctttatcccagttcccgctgttttgattactgtcagtttctagcaggctttgaaaccaggatatgtgagtctttcaactttgttcttctgttataaaatggtttggctattctgaacctcttgagatttaataggaattttaggatgggctttttcatttgtgcagaaaatgccactgggggccaggtacggtggctcatacttgtaattccagcactttgggaggctgaggcataaggatcacttgaggccagaagtttgagaccagcctgggaaacatagcaagaccctgcctctacaaaacatacaaaaggaaaatcagccaggggtggaggcacacatctgtggtcctagctactaggcaggatgagatggaagggtcgcttgagcacagaagtttaaagcagtagtgagccgtgatggcaccactgcatgtttccacgggcaactgagtaagaccctgtctcaaaaaaagaaacggaggaagggcgggagggaagagccattgggatgttgataggatttcatttaatcagtagatcactttgggtagtgttgtcatcttaacaatccatgaacatgggatatctttccatttatttaggtattttataatttctttcagcaaactttggtatttttcagccttgagtcttttacctccttggttaaatttattcataagtattttacttttgttgatgctactgaagtggaatttttttttaatttccttttcatattgttcattggtagtgtatagaaatgccactagttttcgtgtgttgactttgtaccctgtgtctttgctgaattcagttagtggggagcacattcttcatggtcttctggatataggatcatgtcatctgcaaataggccttagaaaggcatcctttctaatgtggaaactttctttttctctttatagcctaatcctctcacttagagcatctaatactctgttgaatagaagtggcaaaagcaggcatccctgtcttgttcctgatcctacggaaaagctttcagtccttcaccatggagggtgatgttagctgtaggtttttcttttcttttttttgagacagagttttgctcttgtcgcccaggctggagtgcaatggcacgatctcggctcactgcaacctctgcctcctgggttcaagccattctcttgcctcagcctcccgagtaactgggattataggcatgcaccaccacgcctggctaatttttgtatttttagtagagatggggtttcaccacgttggccagtctggtcttgaattcctgacctcaggtgatctgcccacctcagcctcccaaagtgctgggattacaggcgtgagccatcatgccttgctggttttttcacttaagtggtttttaccacgttgaggaggtttcttctctccccagtttattaagtggttttatcaccaaaaggtgctggttttttttcagatgccttttctgcatcagttgagatgatcatgtgggatttatgtcatgtattgcattgactttcatatgttgactcacttttgcattcctggaataaaccccacttggtcgtggtgtatgatcctctatgtgccattggattcagtttgctagtattttgttgagcatatttgcatctatatttctaagggatattgttctacagttttcttgtagggtatttgtctggctttgttttatgtgctgtgtccagggttttcgtagtacttagcaggaggaatagagaaaagtatttctgttctgtgttaccacaagagaaagtccctgattgacttttaaaagcagcgacatatttatttccaaaagcttctgcttatcactcacagcaacctaagttctgggaccattttgggttattatcctgtaaaaccattttcttgttatgtaatttttctggtttcagactgaagctatatatcttgtatgttttattgcctcttaggaaaagtcagagaattcattctgcaattcgcatttatgtctccaatctgtaacttgatcaacaggtgcacaaaagatctaatttcaaccacttatttattcagcaaacgttgttgagttttggctgtgtgccagggattcagtggtgaagtcagacacagtgcccacagccagagaacccagtgcctaacaatagaggcaaacccgtgagcagaaagctgcaaggtcgtgtgctcagcaggaggtgaggctggggtggctgagcagcgtctgttcagtgctactttcctctgagacgggtccactggcttctcacttattcttgaccaggagacaatatctggaggatgggaaggaaggagttccagaatgttcctggagaacaggactcaggcacacatagaccctgtcttgtgttctgacttcttcaactccccctttcccaacttctggcttttgagagctcaagggccatgacagccgttgacccagtggcaattctgtccacaccagttaagaggtcggaactagtgataaatatgagccttccctgagagttaggagacgcttcatctcatagaacggaaaacattgtttcaactcttacaaaccagcattctgccggattttaaaatggttatttgggaggattatggttcttttactattatcagtagggctggggctgaaggagcagggaaaacggaaggggaacaccctagatgatcaggtgtgaacctctgtgacggtcgcgctcagcagccttgactgatggaatgaagaggttcatctgtaaaccgccccctgtgtggctgcttcagcctctgcccccattccttgtgtcttgctggtggcggctgcattctctctgtatggtaacatccagaatgatgatcacagtaaggaatttgtgattcttgatttcttttgttcctgtgcaaccaatgattttgataaataacctggcaggtttccttcattgtgaaagaacaacctaccttacaaacttcccacataaaacatgtttactttagaaatatcacttgatattacccataaaattacaaatgattatccttaaaaaaaaaaggttaaatttaactctgcatttgtcaaaataaaggaacaaattttatcttttgatagatgactctgatttctgttacttatttccaggctttctagtctgaaaatgctgtaatccataatgattcttggtatttaatgtagacttaaataattcacttgttgatgacttactcctttcaagatttggttggattataatctttctttctttgtttacttagtactgtaagttttgaaagggttacaattcttgggttagttagtctaatgagagaagggatactgggaaggccgtggagcgtaatatttcagcaagtgacaccttgaattcgtgctaaacgctgcattgtgttctgcaggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggtaaagtaaacgcatgcatcccgtcctgagagacaaactgggatgcaggccgacggcccagggcgtgtgagggcgagtggacgggagggaggccatccgcacagccgacggggcgtgtttgctgctcagggagaggctaggtgtcttgctacaccctggagtcatgtcaggaaggtcatgcctgggggatattttgttgtccatgaagaagatgcctgaaagcacactttcccaggaagtagtgaaaatagctttgtcatatcatattatgaacaggcaagatagaagggctcttacaaattctttcttctttttttttaagggatggcatcttggtgtgttgcccaggctggagtgcagtggcaccatcacaactcactgcagtctaaaactcctaggctcaagctgtcctcccttctcagcctcctgagtagctagaacttcaagcacataccaccatgcctggctaattttttatattttttgtagagataggatctcactatgttgcccaggctagtctcaaattcctggcctcaagcaatcctcccacctcagcctctgaaagtgctggaattgcaggcatgagcagtcatgcctgactgtaattactctttagaatggaatcaacaactaactctgttcctaaacttgttgctagttctttccaaatactggtattacttcttagatcattacatactcaatgtgtttatcattacttgaaaaaacttaatgaagtagaaaattacaaaaactaataatcatcataactggcaaaattaccaattacagattttcaggtacctctaaggcaagagctgccagtgtgccccagctccacaatggggactgaaagttgtttgaggctgaggccactaagaaacagtcgtctggtccacatggtgccttccgagctgagtgaaaggcatggatttcagtggtttgtaggaatggaagaaaaaaaatgccccaattgatgagaatgaagcagaaacttcagaaagttcactgggagtttatctcctagaagaggttaaaggcatcaagtttgaaagtctttaagatccatttcggtccaaaactgaaatccttatcactaaccctgcattttctgagcgtgttgaacaaatgttccttgagttctcgatctgaatggagtattaggcgaagtgggaagttttggtttggtggttttgtgttttgttttgaagtcactctcccctgttcagtccagagtaagtgcacagagcaccgtgtaaagaacgcgacttgcacgtgggaaggcttcagagcgcagggccacggccgccgaaaggctttgctgctgggggctgcgtccttgctctagtggccagtcactcacctgctgtctgtccaggagaagaggggtgtccgtaggatggtgtttgcctggggagcagctgggtcgatctttagaggccttggtggaggagcgtggggatgcctccggcagagcagatgggacagagcccctggggcggggggcaggttgacttgactggaatgggaatgtagaagagtggagagttaatgcctggttggcggggggggatctcagtggctttttc
